United States Patent
Brogdon et al.

(10) Patent No.: US 11,851,659 B2
(45) Date of Patent: Dec. 26, 2023

(54) COMPOSITIONS AND METHODS FOR IMMUNOONCOLOGY

(71) Applicants: Novartis AG, Basel (CH); Intellia Therapeutics, Inc., Cambridge, MA (US)

(72) Inventors: Jennifer Brogdon, Sudbury, MA (US); Ming-Wei Chen, Cambridge, MA (US); Hyungwook Lim, Newton, MA (US); Yi Yang, Belmont, MA (US); Morag Stewart, Boston, MA (US); Sarah Hesse, Cambridge, MA (US)

(73) Assignees: Novartis AG, Basel (CH); Intellia Therapeutics, Inc., Cambridge, MA (US)

( * ) Notice: Subject to any disclaimer, the term of this patent is extended or adjusted under 35 U.S.C. 154(b) by 244 days.

(21) Appl. No.: 16/498,361

(22) PCT Filed: Mar. 21, 2018

(86) PCT No.: PCT/US2018/023631
§ 371 (c)(1),
(2) Date: Sep. 26, 2019

(87) PCT Pub. No.: WO2018/175636
PCT Pub. Date: Sep. 27, 2018

(65) Prior Publication Data
US 2021/0071182 A1    Mar. 11, 2021

Related U.S. Application Data

(60) Provisional application No. 62/475,024, filed on Mar. 22, 2017.

(51) Int. Cl.
| | | |
|---|---|---|
| *C12N 9/22* | (2006.01) | |
| *C12N 15/86* | (2006.01) | |
| *C12N 15/113* | (2010.01) | |
| *A61K 35/17* | (2015.01) | |
| *C07K 14/705* | (2006.01) | |

(52) U.S. Cl.
CPC .......... *C12N 15/1138* (2013.01); *A61K 35/17* (2013.01); *C07K 14/70503* (2013.01); *C07K 14/70578* (2013.01); *C12N 9/22* (2013.01); *C12N 15/86* (2013.01); *C07K 2319/30* (2013.01); *C07K 2319/33* (2013.01); *C12N 2310/20* (2017.05); *C12N 2750/14143* (2013.01); *C12N 2800/80* (2013.01)

(58) Field of Classification Search
CPC ...... C12N 9/22; C12N 15/86; C12N 15/1138; C12N 2310/20; C12N 2800/80; C07K 14/70503; C07K 14/70578; C07K 2319/30; C07K 2319/33
See application file for complete search history.

(56) References Cited

U.S. PATENT DOCUMENTS

| | | |
|---|---|---|
| 5,359,046 A | 10/1994 | Capon et al. |
| 5,686,281 A | 11/1997 | Roberts |
| 5,712,149 A | 1/1998 | Roberts |
| 5,874,240 A | 2/1999 | Ni et al. |
| 5,906,936 A | 5/1999 | Eshhar et al. |
| 6,103,521 A | 8/2000 | Capon et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |
| 6,475,481 B2 | 11/2002 | Talmadge |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,265,209 B2 | 9/2007 | Jensen |
| 7,319,143 B2 | 1/2008 | Gross et al. |
| 7,320,787 B2 | 1/2008 | Seed et al. |
| 7,446,190 B2 | 11/2008 | Sadelain et al. |
| 7,446,191 B2 | 11/2008 | Jensen |
| 7,514,537 B2 | 4/2009 | Jensen |
| 7,638,326 B2 | 12/2009 | June et al. |
| 7,741,465 B1 | 6/2010 | Eshhar et al. |
| 7,745,140 B2 | 6/2010 | June et al. |
| 7,754,482 B2 | 7/2010 | Riley et al. |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |

(Continued)

FOREIGN PATENT DOCUMENTS

| | | |
|---|---|---|
| CN | 104611370 A | 5/2015 |
| CN | 105051188 A | 11/2015 |

(Continued)

OTHER PUBLICATIONS

Kunimoto et al, Scientific Reports 2(273): 10 pages, DOI:10.1038/srep00273, 2012.*
Wang et al, Cell 153: 910-918, 2013.*
Perrin, Nature (507): 423-425, 2014.*
Horii et al, PeerJ 1:e230; DOI 10.7717/peerj.230; 2013;14 pages.*
Jinek et al, Science 337: 816-821, 2012.*
Dang et al, Genome Biology 16: 280, 10 pages, DOI 10.1186/s13059-015-0846-3; 2015.*
Hendel et al, Nature Biotechnol. 33(9): 985-989, 2015.*
Montague et al, Nucleic Acids Research 42(Web Server issue): W401-407, 2014.*
GenBank NC_000004.12, *Homo sapiens* Chromosome 4, GRCh38.p13, region 105269700 to 10527600; 2021.*

(Continued)

*Primary Examiner* — Kevin K Hill
(74) *Attorney, Agent, or Firm* — Finnegan, Henderson, Farabow, Garrett & Dunner, LLP

(57) ABSTRACT

The present disclosure is directed to genome editing systems, reagents and methods for immunooncology.

44 Claims, 11 Drawing Sheets

Specification includes a Sequence Listing.

(56) References Cited

U.S. PATENT DOCUMENTS

| | | |
|---|---|---|
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,272,002 B2 | 3/2016 | Powell, Jr. et al. |
| 9,328,156 B2 | 5/2016 | June et al. |
| 9,365,641 B2 | 6/2016 | June et al. |
| 9,394,368 B2 | 7/2016 | Brogdon et al. |
| 9,402,865 B2 | 8/2016 | Powell et al. |
| 9,422,351 B2 | 8/2016 | Scholler et al. |
| 9,446,105 B2 | 9/2016 | Powell, Jr. |
| 9,464,140 B2 | 10/2016 | June et al. |
| 9,481,728 B2 | 11/2016 | June et al. |
| 9,499,629 B2 | 11/2016 | June et al. |
| 9,518,123 B2 | 12/2016 | June et al. |
| 9,540,445 B2 | 1/2017 | June et al. |
| 9,572,836 B2 | 2/2017 | June et al. |
| 9,573,988 B2 | 2/2017 | Brogdon et al. |
| 9,598,489 B2 | 3/2017 | Powell, Jr. |
| 9,708,384 B2 | 7/2017 | Scholler et al. |
| 9,714,278 B2 | 7/2017 | June et al. |
| 9,745,368 B2 | 8/2017 | Milone et al. |
| 9,765,156 B2 | 9/2017 | June et al. |
| 9,777,061 B2 | 10/2017 | Ebersbach et al. |
| 9,815,901 B2 | 11/2017 | Brogdon et al. |
| 9,999,671 B2 * | 6/2018 | Liu ................... C07K 14/4702 |
| 10,689,438 B2 | 6/2020 | Zhang et al. |
| 2003/0060444 A1 | 3/2003 | Finney et al. |
| 2003/0077249 A1 | 4/2003 | Bebbington et al. |
| 2003/0105000 A1 | 6/2003 | Pero et al. |
| 2003/0148982 A1 | 8/2003 | Brenner et al. |
| 2003/0224520 A1 | 12/2003 | June et al. |
| 2004/0038886 A1 | 2/2004 | Finney et al. |
| 2004/0043401 A1 | 3/2004 | Sadelain et al. |
| 2005/0113564 A1 | 5/2005 | Campana et al. |
| 2005/0129671 A1 | 6/2005 | Cooper et al. |
| 2007/0036773 A1 | 2/2007 | Cooper et al. |
| 2008/0131415 A1 | 6/2008 | Riddell et al. |
| 2008/0160090 A1 | 7/2008 | Oraevsky et al. |
| 2008/0254513 A1 | 10/2008 | Cayli |
| 2009/0257994 A1 | 10/2009 | Jensen |
| 2011/0052554 A1 | 3/2011 | Zakrzewski et al. |
| 2011/0158957 A1 | 6/2011 | Bonini et al. |
| 2012/0027802 A1 | 2/2012 | Bonini et al. |
| 2012/0148552 A1 | 6/2012 | Jensen |
| 2012/0302466 A1 | 11/2012 | Sentman |
| 2012/0321667 A1 | 12/2012 | Sentman |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0287748 A1 | 10/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0349402 A1 | 11/2014 | Cooper et al. |
| 2014/0370045 A1 | 12/2014 | June et al. |
| 2015/0017136 A1 | 1/2015 | Galetto et al. |
| 2015/0017141 A1 | 1/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 * | 2/2016 | Brogdon ............ C07K 16/2878 435/328 |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0186208 A1 | 6/2016 | Jaenisch et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0137783 A1 | 5/2017 | Bedoya et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0260268 A1 | 9/2017 | Beatty et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |
| 2018/0044424 A1 | 2/2018 | June et al. |
| 2018/0118834 A1 | 5/2018 | Brogdon et al. |
| 2018/0125892 A1 | 5/2018 | Brannetti et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0252727 A1 | 9/2018 | Garfall et al. |
| 2018/0258149 A1 * | 9/2018 | Motz ............. A61K 39/001119 |
| 2018/0298068 A1 | 10/2018 | Albelda |
| 2018/0312595 A1 | 11/2018 | Brogdon et al. |
| 2018/0344738 A1 | 12/2018 | Behnke et al. |
| 2018/0362975 A1 | 12/2018 | Chen et al. |
| 2019/0000880 A1 | 1/2019 | Motz et al. |
| 2019/0000944 A1 | 1/2019 | Brogdon et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |
| 2019/0263914 A1 | 8/2019 | Brogdon et al. |
| 2019/0269727 A1 | 9/2019 | Fachin et al. |
| 2019/0292238 A1 | 9/2019 | Bitter et al. |
| 2019/0292257 A1 | 9/2019 | Bedoya et al. |
| 2019/0298715 A1 | 10/2019 | Motz et al. |
| 2019/0330356 A1 | 10/2019 | Brogdon et al. |
| 2019/0336504 A1 | 11/2019 | Gill et al. |
| 2019/0375815 A1 | 12/2019 | Engels et al. |
| 2019/0382500 A1 | 12/2019 | Abujoub et al. |
| 2019/0388471 A1 | 12/2019 | June et al. |
| 2019/0389928 A1 | 12/2019 | Posey et al. |
| 2020/0048359 A1 | 2/2020 | Albelda et al. |
| 2020/0055948 A1 | 2/2020 | Daley et al. |
| 2020/0061113 A1 | 2/2020 | Kassim et al. |
| 2020/0087376 A1 * | 3/2020 | Fraietta ................. A61K 35/17 |
| 2020/0131474 A1 | 4/2020 | Berenshteyn et al. |
| 2021/0017266 A1 | 1/2021 | Racine et al. |
| 2021/0123075 A1 | 4/2021 | Chen et al. |

FOREIGN PATENT DOCUMENTS

| | | |
|---|---|---|
| CN | 105158466 A | 12/2015 |
| EP | 0574512 A1 | 12/1993 |
| EP | 0871495 A1 | 10/1998 |
| EP | 1226244 A2 | 7/2002 |
| EP | 1955708 A1 | 8/2008 |
| JP | 2016501531 A | 1/2016 |
| RU | 2560701 | 8/2015 |
| WO | WO 1992/015322 A1 | 9/1992 |
| WO | WO 1995/030014 A1 | 11/1995 |
| WO | WO 1996/023814 A1 | 8/1996 |
| WO | WO 1996/024671 A1 | 8/1996 |
| WO | WO 1997/015669 A1 | 5/1997 |

(56) References Cited

FOREIGN PATENT DOCUMENTS

| | | |
|---|---|---|
| WO | WO 1997/023613 A2 | 7/1997 |
| WO | WO 1998/018809 A1 | 5/1998 |
| WO | WO 1999/000494 A2 | 1/1999 |
| WO | WO 1995/007268 A1 | 11/1999 |
| WO | WO 2000/014257 A1 | 3/2000 |
| WO | WO 2002/033101 A1 | 4/2002 |
| WO | WO 2002/077029 A2 | 10/2002 |
| WO | WO 2002/088334 A1 | 11/2002 |
| WO | WO 2003/057171 A2 | 7/2003 |
| WO | WO 2005/019429 A2 | 3/2005 |
| WO | WO 2005/044996 A2 | 5/2005 |
| WO | WO 2005/118788 A2 | 12/2005 |
| WO | WO 2006/060878 A1 | 6/2006 |
| WO | WO 2008/045437 A2 | 4/2008 |
| WO | WO 2009/150229 A1 | 12/2009 |
| WO | WO 2010/085660 A2 | 7/2010 |
| WO | WO 2010/129469 A1 | 11/2010 |
| WO | WO 2011/059836 A2 | 5/2011 |
| WO | WO 2011/097477 A1 | 8/2011 |
| WO | WO 2011/156430 A2 | 12/2011 |
| WO | WO 2012/004299 A1 | 1/2012 |
| WO | WO 2012/012667 A2 | 1/2012 |
| WO | WO 2012/058460 A2 | 5/2012 |
| WO | WO 2012/079000 A1 | 6/2012 |
| WO | WO 2012/082841 A2 | 6/2012 |
| WO | WO 2012/099973 A2 | 7/2012 |
| WO | WO 2012/127464 A2 | 9/2012 |
| WO | WO 2012/129514 A1 | 9/2012 |
| WO | WO 2012/135854 A2 | 10/2012 |
| WO | WO 2012/138858 A1 | 10/2012 |
| WO | WO 2013/019615 A2 | 2/2013 |
| WO | WO 2013/033626 A2 | 3/2013 |
| WO | WO 2013/040371 A2 | 3/2013 |
| WO | WO 2013/040557 A2 | 3/2013 |
| WO | WO 2013/059593 A1 | 4/2013 |
| WO | WO 2013/074916 A1 | 5/2013 |
| WO | WO 2013/126712 A1 | 8/2013 |
| WO | WO 2013/126729 A1 | 8/2013 |
| WO | WO 2013/126733 A1 | 8/2013 |
| WO | WO 2013/176915 A1 | 11/2013 |
| WO | WO 2013/176916 A1 | 11/2013 |
| WO | WO 2014/011984 A1 | 1/2014 |
| WO | WO 2014/011987 A1 | 1/2014 |
| WO | WO 2014/011988 A2 | 1/2014 |
| WO | WO 2014/011993 A2 | 1/2014 |
| WO | WO 2014/011996 A1 | 1/2014 |
| WO | WO 2014/012001 A2 | 1/2014 |
| WO | WO 2014/031687 A1 | 2/2014 |
| WO | WO 2014/039513 A2 | 3/2014 |
| WO | WO 2014/055442 A2 | 4/2014 |
| WO | WO 2014/055657 A1 | 4/2014 |
| WO | WO 2014/055668 A1 | 4/2014 |
| WO | WO 2014/055771 A1 | 4/2014 |
| WO | WO 2014/059173 A2 | 4/2014 |
| WO | WO 2014/124134 A1 | 8/2014 |
| WO | WO 2014/130635 A1 | 8/2014 |
| WO | WO 2014/138704 A1 | 9/2014 |
| WO | WO 2014/145252 A2 | 9/2014 |
| WO | WO 2014/153270 A1 | 9/2014 |
| WO | WO 2014/165177 A1 | 10/2014 |
| WO | WO 2014/165707 A2 | 10/2014 |
| WO | WO 2014/165825 A2 | 10/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/190273 A1 | 11/2014 |
| WO | WO 2014/191128 A1 | 12/2014 |
| WO | WO 2014/191521 A2 | 12/2014 |
| WO | WO 2014/191527 A1 | 12/2014 |
| WO | WO 2014/0204723 A1 | 12/2014 |
| WO | WO 2015/048577 A2 | 4/2015 |
| WO | WO 2015/073683 A2 | 5/2015 |
| WO | WO 2015/075195 A1 | 5/2015 |
| WO | WO 2015/090229 A1 | 6/2015 |
| WO | WO 2015/090230 A1 | 6/2015 |
| WO | WO 2015/112626 A1 | 7/2015 |
| WO | WO 2015/136001 A1 | 9/2015 |
| WO | WO 2015/142661 A1 | 9/2015 |
| WO | WO 2015/142675 A2 | 9/2015 |
| WO | WO 2015/148860 A1 | 10/2015 |
| WO | WO 2015/157252 A1 | 10/2015 |
| WO | WO 2015/161276 A2 | 10/2015 |
| WO | WO 2015/164740 A1 | 10/2015 |
| WO | WO 2015/164745 A1 | 10/2015 |
| WO | WO 2015/200920 A1 | 12/2015 |
| WO | WO 2016/009326 A1 | 1/2016 |
| WO | WO 2016/011080 A2 | 1/2016 |
| WO | WO 2016/011210 A2 | 1/2016 |
| WO | WO 2016/014501 A1 | 1/2016 |
| WO | WO 2016/014530 A1 | 1/2016 |
| WO | WO 2016/014535 A1 | 1/2016 |
| WO | WO 2016/014553 A1 | 1/2016 |
| WO | WO 2016/014565 A2 | 1/2016 |
| WO | WO 2016/014576 A1 | 1/2016 |
| WO | WO 2016/019300 A1 | 2/2016 |
| WO | WO 2016/021972 A1 | 2/2016 |
| WO | WO 2016/025880 A1 | 2/2016 |
| WO | WO 2016/028896 A1 | 2/2016 |
| WO | WO 16/049024 * | 3/2016 |
| WO | WO 2016/044605 A1 | 3/2016 |
| WO | WO 2016/0049024 A2 | 3/2016 |
| WO | WO 2016/057705 A1 | 4/2016 |
| WO | WO 2016/063264 A1 | 4/2016 |
| WO | WO 2016/065329 A1 | 4/2016 |
| WO | WO 2016/069282 A1 | 5/2016 |
| WO | WO 2016/069283 A1 | 5/2016 |
| WO | WO 2016/073955 A2 | 5/2016 |
| WO | WO2016/054032 A1 | 7/2016 |
| WO | WO 2016/109410 A2 | 7/2016 |
| WO | WO 2016/120217 A1 | 8/2016 |
| WO | WO 2016/142532 A1 | 9/2016 |
| WO | WO 2016/146542 A1 | 9/2016 |
| WO | WO 2016/154596 A1 | 9/2016 |
| WO | WO 2016/160721 A1 | 10/2016 |
| WO | WO2016/164731 A2 | 10/2016 |
| WO | WO 2016/168595 A1 | 10/2016 |
| WO | WO 2016/183041 A2 | 11/2016 |
| WO | WO 2017/015427 A1 | 1/2017 |
| WO | WO 2017/049166 A1 | 3/2017 |
| WO | WO 2017/093969 A1 | 6/2017 |
| WO | WO 2017/117112 A1 | 7/2017 |
| WO | WO 2018/132783 A1 | 7/2018 |
| WO | WO 2018/175733 A1 | 9/2018 |
| WO | WO 2018/198077 A2 | 11/2018 |
| WO | WO 2019/097305 A2 | 5/2019 |
| WO | WO 2019/126574 A1 | 6/2019 |
| WO | WO 2019/237035 A1 | 12/2019 |
| WO | WO 2020/084580 A1 | 4/2020 |
| WO | WO 2021/220132 A1 | 11/2021 |

OTHER PUBLICATIONS

Chopchop, chopchop.cbu.uib.no/results/1642721720510.5486/last accessed Jan. 20, 2022.*
Ko et al, PNAS 108(35): 14566-14571, 2011.*
Wang et al, Nucleic Acids Research 44(3): e30, 9 pages, available online Nov. 2, 2015.*
Ibarra et al, Molecular Therapy 24(Suppl 1): S301, Abstract 761; May 2016.*
Shrikant et al, Immunol. Res. 46: 12-22, 2010), Carty et al (Blood 124, Abstract 203, 2014.*
Tang et al, Cell 154: 1370-1379, 2013.*
Qin et al, Genetics 200: 423-430, 2015.*
Internet Archive Wayback Machine, ChopChop, https://web.archive.org/web/20220000000000*/https://chopchop.rc.fas.harvard.edu, Feb. 5, 2015.*
Labun et al, Nucleic Acids Research 44: W272-W276, available online May 16, 2016.*
Wiles et al, Mammalian Genome 26:501-510, 2015.*
Abaza et al., "Effects of Amino Acid Substitutions Outside an Antigenic Site on Protein Binding to Monoclonal Antibodies of Predetermined Specificity Obtained by Peptide Immunization: Dem-

(56) References Cited

OTHER PUBLICATIONS onstration with Region 94-100 (Antigenic Site 3) of Myoglobin," Journal of Protein Chemistry (1992), vol. 11, No. 5, pp. 433-444.
Almagro et al., "Humanization of Antibodies," Frontiers in Bioscience (2008), vol. 13, pp. 1619-1633.
Appel et al. "Nucleic Acids: from A to Z" p. 221, 2013, edited by S. Muller translated from English, —Moscow: BINOM, Laboratoriya znanii, 2013 backbone (p. 221).
Attianese et al.,"In vitro and in vivo model of a novel immunotherapy approach for chronic lymphocytic leukemia by anti-CD23 chimeric antigen receptor" Blood (2011), vol. 117, No. 18, pp. 4736-4745.
Baeksgaard et al., "Acute tumor lysis syndrome in solid tumors—a case report and review of the literature," Cancer Chemotherapy Pharmacology (2003), vol. 51, pp. 187-192.
Barrett et al., "Relation of clinical culture method to T-cell memory status and efficacy in xenograft models of adoptive immunotherapy," Cytotherapy (2014), vol. 16, No. 5, pp. 619-630.
Barsov "Telomerase and primary T cells: biology and immortalization for adoptive immunotherapy," Immunotherapy (2011), vol. 3, No. 3, pp. 407-421.
Berry al., "Selection of Target Sites for Mobile DNA Integration in the Human Genome" PLoS Comput Biol (2006), vol. 2, No. 11, e157, pp. 1450-1462.
Berry et al., "Comparing DNA integration site clusters with scan statistics" Bioinformatics (2014), vol. 30, pp. 1493-1500.
Berry et al., "Estimating abundances of retroviral insertion sites from DNA fragment length data" Bioinformatics (2012), 28, No. 6, pp. 755-762.
Bondanza et al., "Suicide gene therapy of graft-versus-host disease induced by central memory human T lymphocytes," Blood (2006), vol. 107, No. 5, pp. 1828-1836.
Brady et al., "A method to sequence and quantify DNA integration for monitoring outcome in gene therapy" Nucleic Acids Res (2011), vol. 39, No. 11, e72, pp. 1-8.
Brady et al., "Integration target site selection by a resurrected human endogenous retrovirus" Genes Dev (2009), vol. 23, pp. 633-642.
Brentjens et al., "Treatment of Chronic Lymphocytic Leukemia With Genetically Targeted Autologous T Cells: Case Report of an Unforeseen Adverse Event in a Phase I Clinical Trial," The American Society of Gene Therapy (2010), vol. 18, No. 4, pp. 666-668.
Brentjens et al., "A Phase I Trial for the Treatment of chemo-Refractory Chronic Lymphocytic Leukemia with CD19-Targeted Autologous T Cells," Molecular Therapy (2008), vol. 16, Suppl. 1, p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15," Nature Medicine (2003), vol. 9, No. 3, pp. 279-286.
Brentjens et al., "Genetically Targeted T Cells Eradicate Systemic Acute Lymphoblastic Leukemia Xenografts," Clinical Cancer Research (2007), vol. 13, No. 18, pp. 5426-5435.a.
Brentjens et al., "Safety and persistence of adoptively transferred autologous CD19-targeted T cells in patients with relapsed or chemotherapy refractory B-cell leukemias," Blood (2011). vol. 118, No. 18, pp. 4817-4828.
Brocker et al., "Signals through T Cell Receptor—Chain alone Are Insufficient to Prime Resting T Lymphocytes," J. Exp. Med. (1995), vol. 181, pp. 1653-1659.
Buenrostro et al., "Transposition of native chromatin for multimodal regulatory analysis and personal epigenomics" Nat Methods (2013), vol. 10, No. 12, pp. 1213-1218.
Busque et al., "Recurrent Somatic TET2 Mutations in Normal Elderly Individuals With Clonal Hematopoiesis" Nature Genetics (2012), vol. 44, pp. 1179-1181.
Call "The T Cell Receptor: Critical Role of the Membrane Environment in Receptor Assembly and Function," Annu. Rev. Immunol. (2005), vol. 23, pp. 101-125.

Carpenito et al., "Control of large, established tumor xenografts with genetically retargeted human T cells containing CD28 and CD137 domains," Proc Natl Acad Sci USA (2009), vol. 106, pp. 3360-3365.
Carty et al., "The loss of TET2 promotes CD8+ T cell memory differentiation" J Immunol (2017), vol. 200, No. 1, pp. 82-91.
Cha et al., "IL-7+IL-15 are superior to IL-2 for the ex vivo expansion of 4T1 mammary carcinoma-specific T cells with greater efficacy against tumors in vivo," Breast Cancer Research and Treatment, Kluwer Academic Publishers (2009), vol. 122, No. 2, pp. 359-369.
Cheadle et al., "CAR T cells: driving the road from the laboratory to the clinic," Immunological Reviews (2013), vol. 257, No. 1, pp. 91-106.
Colman et al., "Effects of amino acid sequence changes on antibody-antigen interactions," Research in Immunology (1994), vol. 145, No. 1, pp. 33-36.
Couper et al.,"Anti-CD25 antibody-mediated depletion of effector T cell populations enhances susceptibility of mice to acute but not chronic Toxoplasma gondii infection" The Journal of Immunology (2009), vol. 182, No. 7, pp. 3985-3994.
Daber et al., "Understanding the limitations of next generation sequencing informatics, an approach to clinical pipeline validation using artificial data sets" Cancer Genet (2013), vol. 206, No. 12, pp. 441-448.
Database Biosis [Online], Database accession No. PREV201700298608 dated Dec. 2, 2016 (3 pgs.).
Database WPI Week 201572, *Derwent World Patents Index*, AN 2015-42037B, XP002767532 ( 6pgs.).
Davila et al., "B Cell Aplasia In a Patient with Relapsed B Cell Acute Lymphoblastic Leukemia Following Re-Induction and Consolidation with Autologous T Cells Genetically Targeted to the CD19 Antigen," 53rd ASH Annual Meeting and Exposition (2010) Oral and Poster Abstract.
Döhner et al., "p53 Gene Deletion Predicts for Poor Survival and Non-Response to Therapy With Purine Analogs in Chronic B-Cell Leukemias," Blood (1995), vol. 85, No. 6, pp. 1580-1589.
Dotti et al., "Design and development of therapies using chimeric antigen receptor-expressing T cells," Immunological Reviews (2013), vol. 257, No. 1, pp. 107-126.
Dropulic et al., "Gene-Based Immunotherapy for Human Immunodeficiency Virus Infection and Acquired Immunodeficiency Syndrome," Human Gene Therapy (2006), vol. 17, pp. 577-588.
Dull et al, "A Third-Generation Lentivirus Vector with a Conditional Packaging System," Journal of Virology (1998), vol. 72, No. 11, pp. 8463-8471.
Efimova et al., "The hydroxyl form of 5-methylcytosine-5-hydroxymethylcytosine: a new look at the biological role in the mammalian genome", Ekologicheskaya genetika, Ecological Genetics.
Eshhar et al., "Specific activation and targeting of cytotoxic lymphocytes through chimeric single chains consisting of antibody-binding domains and the γ or ζ subunits of the immunoglobulin and T-cell receptors," PNAS USA 90: 720-724 (1993).
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Flynn et al., "Stem memory T cells (TSCM)—their role in cancer and HIV immunotherapies," Clinical & Translational Immunology (2014), vol. 3, No. 7, pp. 1-7.
Fraietta et al, "Disruption of TET2 promotes the therapeutic efficacy of CD19-targeted T cells", Nature (2018), vol. 558, No. 7709, pp. 307-312.
Fraietta et al., "Ibrutinib enhances chimeric antigen receptor T-cell engraftment and efficacy in leukemia" Blood (2016), vol. 127, No. 9, pp. 1117-1127.
Frey, "Genetically Engineered Lymphocyte Therapy in Treating Patients With B-Cell Leukemia or Lymphoma That is Resistant or Refractory to Chemotherapy," (2015) Clinical Trial NCT01029366.

(56) References Cited

OTHER PUBLICATIONS

Friedmann-Morvinski et al., "Redirected primary T cells harboring a chimeric receptor require costimulation for their antigen-specific activation," Blood 105: 3087-3093 (2005).
Fujiwara et al., "Profiles Of De Novo CD25-Positive Mature B-Cell Lymphomas" Blood (2013), vol. 122, No. 21, pp. 4308 (1-6).
Geiger et al., "Development and Application of Receptor-Modified T Lymphocytes for Adoptive Immunotherapy," Transfusion Medicine Reviews (2001), vol. 15, No. 1, pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gerriets et al., "Metabolic programming and PDHK1 control CD4+ T cell subsets and inflammation" The Journal of Clinical Investigation (2015), vol. 125, No. 1, pp. 194-207.
Gilbert et al., "Genome-Scale CRISPR-Mediated Control of Gene Repression and Activation," *Cell*, vol. 159, No. 3, Oct. 9, 2014, pp. 647-661, © 2014 Elsevier Inc.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors," Journal of Immunotherapy (2002), vol. 25, No. 2, pp. 139-151.
Gong et al., "Cancer Patient T Cells Genetically Targeted to Prostate-Specific Membrane Antigen Specifically Lyse Prostate Cancer Cells and Release Cytokines in Response to Prostate-Specific Membrane Antigen," Neoplasia (1999), vol. 1, No. 2, pp. 123-127.
Gribben et al., "Stem cell transplantation for indolent lymphoma and chronic lymphocytic leukemia," Biol Blood Marrow Transplant (2011), vol. 17, (1 Suppl): S63-S70.
Griffin et al., "Development and applications of surface-linked single chain antibodies against T-cell antigens," Journal of Immunological Methods (2001), vol. 248, pp. 77-90.
Gross et al, "Expression of immunoglobulin-T-cell receptor chimeric molecules as functional receptors with antibody-type specificity" PNAS (1989), vol. 86, pp. 10024-10028.
Gross et al., "Endowing T cells with antibody specificity using chimeric T cell receptors," The FASEB Journal 6:3370-3378 (1992).
Grupp et al., "Chimeric Antigen Receptor-Modified T Cells for Acute Lymphoid Leukemia," New England Journal of Medicine (2013), vol. 368, No. 16, pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines," Blood (2008), vol. 111, No. 12, pp. 5446-5456.
Han et al., "Malignant B Cells Induce the Conversion of $CD4^+$ $CD25^-$ T Cells to Regulatory T Cells in B-Cell Non-Hodgkin Lymphoma," PLOS One (2011), vol. 6, No. 12, e28649.
Hekele et al., "Growth Retardation of Tumors by Adoptive Transfer of Cytotoxic T Lymphocytes Reprogrammed by CD44V6-Specific SCFV:ζ-CHIMERA," Int J. Cancer (1996), vol. 68, pp. 232-238.
Hernandez-Sanchez et al., "TET2 Overexpression in Chronic Lymphocytic Leukemia Is Unrelated to the Presence of TET2 Variations" BioMed Research International (2014) Article ID 814294, pp. 1-6.
Ho et al., "Adoptive immunotherapy: Engineering T cell responses as biological weapons for tumor mass destruction," Cancer Cell (2003), vol. 3, pp. 431-437.
Hollyman et al., "Manufacturing validation of biologically functional T cells targeted to CD19 antigen for autologous adoptive cell therapy," J Immunother (2009), vol. 32, No. 2, pp. 169-180.
Hombach et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Hosing et al., "CARs in Chronic Lymphocytic Leukemia—Ready to Drive," Current Hematologic Malignancy Reports (2012), vol. 8, No. 1, pp. 60-70.
Husebekk et al., "Selection and expansion of T cells from untreated patients with CLL: source of cells for immune reconstitution?," Cytotherapy (2000), vol. 2, No. 3, pp. 187-193.
Ikeda et al., "Recurrent HIV-1 Integration at the BACH2 Locus in Resting CD4+ T Cell Populations during Effective Highly Active Antiretroviral Therapy" The Journal of Infectious Diseases (2007), vol. 195, pp. 716-725.
Imai et al., "Chimeric receptors with 4-1BB signaling capacity provoke potent cytotoxicity against acute lymphoblastic leukemia," Leukemia, 18: 676-684 (2004).
Imai et al., "Genetic modification of primary natural killer cells overcomes inhibitory signals and induces specific killing of leukemic cells," Blood (2005), vol. 106, No. 1, pp. 376-383.
International Search Report and Written Opinion for International Application No. PCT/US2015/067635 dated Jun. 28, 2016.
International Search Report and Written Opinion for International Application No. PCT/US2016/043255 dated Dec. 16, 2016.
International Search Report and Written Opinion for International Application No. PCT/US2016/052260 dated Jan. 16, 2017.
International Search Report and Written Opinion for International Application No. PCT/US2016/068683 dated Jun. 1, 2017.
International Search Report and Written Opinion for International Application No. PCT/US2018/023785 dated Sep. 6, 2018.
International Search Report and Written Opinion from International Application No. PCT/US2011/064191 dated May 1, 2012.
International Search Report and Written Opinion from International Application No. PCT/US2016/027751 dated Jul. 1, 2016.
Irving et al., "The cytoplasmic domain of the T cell receptor zeta chain is sufficient to couple to receptor-associated signal transduction pathways," Cell 64: 891-901 (1991).
Iyer et al., "Prediction of novel families of enzymes involved in oxidative and other complex modifications of bases in nucleic acids" Cell Cycle (2009), vol. 8, No. 11, pp. 1698-1710.
Jena et al., "Chimeric Antigen Receptor (CAR)-Specific Monoclonal Antibody to Detect CD19-Specific T Cells in Clinical Trials," PLOS ONE (2013), vol. 8, No. 3, e57838, pp. 1-12.
Jena et al., "Redirecting T-cell specificity by introducing a tumor-specific chimeric antigen receptor," Blood, May 3, 2010, vol. 116, No. 7, pp. 1035-1044.
Jensen. et al., "Anti-Transgene Rejection Responses Contribute to Attenuated Persistence of Adoptively Transferred CD20/CD19-Specific Chimeric Antigen Receptor Re-directed T Cells in Humans," Biol Blood Marrow Transplant (2010), vol. 16, No. 9, pp. 1245-1256.
Jin et al., "Simplified Method of the Growth of Human Tumor Infiltrating Lymphocytes (TIL) in Gas—Permeable Flasks to Numbers Needed for Patient Treatment" J Immunother (2012), vol. 35, No. 3, pp. 283-292.
Johnson et al., "Gene therapy with human and mouse T-cell receptors mediates cancer regression and targets normal tissues expressing cognate antigen," Blood (2009), vol. 114, No. 3, pp. 535-545.
Jones et al., "Circulating clonotypic B cells in classic Hodgkin lymphoma," Blood (2009), vol. 113, No. 23, pp. 5920-5926.
Joo et al., "Targeted cancer therapy—are the days of systemic chemotherapy numbered?," Maturitas (2013), vol. 76, No. 4, pp. 308-314.
June et al., "Engineering lymphocyte subsets: tools, trials and tribulations," Nat Rev Immunol, (2009), vol. 9, No. 10, pp. 704-716.
Kalos et al., "T Cells with Chimeric Antigen Receptors Have Potent Antitumor Effects and Can Establish Memory in Patients with Advanced Leukemia," Science Translation Medicine (2011), vol. 3, No. 95, 95ra73.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al., "Human 4-1BB regulates CD28 co-stimulation to promote Th1 cell responses," Eur. J. Immunol. (1998), vol. 28, pp. 881-890.

(56) References Cited

OTHER PUBLICATIONS

Kmieciak et al., "Ex vivo Expansion of Tumor-reactive T Cells by Means of Byrostatin 1/Ionomycin and the Common Gamma Chain Cytokines Formulation" Journal of Visualized Experiments (2011) vol. 47, doi: 10.3791/2381, pp. 1-4.
Kochenderfer et al, "A Phase I Clinical Trial of Treatment of B-Cell Malignancies with Autologous Anti-Cd19-CAR-Transduced T Cells," Blood (2010) vol. 116 No. 21 pp. 1179-1180 & 52nd Annual Meeting of the American-Society-Of-Hematology (ASH); Orlando, FL, USA; Dec. 4-7, 2010 abstract.
Kochenderfer et al., "Construction and Pre-clinical Evaluation of an Anti-CD19 Chimeric Antigen Receptor," J Immunother (2009), vol. 32, No. 7, pp. 689-702.
Kochenderfer et al., "Eradication of B-lineage cells and regression of lymphoma in a patient treated with autologous T cells genetically-engineered to recognize CD19," Blood 116: 4099-4102 (2010).
Koehler et al., "Engineered T Cells for the Adoptive Therapy of B-Cell Chronic Lymphocytic Leukaemia," Advances in Hematology (2012), vol. 180, No. 9, pp. 6365-13.
Kohn et al., "CARs on Track in the Clinic," Molecular Therapy (2011), vol. 19, No. 3, pp. 432-438.
Krause et al., "Antigen-dependent CD28 Signaling Selectively Enhances Survival and Proliferation in Genetically Modified Activated Human Primary T Lymphocytes" J. Exp. Med. (1998), vol. 188, Np. 4, pp. 619-626.
Kwon et al., "cDNA sequences of two inducible T-cell genes," Proc. Natl. Acad. Sci. U.S.A., 86(6): 1963-1967 (1989).
Lamanna et al., "Pentostatin, Cyclophosphamide, and Rutuximab Is an Active, Well-Tolerated Regimen for Patients With Previously Treated Chronic Lymphocytic Leukemia," Journal of Clinical Oncology (2008), vol. 24, No. 10, pp. 1575-1581.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Laport et al., "Adoptive transfer of costimulated T cells induces lymphocytosis in patients with relapsed/refractory non-Hodgkin lymphoma following CD34+-selected hematopoietic cell transplantation," Blood (2003), vol. 102, No. 6, pp. 2004-2013.
Laukka et al., "Fumarate and Succinate Regulate Expression of Hypoxia-inducible Genes via TET Enzymes" The Journal of Biological Chemistry (2016), vol. 291, No. 8, pp. 4256-4265.
Lee et al., "T cells expressing CD19 chimeric antigen receptors for acute lymphoblastic leukaemia in children and young adults: a phase 1 doseescalation trial" Lancet (2014), vol. 385, No. 9967, pp. 517-528.
Lee et al., "The Future is Now: Chimeric Antigen Receptors as New Targeted Therapies for Childhood Cancer," Clin. Cancer Res. 18: 2780-2790 (2012).
Lee et al., "In vivo Inhibition of Human CD19-Targeted Effector T Cells by Natural T Regulatory Cells in a Xenotransplant Murine Model of B Cell Malignancy," Cancer Research (2011), vol. 71, No. 8, pp. 2871-2881.
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector," PNAS (2006), vol. 103, No. 46, pp. 17372-17377.
Lipowska-Bhalla et al., "Targeted immunotherapy of cancer with CAR T cells: achievements and challenges," Cancer Immunology Immunotherapy 2012, vol. 61, pp. 953-962.
Macallan et al., "Measurement and modeling of human T cell kinetics," European Journal of Immunology (2003), vol. 33, pp. 2316-2326.
Maher et al., "Human T lymphocyte cytotoxicity and proliferation directed by a single chimeric TCRzeta/CD28 receptor," Nat. Biotechnol. 20: 70-75 (2002).

Mandal et al., "Efficient Ablation of Genes in Human Hematopoietic Stem and Effector Cells Using CRISPR/Cas9," *Cell Stem Cell*, Nov. 6, 2014, 15(5):643-52, vol. 15, No. 5., © 2014 Elsevier Inc.
Maude et al., "Chimeric Antigen Receptor T Cells for Sustained Remissions in Leukemia" The New England Journal of Medicine (2014), vol. 371, No. 16, pp. 1507-1517.
McGuinness et al., "Anti-tumor activity of human T cells expressing the CC49-ζchimeric immune receptor," Hum. Gene Ther. 10: 165-173 (1999).
Milone et al, "Chimeric Receptors Containing CD137 Signal Transduction Domains Mediate Enhanced Survival of T Cells and Increased Antileukemic Efficacy In Vivo," Molecular Therapy (2009), vol. 17, No. 8, pp. 1453-1464.
Molina, "A Decade of Rituximab: Improving Survival Outcomes in Non-Hodgkin's Lymphoma," Annu. Rev. Med. (2008), vol. 59, pp. 237-250.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz et al., "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells," Proc. Natl. Acad. Sci (1994), vol. 91, pp. 4318-4322.
Muthusamy et al., "Defective activation and survival of T cells lacking the Ets-1 transcription factor," Nature (1995), vol. 377, pp. 639-642.
Naldini et al., "In Vivo Gene Delivery and Stable Transduction of Nondividing Cells by a Lentiviral Vector," Science (1996), vol. 272, pp. 263-267.
NCBI accession HM_852952 accessed Sep. 29, 2015 from http://www.ncbi.nlm.nih.gov/nuccore/hm852952.
Nemudryi et al., "TALEN and CRISPR/Cas Genome Editing Systems: Tools of Discovery," *Acta Naturae*, Jul. 2014, vol. 6, No. 3, Copyright © 2014 Park-media, Ltd., pp. 19-40.
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Ninomiya et al, "Tumor indoleamine 2,3-dioxygenase (IDO) inhibits CD19-CAR T cells and is downregulated by lymphodepleting drugs," Blood (2015), vol. 125, No. 25, pp. 3905-3916.
Ocwieja et al., "HIV Integration Targeting: A Pathway Involving Transportin-3 and the Nuclear Pore Protein RanBP2" PLoS Pathog (2011), vol. 7, No. 3, e1001313, pp. 1-14.
Office Action issued received in Russian Patent Application No. 2019133280, dated Sep. 24, 2021, 10 pgs.
Park et al., "Adoptive Immunotherapy for B-cell Malignancies with Autologous Chimeric Antigen Receptor Modified Tumor Targeted T Cells," Discovery Medicine (2010), vol. 9, No. 47, pp. 277-288.
Park et al., "Adoptive Transfer of Chimeric Antigen Receptor Re-directed Cytolytic T Lymphocyte Clones in Patients with Neuroblastoma," Molecular Therapy (2007), vol. 15, No. 4, pp. 825-833.
Partial Search Report and Invitation to Pay Additional Fees for International Application No. PCT/US2016/052260 dated Nov. 16, 2016.
Patel et al., "Impact of chimeric immune receptor extracellular protein domains on T cell function," Gene Therapy (1999), vol. 6, pp. 412-419.
Pauken et al., "Epigenetic stability of exhausted T cells limits durability of reinvigoration by PD-1 blockade" Science (2016), vol. 354, No. 6316, pp. 1160-1165.
PCT International Preliminary Report on Patentability issued in PCT/US2019/036111, dated Dec. 8, 2020, 12 pgs.
PCT International Search Report issued in International Application No. PCT/IB2016/057318 dated May 9, 2017, 9 pgs.
PCT International Search Report issued in PCT/US2019/036111, dated Nov. 7, 2019, 7 pgs.

(56) References Cited

OTHER PUBLICATIONS

PCT Written Opinion of the International Searching Authority issued in International Application No. PCT/IB2016/057318 dated May 9, 2017, 14 pgs.
PCT Written Opinion of the International Searching Authority issued in PCT/US2019/036111, dated Nov. 7, 2019, 11 pgs.
Piper et al., "Chronic lymphocytic leukemia cells drive the global CD4+ T cell repertoire towards a regulatory phenotype and leads to the accumulation of CD4+ forkhead box P3+ T cells" Clinical and Experimental Immunology (2011), vol. 166, No. 2, pp. 154-163.
Porter et al., "Chimeric antigen receptor T cells persist and induce sustained remissions in relapsed refractory chronic lymphocytic leukemia" Science Translational Medicine (2015), vol. 7, No. 303, ra139, pp. 1-25.
Porter et al., "A phase 1 trial of donor lumphocyte infusions expanded and activated ex vivo via CD3/CD28 costimulation," Blood (2006), vol. 107, No. 4, pp. 1325-1331.
Porter et al., "Chimeric Antigen Receptor-Modified T Cells in Chronic Lymphoid Leukemia," The New England Journal of Medicine (2011), vol. 365, No. 8, pp. 725-733.
Porter et al., "Chimeric Antigen Receptor Therapy for B-cell Malignancies," Journal of Cancer (2011), vol. 2, pp. 331-332.
Powell et al., "Large-Scale Depletion of CD25+ Regulatory T Cells from Patient Leukapheresis Samples," Journal of Immunotherapy (2005), vol. 28, No. 4, pp. 403-411.
Powell et al., "Partial Reduction of Human FOXP3+ CD4 T Cells In Vivo After CD25-directed Recombinant Immunotoxin Administration," J Immunother (2008), vol. 31, pp. 189-198.
Priceman et al., "Smart CARs Engineered for Cancer Immunotherapy," Curr Opin Oncol (2015), vol. 27, No. 6, pp. 466-474.
Pronier et al., "Inhibition of TET2-mediated conversion of 5-methylcytosine to 5-hydroxymethylcytosine disturbs erythroid and granulomonocytic differentiation of human hematopoietic progenitors" Blood (2011), vol. 118, No. 9, pp. 2551-2555.
Pule, M. A. et al., "Virus-specific T cells engineered to coexpress tumor-specific recceptors: persistence and antitumor activity in individuals with neuroblastoma," Nat. Med. (2008). vol. 14, No. 11, pp. 1264-1270.
Rapoport et al., "Restoration of immunity in lymphopenic individuals with cancer by vaccination and adoptive T-cell transfer," Nature Medicine (2005), vol. 11, No. 11, pp. 1230-7.
Ren et al., "Multiplex Cripsr/Cas9 Genome Editing to Generate Potent Universal CART and PD1—Deficient Cells Against Leukemia," *Blood* 2015 126;4280; © 2015 by The American Society of Hematology.
Roederer, "T-cell dynamics of immunodeficiency," Nature Medicine (1995), vol. 1, No. 7, pp. 621-622.
Romeo et al., "Cellular immunity to HIV activated by CD4 fused to T cell or Fc receptor polypeptides," Cell 64:1037-1046 (1991).
Rudikoff et al., "Single amino acid substitution altering antigen-binding specificity," PNAS (1982), vol. 79, pp. 1979-1983.
Rufer et al., "Transfer of the human telomerase reverse transcriptase (TERT) gene into T lymphocytes results in extension of replicative potential," Blood (2001), pp. 597-603.
Sabbagh et al., "TNF family ligands define niches for T cell memory," Trends in Immunology (2007), vol. 28, No. 8, pp. 333-339.
Sadelain et al., "The promise and potential pitfalls of chimeric antigen receptors," Current Opinion Immunology (2009), vol. 21, No. 2, pp. 215-223.
Sadelain et al., "Targeting Tumours with Genetically Enhanced T Lymphocytes," Nature Reviews: Cancer 3: 33-45 (2003).
Sato, Takehito et al., "Establishment of β2-microglobulin deficient human iPS cells using CRISPR/Cas9 system," Integrative Molecular Medicine (2015) vol. 2(6), pp. 373-377.
Savoldo et al., "CD28 costimulation improves expansion and persistence of chimeric antigen receptor-modified T cells in lymphoma patients," The Journal of Clinical Investigation (2011), vol. 121, No. 5, pp. 1822-1826.

Scholler et al., "Decade-Long Safety and Function of Retroviral-Modified Chimeric Antigen Receptor T-cells" Science Translationaal Medicine (2012) vol. 4, No. 132, ra153, pp. 1-16.
Sebestyén et al., "Human TCR That Incorporate CD3ζ Induce Highly Preferred Pairing between TCR α and β Chains following Gene Transfer," Journal of Immunology (2008), vol. 180, pp. 7736-7746.
Shirasun. et al., "Functional Design of Chimeric T-Cell Antigen Receptors for Adoptive Immunotherapy of Cancer: Architecture and Outcomes," AntiCancer Res. 32: 2377-2384 (2012).
Shvidel et al., "Cell surface expression of CD25 antigen (surface IL-2 receptor alpha-chain) is not a prognostic marker in chronic lymphocytic leukemia: results of a retrospective study of 281 patients" Ann Hematol (2012), vol. 91, pp. 1597-1602.
Singapore Search Report and Written Opinion for Singapore Application No. 11201705293W dated Mar. 22, 2018.
Singapore Search Report and Written Opinion for Singapore Application No. 11201708516Y dated Sep. 25, 2018.
Singh et al., "Early memory phenotypes drive T cell proliferation in patients with pediatric malignancies," Science Translational Medicine (2012), vol. 8, No. 320, pp. 320ra3-320ra3.
Slaney et al "Dual-specific Chimeric Antigen Receptor T Cells and an Indirect Vaccine Eradicate a Variety of Large Solid Tumors in an Immunocompetent Self-antigen Setting" Clinical Cancer Research (2017), vol. 23, No. 10, pp. 2478-2490.
Sorror et al., "Outcomes after allogeneic hematopoietic cell transplantation with nonmyeloablative or myeloablative conditioning regimens for treatment of lymphoma and chronic lymphocytic leukemia," Blood (2008), vol. 111, No. 1, pp. 446-452.
Stroncek et al., "Highlights of the society for immunotherapy of cancer (SITC) 27th annual meeting," Journal for ImmunoTherapy of Cancer (2013), vol. 1, No. 4, pp. 1-11.
Tahiliani et al., "Conversion of 5-Methylcytosine to 5-Hydroxymethylcytosine in Mammalian DNA by MLL Partner TET1" Science (2009), vol. 324, pp. 930-935.
Taylor et al., "IL-10 suppresses CD2-mediated T cell activation via SHP-1" Molecular Immunology (2009), vol. 46, pp. 622-629.
Terakura et al., "Generation of CD19-chimeric antigen receptor modified CD8+T cells derived from virus-specific central memory T cells," Blood (2012), vol. 119, No. 1, pp. 72-82.
Till. et al., "Adoptive immunotherapy for indolent non-Hodgkin lymphoma and mantle cell lymphoma using genetically modified autologous CD20-specific T cells," Blood (2008), vol. 112, No. 6, pp. 2261-2271.
Torikai, Hiroki et al., "A Foundation for Universal T-Cell Based Immunotherapy: T Cells Engineered to Express a CD-Specific Chimeric-Antigen-Receptor and Eliminate Expression of Endogenous TCR," Blood, Jun. 14, 2012, vol. 1192, No. 24, pp. 5697-5705, 10 pgs., from www.bloodjournal.org by guest on Dec. 11, 2018, © 2012 by The American Society of Hematology.
Tretter et al., "Succinate, an intermediate in metabolism, signal transduction, ROS, hypoxia, and tumorigenesis" Biochimica et Biophysica Acta (2016), vol. 1857, pp. 1086-1101.
Tsukumo et al., "Bach2 maintains T cells in a naive state by suppressing effector memory-related genes" PNAS (2013), vol. 110, No. 26, pp. 10735-10740.
Uckun et al., "Detailed studies on expression and function of CD19 surface determinant by using B43 monoclonal antibody and the clinical potential of anti-CD19 immunotoxins," Blood (1988), vol. 71, pp. 13-29.
Urak et al., "Ex vivo Akt inhibition promotes the generation of potent CD19CAR T cells for adoptiveimmunotherapy" Journal for Immunotherapy of Cancer (2017), vol. 5, No. 1, pp. 7-13.
Verbinnen et al., "Contribution of Regulatory T Cells and Effector T Cell Deletion in Tolerance Induction by Costimulation Blockade1," Journal of Immunology (2008), vol. 181, pp. 1034-1042.
Vinay et al., "Role of 4-1BB in immune responses," Immunology (1998), vol. 10, pp. 481-489.
Wang et al., "CS-1 Re-Directed Central Memory T Cell Therapy for Multiple Myeloma," Blood (2014), vol. 124, No. 21, Meeting Abstract 1114.

(56) References Cited

OTHER PUBLICATIONS

Wang et al., "Phenotypic and Functional Attributes of Lentivirus Modified CD19-specific Human CD8+Central Memory T Cells Manufactured at Clinical Scale," J. Immunother (2012), vol. 35, No. 9, pp. 689-701.
Wilkie et al., "Dual Targeting of ErbB2 and MUC1 in Breast Cancer Using Chimeric Antigen Receptors Engineered to Provide Complementary Signaling," J Clin Immunol (2012), vol. 32, pp. 1059-1070.
Willemsen et al., "Genetic Engineering of T Cell Specificity for Immunotherapy of Cancer," Human Immunology (2003), vol. 64, pp. 56-68.
Wu et al., "Suppression of TET1-Dependent DNA Demethylation Is Essential for KRAS-Mediated Transformation," Cell Reports (2014), vol. 9, pp. 1827-1840.
Xu et al., "Oncometabolite 2-Hydroxyglutarate Is a Comparative Inhibitor of alpha-Ketoglutarate-Dependent Dioxygenases," Cancer Cell (2011), vol. 19, No. 1, pp. 17-30.
Yeh et al., "Mutation of epigenetic regulators TET2 and MLL3 in patients with HTLV-I-induced acute adult T-cell leukemia" Molecular Cancer (2016), vol. 15, No. 15, pp. 1-7.
Zang et al., "Mutations in 5-methylcytosine oxidase TET2 and RhoA cooperatively disrupt T cell homeostasis" The Journal of Clinical Investigation (2017), vol. 127, pp. 2998-3012.
Zhang et al., "Efficiency of CD19 chimeric antigen receptor-modified T cells for treatment of B cell malignancies in phase I clinical trials: a meta analysis," Oncotarget (2015), vol. 6, No. 32, pp. 33961-33971.
Zhang et al., "Down-regulation of TET2 in CD3+and CD34+cells of myelodysplastic syndromes and enhances CD34+cells proliferation," Int J Clin Exp Pathol (2015), vol. 8, No. 9, pp. 10840-10846.
Zhao et al., "A Herceptin-Based Chimeric Antigen Receptor with Modified Signaling Domains Leads to Enhanced Survival of Transduced T Lymphocytes and Antitumor Activity," The Journal of Immunology (2009), vol. 183, pp. 5563-5574.
Zufferey et al., "Multiply attenuated lentiviral vector achieves efficient gene delivery in vivo," Nature Biotechnology (1997), vol. 15, pp. 871-876.
Myadelets "Part 1. Cytology, embryology and general histology"Histology, cytology and human embryology, textbook, Vitebsk:VSMU, 2014, p. 197.
Horii, Takuro et al., "Genome Engineering of Mammalian Haploid Embryonic Stem Cells Using the Cas9/RNA System," *PeerJ*, © 2013 Horii et al., 14 pages.
Moran-Crusio, Kelly et al., "Tet2 Loss Leads to Increased Hematopoietic Stem Cell Self-Renewal and Myeloid Transformation," *Cancer Cell, Cell Press Article*, vol. 20, No. 1, Jun. 6, 2011, 14 pages.
PCT International Preliminary Report on Patentability Chapter I issued in International Application No. PCT/US2018/023631 dated Sep. 24, 2019, 11 pages.
PCT International Search Report issued in International Application No. PCT/US2018/023631 dated Oct. 25, 2018, 7 pages.
PCT Written Opinion of the International Searching Authority issued in International Application No. PCT/US2018/023631 dated Oct. 22, 2018, 10 pages.
Scourzic, Laurianne et al., "TET Proteins and the Control of Cytosine Demethylation in Cancer," *Genome Medicine (2015)*, vol. 7, No. 1, © Scourzic et al, licensee BioMed Central, 16 pages.
Shide, K. et al., "TET2 is Essential for Survival and Hematopoietic Stem Cell Homeostasis," *Leukemia (2012)* 26, © 2012 Macmillan Publishers Limited, www.nature.com/leu, pp. 2216-2223.
PCT International Search Report and Written Opinion of the International Searching Authority received in PCT/IB2019/059162, dated Jan. 21, 2020 (12 pgs.).
Amescua et al., "Limbal stem cell transplantation: current perspectives", Clinical Ophthalmology Apr. 1, 2016, pp. 593-602.
Yang et al. "Universal Corneal Epithelial-Like Cells Derived from Human Embryonic Stem Cells for Cellularization of a Corneal Scaffold", Translational Vision Science & Technology,vol. 7, No. 5, 2018 (16 pgs.)

Bernal et al. "Implication of the β2-microglobulin gene in the generation of tumor escape henotypes," Cancer Immunol. Immunother., 2012, v.61, p. 1359-1371.
Lin et al. "Topical administration of orbital fat-derived stem cells promotes corneal tissue regeneration," Stem Cell Res Ther. 2013; 4(3):72.
Shaw et al. "Novel ROCK inhibitors for the treatment of pulmonary arterial hypertension," Bioorg Med Chem Lett. Oct. 15, 2014;24(20):4812-7. doi: 10.1016/j.bmcl.2014.09.002. Epub Sep. 6, 2014. PMID: 25248678.
Yang et al. "One-Step Generation of Mice Carrying Reporter and Conditional Alleles by CRISPR/Cas-Mediated Genome Engineering," *Cell*, 2013, 154: 1370-1379.
Derksen et al. "Illegitimate WNT signaling promotes proliferation of multiple myeloma cells," PNAS, 2004, vol. 101 No. 16 p. 6122-6127.
Dirks. "Brain tumor stem cells: bringing order to the chaos of brain cancer," J Clin Oncol. Jun. 10, 2008;26(17):2916-24.
Kozhucharova "New Human Embryonic Stem Cell Lines C612 and C910," Cytology, 2009; 51(7):551-558, p. 551.
Kuznetsova "Parenthesis In Text Of Legal Document As A Linguocognitive Phenomenon," Vestnik MGOU. Series: Russian Philology, 2015, N3, pp. 37-43.
Liang et al. "Rapid and highly efficient mammalian cell engineering via Cas9 protein transfection," J Biotechnol. Aug. 20, 2015;208:44-53.
Lopez-Lazaro "The migration ability of stem cells can explain the existence of cancer of unknown primary site. Rethinking metastasis," Oncoscience. May 1, 2015;2(5):467-75.
Mabey "Epidemiology of sexually transmitted infections: worldwide," Medicine (2014), http://dx.doi.org/10.1016/j.mpmed.2014.03.004.
Menzorov et al. "What Collections of Cell Lines Are For," Vavilov Journal of Genetics and Selection, 2016; 20(6): 945-948; p. 947.
Menzorov "Murine and Human Embryonic Stem Cells," Vavilov Journal of Genetics and Selection, 2013; 17(2): 234-245.
Novokhatsky et al. "The Problem of Contamination with Cells and New Approaches to Controlling Continuous Lines," Voprosy Virusologii, 1977; 4: 396-408; pp. 396, 407, 408.
Tran et al. "Survial comparison between glioblastoma multiforme and other incurable cancers," J Clin Neurosci. Apr. 2010;17(4):417-21.
Vechkanov et al. "Foundations of Cell Engineering: a textbook"—Rostov-na-Donu, 2012; pp. 15, 16.
Yangulov et al. "The Effect of Various Cryoprotective Media on the Viability of Cryopreserved Lymphoblastic Cell Lines H-9 and U-937," Problems of Cryobiology. 1991; 3: 46-49.
Zhdanov et al. "The Mystery of the Third Kingdom," Moscow, "Znanie", 1975—176 pages; pp. 124, 125.
Davies et al. "Opportunities and limitations of natural killer cells as adoptive therapy for malignant disease," Cytotherapy. Nov. 2014;16(11):1453-1466.
Gilham et al. "CAR-T cells and solid tumors: tuning T cells to challenge an inveterate foe," Trends Mol Med. Jul. 2012;18(7):377-84.
Labun et al. "CHOPCHOP v2: a web tool for the next generation of CRISPR genome engineering," Nucleic Acids Res. Jul. 8, 2016;44(W1):W272-6. doi: 10.1093/nar/gkw398. Epub May 16, 2016. PMID: 27185894; PMCID: PMC4987937.
Li et al. "Stem cell treatment for Alzheimer's disease," Int J Mol Sci. Oct. 23, 2014;15(10):19226-38.
Marofi et al. "CAR T cells in solid tumors: challenges and opportunities," Stem Cell Res Ther. Jan. 25, 2021;12(1):81.
PCT International Search Report and Written Opinion of the International Searching Authority issued in PCT/IB2021/053413, dated Sep. 7, 2021, 13.
Wiles et al. "CRISPR-Cas9-mediated genome editing and guide RNA design. Mamm Genome," Oct. 2015;26(9-10):501-10. doi: 10.1007/s00335-015-9565-z. Epub May 20, 2015. PMID: 25991564; PMCID: PMC4602062.

(56) References Cited

OTHER PUBLICATIONS

Zhang et al. "Engineering CAR-T cells," Biomark Res. Jun. 24, 2017;5:22.

* cited by examiner

COMPOSITIONS AND METHODS FOR IMMUNOONCOLOGY

RELATED APPLICATIONS

This application claims priority to U.S. Provisional patent application No. 62/475,024, filed Mar. 22, 2017. The entire content of this application is incorporated herein by reference.

SEQUENCE LISTING

The instant application contains a Sequence Listing which has been submitted electronically in ASCII format and is hereby incorporated by reference in its entirety. Said ASCII copy, created on Mar. 15, 2018, is named PAT057662-WO-PCT_SL.txt and is 3,460,141 bytes in size.

BACKGROUND

CRISPRs (Clustered Regularly Interspaced Short Palindromic Repeats) evolved in bacteria as an adaptive immune system to defend against viral attack. Upon exposure to a virus, short segments of viral DNA are integrated into the CRISPR locus of the bacterial genome. RNA is transcribed from a portion of the CRISPR locus that includes the viral sequence. That RNA, which comprises a sequence complementary to the viral genome, mediates targeting of a Cas9 protein to the sequence in the viral genome. The Cas9 protein cleaves and thereby silences the viral target.

Recently, the CRISPR/Cas system has been adapted for genome editing in eukaryotic cells. The introduction of site-specific single-strand breaks (SSBs) or double-strand breaks (DSBs) allows for target sequence alteration through, for example, non-homologous end-joining (NHEJ) or homology-directed repair (HDR).

SUMMARY

In an aspect, the disclosure provides a gRNA molecule including a tracr and crRNA, wherein the crRNA includes a targeting domain that is complementary with a target sequence of a TET2 intron or TET2 intron-exon junction.

In an aspect, the disclosure provides a gRNA molecule, wherein the targeting domain is complementary to a sequence within a genomic region selected from: a) chr4:105146980-105190359; b) chr4:105190506-105233896; c) chr4:105237352-105241338; d) chr4:105241430-105242833; e) chr4:105242928-105243569; f) chr4:105243779-105259618; g) chr4:105259770-105261758; h) chr4:105261849-105269609; i) chr4:105269748-105272563; and j) chr4:105272919-105275047, wherein said genomic region is according to human reference genome hg38, for example, wherein the genomic region is chr4:105269748-105272563 (the intron between exon 9 and exon 10 of TET2).

In an aspect, the disclosure provides a gRNA molecule, wherein the targeting domain is complementary to a sequence within a genomic region selected from chr4:105270624-105270643; chr4:105270630-105270649; chr4:105271863-105271883; chr4:105271340-105271360; chr4:105271204-105271223; chr4:105271526-105271546; chr4:105270350-105270370; chr4:105270268-105270288; chr4:105272182-105272202; chr4:105272465-105272485; chr4:105271387-105271407; chr4:105272436-105272456; chr4:105271924-105271944; chr4:105272323-105272343; chr4:105272057-105272077; chr4:105272309-105272329; chr4:105272324-105272344; chr4:105272324-105272344; chr4:105271184-105271204; chr4:105271190-105271210; chr4:105271295-105271315; chr4:105271292-105271312; chr4:105271458-105271478; chr4:105270635-105270655; chr4:105271173-105271192; chr4:105271232-105271252; chr4:105271845-105271865; chr4:105271849-105271869; and chr4:105271056-105271076.

In an aspect, the disclosure provides a gRNA molecule, wherein the targeting domain is complementary to a sequence within a genomic region selected from chr4:105270624-105270643; chr4:105270630-105270649; chr4:105271387-105271407; chr4:105271924-105271944; chr4:105272323-105272343; chr4:105272057-105272077; chr4:105272309-105272329; chr4:105272324-105272344; chr4:105272324-105272344; chr4:105271184-105271204; chr4:105271190-105271210; chr4:105271295-105271315; chr4:105271292-105271312; chr4:105271458-105271478; chr4:105270635-105270655; chr4:105271173-105271192; chr4:105271232-105271252; and chr4:105271056-105271076.

In an aspect, the disclosure provides a gRNA molecule, wherein the targeting domain is complementary to a sequence within a genomic region selected from chr4:105271863-105271883; chr4:105271340-105271360; chr4:105271204-105271223; chr4:105271526-105271546; chr4:105270350-105270370; chr4:105270268-105270288; chr4:105272182-105272202; and chr4:105272465-105272485. In some embodiments, the gRNA molecule is capable of generating the editing repair pattern described in Table 22 and/or >75% indel frequencies as described in Table 23.

In an aspect, the disclosure provides a gRNA molecule, wherein the targeting domain is complementary to a sequence within a genomic region selected from chr4:105271340-105271360; chr4:105271526-105271546; chr4:105270350-105270370; chr4:105270268-105270288; chr4:105272182-105272202; and chr4:105272465-105272485. In some embodiments, the gRNA molecule is capable of generating the editing repair pattern described in Table 22 and/or >80% indel frequencies as described in Table 23.

In an aspect, the disclosure provides a gRNA molecule, wherein the targeting domain is complementary to a sequence within a genomic region selected from chr4:105270624-105270643, chr4:105270630-105270649, and chr4:105271863-105271883. In an aspect, including in any of the previous aspects, a gRNA molecule of the disclosure includes a targeting domain includes, e.g., consists of, any one of SEQ ID NO: 1000 to SEQ ID NO: 10514, e.g., of Table 1 or Table 2, e.g., includes, e.g., consists of, any one of SEQ ID NO: 10102 to SEQ ID NO: 10324.

In an aspect of the gRNA molecule, including in any of the previous aspects, a gRNA molecule of the disclosure includes a targeting domain that includes, e.g., consists of, a targeting domain sequence listed in Table 2, for example, includes, e.g., consists of, any one of SEQ ID NO: 10148, SEQ ID NO: 10184, SEQ ID NO: 10185, SEQ ID NO: 10188, SEQ ID NO: 10209, SEQ ID NO: 10212, SEQ ID NO: 10317, SEQ ID NO: 10318, SEQ ID NO: 10187, SEQ ID NO: 10224, SEQ ID NO: 10292, SEQ ID NO: 10149, SEQ ID NO: 10177, SEQ ID NO: 10151, SEQ ID NO: 10225 or SEQ ID NO: 10509.

In an aspect of the gRNA, including in any of the previous aspects, a gRNA molecule of the disclosure includes a targeting domain that comprises or consists of SEQ ID NO: 10148, 10149, 10206, 10191, 10515, 10203, 10259, 10136, 10314, 10234, 10290, 10233, 10209, 10224, 10212, 10317, 10318, 10225, 10184, 10185, 10188, 10187, 10292, 10151, 10509, 10281, 10299, 10301, or 10177; or a fragment thereof.

In an aspect of the gRNA, including in any of the previous aspects, a gRNA molecule of the disclosure includes a targeting domain that comprises or consists of SEQ ID NO: 10148, 10149, 10290, 10209, 10224, 10212, 10317, 10318, 10225, 10184, 10185, 10188, 10187, 10292, 10151, 10509, 10281, or 10177; or a fragment thereof.

In an aspect of the gRNA, including in any of the previous aspects, a gRNA molecule of the disclosure includes a targeting domain that comprises or consists of SEQ ID NO: 10206, 10191, 10515, 10203, 10259, 10136, 10314, or 10234; or a fragment thereof.

In an aspect of the gRNA, including in any of the previous aspects, a gRNA molecule of the disclosure includes a targeting domain that comprises or consists of SEQ ID NO: 10191, 10203, 10259, 10136, 10314, or 10234; or a fragment thereof. In some embodiments, the gRNA molecule is capable of generating the editing repair pattern described in Table 22 and/or >75% indel frequencies as described in Table 23.

In an aspect of the gRNA, including in any of the previous aspects, a gRNA molecule of the disclosure includes a targeting domain that comprises or consists of SEQ ID NO: 10148, SEQ ID NO: 10149, or SEQ ID NO: 10206; or a fragment thereof. In some embodiments, the gRNA molecule is capable of generating the editing repair pattern described in Table 22 and/or >80% indel frequencies as described in Table 23.

In some embodiments, the gRNA molecules are capable of generating the editing repair pattern described in Table 22 and/or the indel frequencies described in Table 23. In an aspect of the gRNA molecule, including in any of the previous aspects, the targeting domain includes 17, 18, 19 or, 20 consecutive nucleic acids of any one of the recited targeting domain sequences. In an aspect, including in any of the previous aspects, the targeting domain consists of 17, 18, 19, or 20 consecutive nucleic acids of any one of the recited targeting domain sequences. In an aspect, the 17, 18, 19, or 20 consecutive nucleic acids of any one of the recited targeting domain sequences are the 17, 18, 19, or 20 consecutive nucleic acids disposed at the 3' end of the recited targeting domain sequence. In another aspect, the 17, 18, 19, or 20 consecutive nucleic acids of any one of the recited targeting domain sequences are the 17, 18, 19, or 20 consecutive nucleic acids disposed at the 5' end of the recited targeting domain sequence. In another aspect, the 17, 18, 19, or 20 consecutive nucleic acids of any one of the recited targeting domain sequences do not include either the 5' or 3' nucleic acid of the recited targeting domain sequence.

In an aspect of the gRNA molecule, including in any of the previous aspects, the targeting domain consists of the recited targeting domain sequence.

In an aspect of the gRNA molecule, including in any of the previous aspects, a portion of the crRNA and a portion of the tracr hybridize to form a flagpole including SEQ ID NO: 50 or SEQ ID NO: 51. In an aspect of the gRNA molecule, including in any of the previous aspects, the flagpole further includes a first flagpole extension, located 3' to the crRNA portion of the flagpole, wherein said first flagpole extension includes SEQ ID NO: 55. In an aspect of the gRNA molecule, including in any of the previous aspects, the flagpole further includes a second flagpole extension located 3' to the crRNA portion of the flagpole and, if present, the first flagpole extension, wherein said second flagpole extension includes SEQ ID NO: 57.

In an aspect of the gRNA molecule, including in any of the previous aspects, the tracr includes: (a) SEQ ID NO: 87, optionally further including, at the 3' end, an additional 1, 2, 3, 4, 5, 6, or 7 uracil (U) nucleotides; (b) SEQ ID NO: 65; or (c) SEQ ID NO: 84.

In an aspect of the gRNA molecule, including in any of the previous aspects, the crRNA portion of the flagpole includes SEQ ID NO: 79 or SEQ ID NO: 80.

In an aspect of the gRNA molecule, including in any of the previous aspects, the tracr includes SEQ ID NO: 53 or SEQ ID NO: 54, and optionally, if a first flagpole extension is present, a first tracr extension, disposed 5' to SEQ ID NO: 53 or SEQ ID NO: 54, said first tracr extension including SEQ ID NO: 56.

In an aspect of the gRNA molecule, including in any of the previous aspects, the targeting domain and the tracr are disposed on separate nucleic acid molecules.

In an aspect of the gRNA molecule, including in any of the previous aspects, the crRNA includes, from 5' to 3', [targeting domain]-: a) SEQ ID NO: 50; b) SEQ ID NO: 51; c) SEQ ID NO: 77; d) SEQ ID NO: 78; e) SEQ ID NO: 79; f) SEQ ID NO: 80; or g) SEQ ID NO: 81.

In an aspect of the gRNA molecule, including in any of the previous aspects, the tracr includes, from 5' to 3': a) SEQ ID NO: 53; b) SEQ ID NO: 54; c) SEQ ID NO: 82; d) SEQ ID NO: 83; e) SEQ ID NO: 65; f) SEQ ID NO: 84; g) SEQ ID NO: 87; h) SEQ ID NO: 76; i) SEQ ID NO: 85; j) SEQ ID NO: 86; k) any of a) to j), above, further including, at the 3' end, at least 1, 2, 3, 4, 5, 6 or 7 uracil (U) nucleotides, e.g., 1, 2, 3, 4, 5, 6, or 7 uracil (U) nucleotides; 1) any of a) to k), above, further including, at the 3' end, at least 1, 2, 3, 4, 5, 6 or 7 adenine (A) nucleotides, e.g., 1, 2, 3, 4, 5, 6, or 7 adenine (A) nucleotides; or m) any of a) to 1), above, further including, at the 5' end (e.g., at the 5' terminus), at least 1, 2, 3, 4, 5, 6 or 7 adenine (A) nucleotides, e.g., 1, 2, 3, 4, 5, 6, or 7 adenine (A) nucleotides.

In an aspect of the gRNA molecule, including in any of the previous aspects, the targeting domain and the tracr are disposed on separate nucleic acid molecules, and wherein the nucleic acid molecule including the targeting domain includes SEQ ID NO: 79, optionally disposed immediately 3' to the targeting domain, and the nucleic acid molecule including the tracr includes, e.g., consists of, SEQ ID NO: 65.

In an aspect of the gRNA molecule, including in any of the previous aspects, the targeting domain and the tracr are disposed on a single nucleic acid molecule, and wherein the tracr is disposed 3' to the targeting domain. In an aspect of the gRNA molecule, including in any of the previous aspects involving a sgRNA, the gRNA molecule further includes a loop, disposed 3' to the targeting domain and 5' to the tracr, for example a loop that includes SEQ ID NO: 52.

In an aspect of the gRNA molecule, including in any of the previous aspects, the gRNA molecule includes, from 5' to 3', [targeting domain]-: (a) SEQ ID NO: 71; (b) SEQ ID NO: 72; (c) SEQ ID NO: 73; (d) SEQ ID NO: 74; (e) SEQ ID NO: 75; or (f) any of (a) to (e), above, further including, at the 3' end, 1, 2, 3, 4, 5, 6 or 7 uracil (U) nucleotides.

In an aspect of the gRNA molecule, including in any of the previous aspects, the targeting domain and the tracr are disposed on a single nucleic acid molecule, and wherein said nucleic acid molecule includes, e.g., consists of, said targeting domain and SEQ ID NO: 71, optionally disposed immediately 3' to said targeting domain.

In an aspect of the gRNA molecule, including in any of the previous aspects, the targeting domain and the tracr are disposed on a single nucleic acid molecule, and wherein said nucleic acid molecule includes, e.g., consists of, said targeting domain and SEQ ID NO: 75, optionally disposed immediately 3' to said targeting domain.

In an aspect of the gRNA molecule, including in any of the previous aspects, one, or optionally more than one, of the nucleic acid molecules including the gRNA molecule includes: a) a, e.g., three, phosphorothioate modification(s) at the 3' end of said nucleic acid molecule or molecules; b) a, e.g., three, phosphorothioate modification(s) at the 5' end of said nucleic acid molecule or molecules; c) a, e.g., three, 2'-O-methyl modification(s) at the 3' end of said nucleic acid molecule or molecules; d) a, e.g., three, 2'-O-methyl modification(s) at the 5' end of said nucleic acid molecule or molecules; e) a 2' O-methyl modification at each of the 4th-to-terminal, 3rd-to-terminal, and 2nd-to-terminal 3' residues of said nucleic acid molecule or molecules; or f) any combination thereof.

In an aspect of the gRNA molecule, including in any of the previous aspects, when a CRISPR system (e.g., an RNP as described herein) including the gRNA molecule is introduced into a cell, an indel is formed at or near the target sequence complementary to the targeting domain of the gRNA molecule, for example, an indel that includes a deletion of greater than 10 nucleotides, e.g., 11, 12, 13, 14, 15, 16, 17, 18, 19, 20, 21, 22, 23, 24, 25, 26, 27, 28, 29, 30, 31, 32, 33, 34, or 35 nucleotides.

In an aspect of the gRNA molecule, including in any of the previous aspects, when a CRISPR system (e.g., an RNP as described herein) including the gRNA molecule is introduced into a population of cells, an indel is formed at or near the target sequence complementary to the targeting domain of the gRNA molecule in at least about 40%, e.g., at least about 50%, e.g., at least about 60%, e.g., at least about 70%, e.g., at least about 80%, e.g., at least about 90%, e.g., at least about 95%, e.g., at least about 96%, e.g., at least about 97%, e.g., at least about 98%, e.g., at least about 99%, of the cells of the population, for example, as measured by next generation sequencing (NGS). In an aspect of the gRNA molecule, including in any of the previous aspects, the indel that includes a deletion of greater than 10 nucleotides, e.g., 11, 12, 13, 14, 15, 16, 17, 18, 19, 20, 21, 22, 23, 24, 25, 26, 27, 28, 29, 30, 31, 32, 33, 34, or 35 nucleotides is detected in at least about 5%, e.g., at least about 10%, 15%, 20%, 25%, 30% or more of the cells of the population, for example, as measured by next generation sequencing (NGS).

In an aspect of the gRNA molecule, including in any of the previous aspects, when a CRISPR system (e.g., an RNP as described herein) including the gRNA molecule is introduced into a cell, expression of TET2, e.g., at least one isoform of TET2, is reduced or eliminated in said cell.

In an aspect of the gRNA molecule, including in any of the previous aspects, when a CRISPR system (e.g., an RNP as described herein) including the gRNA molecule is introduced into a cell, a function, e.g., a catalytic function, of TET2 is reduced or eliminated in said cell.

In an aspect of the gRNA molecule, including in any of the previous aspects, the function, e.g., the catalytic function, of TET2 is reduced, e.g., by at least about 10%, 20%, 30%, 40% or 50%, but said function, e.g., said catalytic function, is not reduced by more than about 80%, e.g., is not eliminated, in said cell.

In an aspect of the gRNA molecule, including in any of the previous aspects, when a CRISPR system (e.g., an RNP as described herein) including the gRNA molecule is introduced into a cell, TET2 expression, e.g., expression of at least one TET2 isoform, and/or at least one TET2 function is not altered relative to the level of expression and/or function in the same type of cell but to which said CRISPR system is not introduced (e.g., an unaltered cell of the same type).

In an aspect of the gRNA molecule, including in any of the previous aspects, when a CRISPR system (e.g., an RNP as described herein) including the gRNA molecule is introduced into a cell, no off-target indels are formed in said cell, e.g., as detectible by next generation sequencing and/or a nucleotide insertional assay. In an aspect of the gRNA molecule, including in any of the previous aspects, when a CRISPR system (e.g., an RNP as described herein) including the gRNA molecule is introduced into a population of cells, an off-target indel is detected in no more than about 5%, e.g., no more than about 1%, e.g., no more than about 0.1%, e.g., no more than about 0.01%, of the cells of the population of cells e.g., as detectible by next generation sequencing and/or a nucleotide insertional assay.

In some embodiments, when a CRISPR system (e.g., an RNP as described herein) including the gRNA molecule (e.g., described herein) is introduced into a cell, e.g., a T cell, a non-naturally occurring indel at or near the target sequence of a gRNA described herein is formed, e.g., an indel comprising a non-naturally occurring indel as described in Table 22 is formed. In some embodiments, when a CRISPR system (e.g., an RNP as described herein) including the gRNA molecule (e.g., described herein) is introduced into a population of cells, e.g., a population of T cells, at least 10%, at least 20%, at least 30%, at least 40%, at least 50%, at least 60%, at least 70%, at least 80%, or at least 90% of the cells of the population comprise one or more non-naturally occurring indels at or near the target sequence of a gRNA described herein, e.g., comprise one or more non-naturally occurring indels selected from the indels described in Table 22 (e.g., the indels described in Table 2 associated with a gRNA targeting domain sequence).

In some embodiments, when a CRISPR system (e.g., an RNP as described herein) including a gRNA molecule (e.g., described herein) and a template nucleic acid molecule (e.g., as described herein) is introduced into a cell, e.g., a T cell, a cell comprising heterologous sequence inserted at or near the target sequence of a gRNA is formed. In some embodiments, the heterologous sequence comprises sequence encoding a CAR, e.g., as described herein. In some embodiments, the heterologous sequence comprises sequence encoding a CAR, e.g., as described herein, operably linked to sequence encoding a promoter, e.g., an EF1-alpha promoter, e.g., as described herein. In an aspect the disclosure provides a composition including a first gRNA molecule of any of the preceding gRNA aspects and embodiments. In an aspect, the composition further includes a Cas9 molecule, for example, a Cas9 molecule that includes, e.g., consists of, any one of SEQ ID NO: 90 or SEQ ID NO: 111 to SEQ ID NO: 121 or SEQ ID NO: 123, or for example, an active or inactive S. pyogenes Cas9.

In an aspect of the composition, including in any of the previous composition aspects, the first gRNA molecule and Cas9 molecule are present in a ribonuclear protein complex (RNP).

In an aspect of the composition, including in any of the previous composition aspects, the composition further includes a template nucleic acid, for example, a template nucleic acid that is double-stranded or single stranded, or for example, wherein the template nucleic acid is or is included in a vector, for example, a lentivirus vector, and AAV vector, an adenovirus vector, a plasmid, a minicircle or a nanoplasmid. In an aspect of the composition, including in any of the previous composition aspects, the template nucleic acid includes at least one (e.g., at least a 5' or at least a 3') homology arm, and wherein said homology arm includes sequence homologous to sequence of a TET2 intron. In an aspect of the composition, including in any of the previous composition aspects, the template nucleic acid includes both a 5' and a 3' homology arm, and wherein at least one of the homology arms includes sequence homologous to sequence of a TET2 intron. In an aspect of the composition, including in any of the previous composition aspects, the composition the template nucleic acid includes nucleic acid encoding a chimeric antigen receptor (CAR), for example, a CAR as described herein. In aspects, the CAR is: (a) a CD19 CAR, e.g., as described in herein; or (b) a BCMA CAR, e.g., as described herein. In aspects, the CAR is a CD19 CAR including an antigen binding domain including any one of SEQ ID NO: 160 to SEQ ID NO: 172 or SEQ ID NO: 175. In aspects, the CAR is a CD19 CAR and includes any one of SEQ ID NO: 185 to SEQ ID NO: 197. In other aspects, the CAR is a BCMA CAR including an antigen binding domain including any one of SEQ ID NO: 239 to SEQ ID NO: 412. In aspects, the CAR is a BCMA CAR and includes any one of SEQ ID NO: 849 to SEQ ID NO: 863 or SEQ ID NO: 879 to SEQ ID NO: 899, e.g., includes SEQ ID NO: 859. In an aspect of the composition, including in any of the previous composition aspects, the composition includes a template nucleic acid that includes a promotor, e.g., an EF1-alpha promoter, operably linked to the nucleic acid sequence encoding the CAR.

In an aspect of the composition, including in any of the previous composition aspects, the composition further includes at least one additional gRNA molecule (e.g., a second gRNA molecule; a second gRNA molecule and a third gRNA molecule; or a second gRNA molecule, a third gRNA molecule, and a fourth gRNA molecule), and wherein each gRNA molecule of the composition is complementary to a different target sequence. In an aspect, the at least one additional gRNA molecule, e.g., a second gRNA molecule, the third gRNA molecule (if present), and the fourth gRNA molecule (if present), are complementary to target sequences within the same TET2 intron. In another aspect, the first gRNA molecule, the second gRNA molecule, the third gRNA molecule (if present), and the fourth gRNA molecule (if present) are complementary to target sequence within different genes, for example, the first gRNA molecule is a gRNA molecule of any of the previous gRNA aspects and embodiments (e.g., as described herein), and the second gRNA molecule includes a targeting domain complementary to a target sequence of an inhibitory molecule (e.g., PDCD1), a component of the T cell receptor (e.g., TRAC or TRBC), B2M, or CIITA.

In an aspect of the composition, including in any of the previous composition aspects, the composition is formulated in a medium suitable for electroporation, for example, wherein each of said gRNA molecules is in a RNP complex with a Cas9 molecule described herein, and wherein each of said RNP complexes is at a concentration of less than about 10 uM, e.g., less than about 3 uM, e.g., less than about 1 uM, e.g., less than about 0.5 uM, e.g., less than about 0.3 uM, e.g., less than about 0.1 uM.

In an aspect, the disclosure provides a nucleic acid sequence that encodes a gRNA molecule of any of the preceding gRNA aspects and embodiments or a, e.g., all, components of a composition of any of the preceding composition aspects and embodiments.

In an aspect, the disclosure provides a vector including a nucleic acid of any of the preceding nucleic acid aspects and embodiments, for example, wherein in the vector is selected from the group consisting of a lentiviral vector, an adenoviral vector, an adeno-associated viral (AAV) vector, a herpes simplex virus (HSV) vector, a plasmid, a minicircle, a nanoplasmid, and an RNA vector.

In an aspect, the disclosure provides a method of altering e.g., altering the structure, e.g., sequence of, a target sequence of a cell, including contacting said cell with: a) a gRNA molecule, e.g., more than one gRNA molecule, of any of the preceding gRNA aspects and embodiments and a Cas9 molecule; b) a gRNA molecule, e.g., more than one gRNA molecule, of any of the preceding gRNA aspects and embodiments and nucleic acid encoding a Cas9 molecule; c) nucleic acid encoding a gRNA molecule, e.g., more than one gRNA molecule, of any of the preceding gRNA aspects and embodiments and a Cas9 molecule; d) nucleic acid encoding a gRNA molecule, e.g., more than one gRNA molecule, of any of the preceding gRNA aspects and embodiments and nucleic acid encoding a Cas9 molecule; e) any of a) to d), above, and a template nucleic acid, e.g., a template nucleic acid as described in any of the preceding aspects and embodiments, e.g., as described herein; g) the composition of any of the preceding composition aspects and embodiments; or h) the vector of any of the preceding vector aspects and embodiments.

In an aspect of the method, including in any of the previous method aspects, the gRNA molecule of any of the preceding gRNA aspects and embodiments (or nucleic acid encoding the gRNA molecule of any of the preceding gRNA aspects and embodiments), and the Cas9 molecule or nucleic acid encoding the Cas9 molecule, are formulated in a single composition.

In an aspect of the method, including in any of the previous method aspects, when the composition includes a template nucleic acid, e.g., a template nucleic acid as described in of any of the preceding aspects and embodiments (e.g., as described herein), the template nucleic acid is formulated in a separate composition from the gRNA molecule of any of the preceding gRNA aspects and embodiments (or nucleic acid encoding the gRNA molecule of any of the preceding gRNA aspects and embodiments) and the Cas9 molecule or nucleic acid encoding the Cas9 molecule. In an aspect the more than one compositions are delivered (to a cell) sequentially.

In an aspect of the method, including in any of the previous method aspects, the method results in insertion of at least a portion of the template nucleic acid at or near the target sequence of the gRNA molecule of any of the preceding gRNA aspects and embodiments. In an aspect, insertion occurs at only at one allele.

In an aspect, the disclosure provides a method of engineering a cell to express a chimeric antigen receptor (CAR), including: (a) introducing into said cell a CRISPR system including a gRNA molecule of any of the preceding gRNA aspects and embodiments or a composition of any of the preceding composition aspects and embodiments; and (b) introducing into said cell a template nucleic acid including nucleic acid sequence encoding a CAR; wherein said nucleic acid sequence encoding a CAR is integrated into the genome, e.g., optionally at only a single allele of the genome, at or near the target sequence of said gRNA molecule. In an aspect, the method further includes introducing into said cell one or more CRISPR systems including one or more gRNA molecules complementary to a target sequence of an inhibitory molecule, a component of the T cell receptor, B2M and/or CIITA.

In an aspect of the method, including in any of the previous method aspects, the cell is an animal cell, for example, a mammalian, primate, or human cell, for example, an immune effector cell (e.g., a population of immune effector cells), for example, a T cell or NK cell, e.g., a T cell, e.g., a CD4+ T cell, a CD8+ T cell, or a combination thereof.

In an aspect of the method, including in any of the previous method aspects, the CAR is a CAR described herein, for example: (a) a CD19 CAR, e.g., as described in herein; or (b) a BCMA CAR, e.g., as described herein. In aspects, the CAR is: (a) a CD19 CAR, e.g., as described in herein; or (b) a BCMA CAR, e.g., as described herein. In aspects, the CAR is a CD19 CAR including an antigen binding domain including any one of SEQ ID NO: 160 to SEQ ID NO: 172 or SEQ ID NO: 175. In aspects, the CAR is a CD19 CAR and includes any one of SEQ ID NO: 185 to SEQ ID NO: 197. In other aspects, the CAR is a BCMA CAR including an antigen binding domain including any one of SEQ ID NO: 239 to SEQ ID NO: 412. In aspects, the CAR is a BCMA CAR and includes any one of SEQ ID NO: 849 to SEQ ID NO: 863 or SEQ ID NO: 879 to SEQ ID NO: 899, e.g., includes SEQ ID NO: 859.

In an aspect of the method, including in any of the previous method aspects, the cell is autologous or allogeneic with respect to a patient to be administered said cell.

In an aspect, the disclosure provides a cell as described herein, for example, a cell altered by the method of any of the herein method aspects and embodiments (e.g., by a method described herein). In aspects, the cell includes a first gRNA molecule of any of the preceding gRNA aspects and embodiments (e.g., as described herein), or a composition of any of the preceding composition aspects and embodiments (e.g., as described herein), a nucleic acid, e.g., as described herein, or a vector of any of the preceding vector aspects and embodiments. In aspects, the cell is an animal cell, e.g., a mammalian, primate, or human cell. In aspects, the cell is an immune effector cell (e.g., a population of immune effector cells), e.g., a T cell or NK cell, e.g., a T cell, e.g., a CD4+ T cell, a CD8+ T cell, or a combination thereof.

In an aspect of the cell, including in any of the previous cell aspects, the cell has reduced or eliminated expression of an inhibitory molecule, a component of the T cell receptor (e.g., TRAC, TRBC1, TRBC2, CD3E, CD3D, or CD3G), B2M, CIITA, or combinations thereof, e.g., relative to an unmodified cell of the same type.

In an aspect of the cell, including in any of the previous cell aspects, the cell includes nucleic acid sequence encoding a chimeric antigen receptor (CAR) (e.g., a CAR as described herein) integrated into the genome at a TET2 intron or intron-exon junction, e.g., integrated at only a single allele.

In an aspect of the cell, including in any of the previous cell aspects, the cell includes reduced or eliminated TET2 expression, e.g., expression of at least one TET2 isoform, and/or reduced or eliminated function of TET2, e.g., at least one function of TET2, e.g., catalytic function of TET2, relative to the level of expression and/or function of an unaltered cell of the same cell type.

In an aspect of the cell, including in any of the previous cell aspects, the cell is a T cell and exhibits: (a) enhanced proliferative capacity; (b) enhanced cytotoxicity; (c) a less-exhausted phenotype (e.g., reduced expression of an inhibitory molecule, e.g., PD1, TIM3, LAG3, PD-L1, or combinations thereof); or (d) a Tscm phenotype (e.g., is CD45RA+ CD62L+CD27+CD95+), relative to an unaltered cell of similar type.

In an aspect of the cell, including in any of the previous cell aspects, the cell is autologous with respect to a patient to be administered said cell. In other aspects of the cell, including in any of the previous cell aspects, the cell is allogeneic with respect to a patient to be administered said cell.

In an aspect, the disclosure provides a modified cell, which has reduced or eliminated expression and/or function of TET2, and includes heterologous nucleic acid sequence (e.g., nucleic acid sequence encoding a chimeric antigen receptor, e.g., as described herein) integrated at a site within a TET2 intron, wherein said site within a TET2 intron is selected from: a) chr4:105146980-105190359; b) chr4: 105190506-105233896; c) chr4:105237352-105241338; d) chr4:105241430-105242833; e) chr4:105242928-105243569; f) chr4:105243779-105259618; g) chr4: 105259770-105261758; h) chr4:105261849-105269609; i) chr4:105269748-105272563; and j) chr4:105272919-105275047, wherein the coordinates above are according to hg38.

In an aspect of the cell, including in any of the previous cell aspects, the cell has reduced or eliminated expression and/or function of a component of the T cell receptor, B2M, CIITA or a combination thereof, relative to an unmodified cell of the same type.

In some embodiments, including in any of the previous cell aspects and embodiments, the cell, e.g., the T cell, comprises a non-naturally occurring indel at or near the target sequence of a gRNA described herein, e.g., comprises an indel comprising a non-naturally occurring indel as described in Table 22. In some embodiments, including in any of the previous cell aspects and embodiments, the disclosure provides a population of cells, e.g., a population of T cells, wherein at least 10%, at least 20%, at least 30%, at least 40%, at least 50%, at least 60%, at least 70%, at least 80%, or at least 90% of the cells of the population comprise one or more non-naturally occurring indels at or near the target sequence of a gRNA described herein, e.g., comprise one or more non-naturally occurring indels selected from the indels described in Table 22 (e.g., the indels described in Table 2 associated with a gRNA targeting domain sequence).

In some embodiments, the disclosure provides a cell comprising heterologous sequence inserted at or near the target sequence of a gRNA, e.g., a gRNA described herein. In some embodiments, the heterologous sequence comprises sequence encoding a CAR, e.g., as described herein. In some embodiments, the heterologous sequence comprises sequence encoding a CAR, e.g., as described herein, operably linked to sequence encoding a promoter, e.g., an EF1-alpha promoter, e.g., as described herein. In preferred embodiments, the CAR in expressed in said cell.

In an aspect, the disclosure provides a method of providing an anti-tumor immunity in a subject, the method including administering to the subject an effective amount of a cell of any of the preceding cell aspects and embodiments (e.g., as described herein).

In an aspect, the disclosure provides a method of treating a subject having a disease associated with expression of a tumor antigen, e.g., a proliferative disease, a precancerous condition, a cancer, and a non-cancer related indication associated with expression of the tumor antigen, the method including administering to the subject an effective amount of a cell of any of the preceding cell aspects and embodiments (e.g., as described herein), for example, wherein the disease associated with expression of a tumor antigen is cancer or a non-cancer related indication, for example, wherein the disease is cancer, for example, a cancer selected from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, Hodgkin's lymphoma, plasmablastic lymphoma, plasmacytoid dendritic cell neoplasm, Waldenstrom macroglobulinemia, and pre-leukemia, combinations of said cancers, and metastatic lesions of said cancers.

In an aspect of the method, including in any of the previous method aspects, the method further includes administering a chemotherapeutic agent, for example, cyclophosphamide, fludarabine, or cyclophosphamide and fludarabine.

In an aspect of the method, including in any of the previous method aspects, the method includes administering a lympho-depleting agent or immunosuppressant prior to administering to the subject an effective amount of the cell of any of the preceding cell aspects and embodiments (e.g., as described herein).

In an aspect, the disclosure provides a population of cells including the cell of any of the previous cell aspects and embodiments (e.g., as described herein), wherein at least about 30% of the cells, e.g., at least about 40%, 50%, 60%, 70%, 80% or 90% of the cells, are a cell of any of the preceding cell aspects and embodiments (e.g., as described herein).

In an aspect, the disclosure provides a gene editing system which binds a sequence of a TET2 intron or intron-exon junction, for example, wherein the sequence of a TET2 intron or intron-exon junction is a sequence within a genomic region selected from: a) chr4:105146980-105190359; b) chr4:105190506-105233896; c) chr4:105237352-105241338; d) chr4:105241430-105242833; e) chr4:105242928-105243569; f) chr4:105243779-105259618; g) chr4:105259770-105261758; h) chr4:105261849-105269609; i) chr4:105269748-105272563; and j) chr4:105272919-105275047, wherein said genomic region is according to hg38, for example, wherein the genomic region is chr4:105269748-105272563. In an aspect, the gene editing system is a zinc finger nuclease (ZFN) gene editing system, a TALEN gene editing system, a CRISPR gene editing system, or a meganuclease gene editing system. In an aspect, the gene editing system further includes a template nucleic acid (e.g., as described herein), for example, a template nucleic acid including nucleic acid sequence encoding a CAR (e.g., as described herein). In an aspect of the gene editing system, including in any of the previous gene editing system aspects, when said gene editing system (and/or nucleic acid sequence encoding one or more components of the gene editing system) is introduced into a cell, the nucleic acid sequence encoding the CAR is integrated into the genome of said cell at or near the sequence of a TET2 intron or intron-exon junction bound by said genome editing system.

In an aspect, the disclosure provides a cell, modified by the gene editing system of any of the preceding gene editing system aspects and embodiments (e.g., as described herein).

In an aspect, the disclosure provides a cell including the gene editing system of any of the preceding gene editing system aspects and embodiments (e.g., as described herein).

In an aspect, the disclosure provides a gRNA molecule of any of the preceding gRNA aspects and embodiments (e.g., as described herein), a composition of any of the preceding composition aspects and embodiments (e.g., as described herein), a nucleic acid of any of the preceding nucleic acid aspects and embodiments (e.g., as described herein), a vector of any of the preceding vector aspects and embodiments (e.g., as described herein), a cell (or population of cells) of any of the preceding cell aspects and embodiments (e.g., as described herein), or a gene editing system of any of the preceding gene editing system aspects and embodiments (e.g., as described herein), for use as a medicament.

In an aspect, the disclosure provides a gRNA molecule of any of the preceding gRNA aspects and embodiments (e.g., as described herein), a composition of any of the preceding composition aspects and embodiments (e.g., as described herein), a nucleic acid of any of the preceding nucleic acid aspects and embodiments (e.g., as described herein), a vector of any of the preceding vector aspects and embodiments (e.g., as described herein), a cell (or population of cells) of any of the preceding cell aspects and embodiments (e.g., as described herein), or a gene editing system of any of the preceding gene editing system aspects and embodiments (e.g., as described herein), for use in the manufacture of a medicament.

In an aspect, the disclosure provides a gRNA molecule of any of the preceding gRNA aspects and embodiments (e.g., as described herein), a composition of any of the preceding composition aspects and embodiments (e.g., as described herein), a nucleic acid of any of the preceding nucleic acid aspects and embodiments (e.g., as described herein), a vector of any of the preceding vector aspects and embodiments (e.g., as described herein), a cell (or population of cells) of any of the preceding cell aspects and embodiments (e.g., as described herein), or a gene editing system of any of the preceding gene editing system aspects and embodiments (e.g., as described herein), for use in the treatment of a disease.

In an aspect, the disclosure provides a gRNA molecule of any of the preceding gRNA aspects and embodiments (e.g., as described herein), a composition of any of the preceding composition aspects and embodiments (e.g., as described herein), a nucleic acid of any of the preceding nucleic acid aspects and embodiments (e.g., as described herein), a vector of any of the preceding vector aspects and embodiments (e.g., as described herein), a cell (or population of cells) of any of the preceding cell aspects and embodiments (e.g., as described herein), or a gene editing system of any of the preceding gene editing system aspects and embodiments (e.g., as described herein), for use in the treatment of a disease, wherein the disease is a disease associated with expression of a tumor antigen, e.g., a proliferative disease, a precancerous condition, a cancer, and a non-cancer related indication associated with expression of the tumor antigen.

In an aspect, the disclosure provides a gRNA molecule of any of the preceding gRNA aspects and embodiments (e.g., as described herein), a composition of any of the preceding composition aspects and embodiments (e.g., as described herein), a nucleic acid of any of the preceding nucleic acid aspects and embodiments (e.g., as described herein), a vector of any of the preceding vector aspects and embodiments (e.g., as described herein), a cell (or population of cells) of any of the preceding cell aspects and embodiments (e.g., as described herein), or a gene editing system of any of the preceding gene editing system aspects and embodiments (e.g., as described herein), for use in the treatment of a cancer, wherein the cancer is a hematologic cancer selected from the group consisting of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and pre-leukemia.

In an aspect, the disclosure provides a gRNA molecule of any of the preceding gRNA aspects and embodiments (e.g., as described herein), a composition of any of the preceding composition aspects and embodiments (e.g., as described herein), a nucleic acid of any of the preceding nucleic acid aspects and embodiments (e.g., as described herein), a vector of any of the preceding vector aspects and embodiments (e.g., as described herein), a cell (or population of cells) of any of the preceding cell aspects and embodiments (e.g., as described herein), or a gene editing system of any of the preceding gene editing system aspects and embodiments (e.g., as described herein), for use in the treatment of a cancer, e.g., wherein the cancer is selected from the group consisting of mesothelioma, adenocarcinoma, glioblastoma, colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

DEFINITIONS

Figure 1:
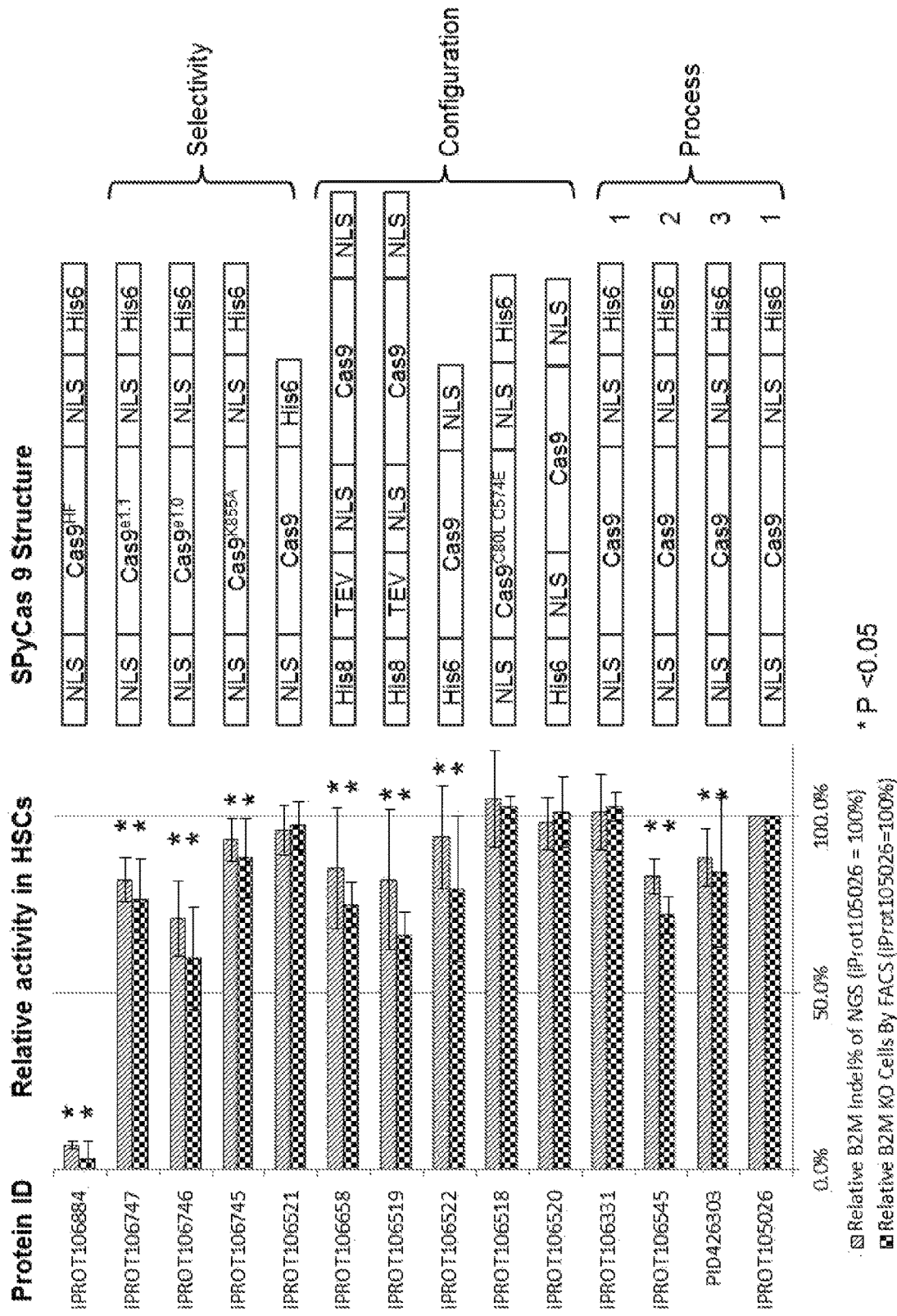
FIG. 1: Editing efficiency at targeted B2M locus in CD34+ hematopoietic stem cells by different Cas9 variants, as evaluated by NGS and Flow cytometry. NLS=SV40 NLS; His6 (SEQ ID NO: 108) or His8 (SEQ ID NO: 109) refers to 6 or 8 histidine residues, respectively; TEV=tobacco etch virus cleavage site; Cas9=wild type *S. pyogenes* Cas9-mutations or variants are as indicated).

The terms "gene editing system" or "genome editing system" refer to a system of one or more molecules comprising at least a nuclease (or nuclease domain) and a programmable nucleotide binding domain, which necessary and sufficient to direct and effect modification (e.g., single or double-strand break) of nucleic acid at a target sequence by the nuclease (or nuclease domain). In embodiments, the gene editing system is a CRISPR system. In embodiments, the gene editing system is a zinc finger nuclease system (ZFN). In embodiments, the gene editing system is a TALEN system. In embodiments, the gene editing system is a meganuclease system. In embodiments, the gene editing system modifies a site within a TET2 intron. In embodiments, the gene editing system further comprises a template nucleic acid, e.g., a template nucleic acid comprising sequence encoding a chimeric antigen receptor, e.g., as described herein. In embodiments, one or more of the components of the gene editing system may be introduced into cells as nucleic acid encoding said component or components. Without being bound by theory, upon expression of said component or component, the gene editing system is constituted, e.g., in the cell.

The terms "CRISPR system," "Cas system" or "CRISPR/Cas system" refer to a set of molecules comprising an RNA-guided nuclease or other effector molecule and a guide RNA molecule that together are necessary and sufficient to direct and effect modification of nucleic acid at a target sequence by the RNA-guided nuclease or other effector molecule. In one embodiment, a CRISPR system comprises a guide RNA and a Cas protein, e.g., a Cas9 protein. Such systems comprising a Cas9 or modified Cas9 molecule are referred to herein as "Cas9 systems" or "CRISPR/Cas9 systems." In one example, the guide RNA molecule and Cas molecule may be complexed, to form a ribonuclear protein (RNP) complex.

The terms "guide RNA," "guide RNA molecule," "gRNA molecule" or "gRNA" are used interchangeably, and refer to a set of nucleic acid molecules that promote the specific directing of a RNA-guided nuclease or other effector molecule (typically in complex with the gRNA molecule) to a target sequence. In some embodiments, said directing is accomplished through hybridization of a portion of the gRNA to DNA (e.g., through the gRNA targeting domain), and by binding of a portion of the gRNA molecule to the RNA-guided nuclease or other effector molecule (e.g., through at least the gRNA tracr). In embodiments, a gRNA molecule consists of a single contiguous polynucleotide molecule, referred to herein as a "single guide RNA," "sgRNA," or "single-molecule DNA-targeting RNA" and the like. In other embodiments, a gRNA molecule consists of a plurality, usually two, polynucleotide molecules, which are themselves capable of association, usually through hybridization, referred to herein as a "dual guide RNA," "dgRNA," or "double-molecule DNA-targeting RNA" and the like. gRNA molecules are described in more detail below, but generally include a targeting domain and a tracr. In embodiments the targeting domain and tracr are disposed on a single polynucleotide. In other embodiments, the targeting domain and tracr are disposed on separate polynucleotides.

The term "targeting domain" as used herein in connection with a gRNA, is the portion of the gRNA molecule that recognizes, e.g., is complementary to, a target sequence, e.g., a target sequence within the nucleic acid of a cell, e.g., within a gene.

The term "crRNA" as used herein in connection with a gRNA molecule, is a portion of the gRNA molecule that comprises a targeting domain and a region that interacts with a tracr to form a flagpole region.

The term "target sequence" refers to a sequence of nucleic acids complementary, for example fully complementary, to a gRNA targeting domain. In embodiments, the target sequence is disposed on genomic DNA. In an embodiment the target sequence is adjacent to (either on the same strand or on the complementary strand of DNA) a protospacer adjacent motif (PAM) sequence recognized by a protein having nuclease or other effector activity, e.g., a PAM sequence recognized by Cas9. The PAM sequence and length may depend on the Cas9 protein used. Non-limiting examples of PAM sequences include 5'-NGG-3', 5'-NGGNG-3', 5'-NG-3', 5'-NAAAAN-3', 5'-NNAAAAW-3', 5'-NNNNACA-3', 5'-GNNNCNNA-3', and 5'-NNNNGATT-3' where N represents any nucleotide, and W represents A or T.

In embodiments, the target sequence is a target sequence of an allogeneic T cell target. In embodiments, the target sequence is a target sequence of an inhibitory molecule. In embodiments, the target sequence is a target sequence of a downstream effector of an inhibitory molecule.

The term "flagpole" as used herein in connection with a gRNA molecule, refers to the portion of the gRNA where the crRNA and the tracr bind to, or hybridize to, one another.

The term "tracr" or "tracrRNA" as used herein in connection with a gRNA molecule refers to the portion of the gRNA that binds to a nuclease or other effector molecule. In embodiments, the tracr comprises nucleic acid sequence that binds specifically to Cas9. In embodiments, the tracr comprises nucleic acid sequence that forms part of the flagpole.

The term "Cas" refers to an RNA-guided nuclease of the CRISPR system that together with a guide RNA molecule are necessary and sufficient to direct and effect modification of nucleic acid at a target sequence. One non-limiting example is a Cas molecule from the Type II CRISPR system, e.g., a Cas9 molecule. Another non-limiting example is a Cas molecule is from a Type V CRISPR system, e.g., a Cpf1 molecule.

The terms "Cas9" and "Cas9 molecule" refer to an enzyme from bacterial Type II CRISPR/Cas system responsible for DNA cleavage. In embodiments, Cas9 also includes wild-type protein, mutant protein, variant protein, including non-catalytic protein, and functional fragments thereof. Non-limiting examples of Cas9 sequences are known in the art and provided herein. In some embodiments, Cas9 refers to a Cas9 sequence that comprises at least about 60%, 65%, 70%, 75%, 80%, 85%, 90%, 95%, 96%, 97%, 98%, or 99% homology with; differs at no more than 1%, 2%, 5%, 10%, 15%, 20%, 30%, or 40% of the amino acid residues when compared with; differs by at least 1, 2, 5, 10 or 20 amino acids but by no more than 100, 80, 70, 60, 50, 40 or 30 amino acids from; or is identical to any Cas9 sequence, e.g., wild-type, mutant, variant, non-catalytic, or functional fragment thereof, known in the art or disclosed herein.

The terms "Cpf1" and "Cpf1 molecule" refer to an enzyme from a bacterial Type V CRISPR/Cas system responsible for DNA cleavage. In embodiments, Cpf1 also includes wild-type protein, mutant protein, variant protein, including non-catalytic protein, and functional fragments thereof. Non-limiting examples of Cpf1 sequences are known in the art. In some embodiments, Cpf1 refers to a Cpf1 sequence that comprises at least about 60%, 65%, 70%, 75%, 80%, 85%, 90%, 95%, 96%, 97%, 98%, or 99% homology with; differs at no more than 1%, 2%, 5%, 10%, 15%, 20%, 30%, or 40% of the amino acid residues when compared with; differs by at least 1, 2, 5, 10 or 20 amino acids but by no more than 100, 80, 70, 60, 50, 40 or 30 amino acids from; or is identical to any Cpf1 sequence, e.g., wild-type, mutant, variant, non-catalytic, or functional fragment thereof, known in the art.

The term "complementary" as used in connection with nucleic acid, refers to the pairing of bases, A with T or U, and G with C. The term complementary can also refer to nucleic acid molecules that are completely complementary, that is, form A to T or U pairs and G to C pairs across the entire reference sequence, as well as molecules that are at least about 80%, 85%, 90%, 95%, or 99% complementary.

As used herein, "template nucleic acid" refers to a nucleic acid sequence which can be used with a gene editing system, e.g., a CRISPR system, to insert nucleic acid sequence at or near a target sequence e.g., in homology-directed repair or homologous recombination. In embodiments, part of the template nucleic acid sequence is inserted at or near a target sequence. In embodiments, all or substantially all of the template nucleic acid sequence is inserted at or near a target sequence. The template nucleic acid can be single- or double-stranded RNA or DNA. In embodiments, the template nucleic acid is a vector, or is included in a vector, for example an AAV vector, plasmid DNA, minicircle or nanoplasmid. In aspects, the template nucleic acid comprises nucleic acid sequence encoding a chimeric antigen receptor (CAR), e.g., as described herein. In aspects, the template nucleic acid comprises or is included in a vector comprising nucleic acid sequence encoding a chimeric antigen receptor (CAR), e.g., as described herein. In embodiments, the template nucleic acid comprises nucleic acid sequence which is complementary to nucleic acid sequence at or near the target sequence.

An "indel," as the term is used herein, refers to a nucleic acid comprising one or more insertions of nucleotides, one or more deletions of nucleotides, or a combination of insertions and deletions of nucleotides, relative to an unmodified reference nucleic acid, that results from being exposed to a composition comprising a gRNA molecule, e.g., a CRISPR system. In some embodiments, an indel comprises nucleotides outside of the target sequence. Indels can be determined by sequencing nucleic acid after being exposed to a composition comprising a gRNA molecule, for example, by NGS. With respect to the site of an indel, an indel is said to be "at or near" a reference site (e.g., a site complementary to a targeting domain of a gRNA molecule) if it comprises at least one insertion or deletion within about 10, 9, 8, 7, 6, 5, 4, 3, 2, or 1 nucleotide(s) of the reference site, or is overlapping with part or all of said reference site (e.g., comprises at least one insertion or deletion overlapping with, or within 10, 9, 8, 7, 6, 5, 4, 3, 2, or 1 nucleotides of a site complementary to the targeting domain of a gRNA molecule, e.g., a gRNA molecule described herein). In embodiments, indels are non-naturally occurring, for example, do not correspond to any naturally-occurring genetic mutation (e.g., insertion, deletion or combination thereof), for example, in the target cell.

An "indel pattern," as the term is used herein, refers to a set of indels that results after exposure to a composition comprising a gene editing system, e.g., a CRISPR system, or gRNA molecule. In an embodiment, the indel pattern comprises or consists of, the top three indels, by frequency of appearance. In an embodiment, the indel pattern comprises or consists of, the top five indels, by frequency of appearance. In an embodiment, the indel pattern comprises or consists of, the indels which are present at greater than about 5% frequency relative to all sequencing reads. In an embodiment, the indel pattern comprises or consists of, the indels which are present at greater than about 10% frequency relative to total number of indel sequencing reads (i.e., those reads that do not consist of the unmodified reference nucleic acid sequence). In an embodiment, the indel pattern includes of any 3 of the top five most frequently observed indels. The indel pattern may be determined, for example, by sequencing cells of a population of cells which were exposed to a gene editing system, e.g., a CRISPR system, e.g., a CRISPR system comprising a gRNA molecule described herein.

An "off-target indel," as the term I used herein, refers to an indel at or near a site other than the target sequence of the targeting domain of the gRNA molecule. Such sites may comprise, for example, 1, 2, 3, 4, 5 or more mismatch nucleotides relative to the sequence complementary to the targeting domain of the gRNA. In exemplary embodiments, such sites are detected using targeted sequencing of in silico predicted off-target sites, or by an insertional method known in the art.

The term "inhibitory molecule" refers to a molecule, which when activated causes or contributes to an inhibition of cell survival, activation, proliferation and/or function. The term also refers to the gene encoding said molecule and its associated regulatory elements, e.g., promoters, enhancers, etc. In embodiments, an inhibitory molecule is a molecule expressed on an immune effector cell, e.g., on a T cell. Non-limiting examples of inhibitory molecules are PD-1, PD-L1, PD-L2, CTLA4, TIM3, LAG3, CEACAM (e.g., CEACAM-1, CEACAM-3 and/or CEACAM-5), VISTA, BTLA, TIGIT, LAIR1, CD160, 2B4, CD80, CD86, B7-H3 (CD276), B7-H4 (VTCN1), HVEM (TNFRSF14 or CD107), KIR, A2aR, MHC class I, MHC class II, GAL9, adenosine, and TGF beta. It will be understood that the term inhibitory molecule may refer to the gene (and its associated regulatory elements) encoding an inhibitory molecule protein when it is used in connection with a target sequence or gRNA molecule. In some embodiments, gene editing systems, e.g., CRISPR systems, comprising one or more gRNA molecules comprising a targeting domain to a sequence of an inhibitory molecule are used in conjunction with the other features disclosed herein (e.g., a CRISPR system to a TET2 intron).

The terms "allogeneic T cell target" and "allogeneic T-cell target" are used interchangeably herein, and refer to a protein that mediates or contributes to a host versus graft response, mediates or contributes to a graft versus host response, or is a target for an immunosuppressant; and the gene encoding said molecule and its associated regulatory elements, e.g., promoters. It will be understood that the term allogeneic T cell target may refer to the gene (and its associated regulatory elements) encoding an allogeneic T cell target protein when it is used in connection with a target sequence or gRNA molecule. Without being bound by theory, inhibition or elimination of one or more allogeneic T cell targets, e.g., by use of gene editing systems, e.g., CRISPR systems, to such targets, may improve the efficacy, survival, function and/or viability of, e.g., an allogeneic cell, e.g., an allogeneic T cell, for example, by reducing or eliminating undesirable immunogenicity (such as a host versus graft response or a graft versus host response). An allogeneic T cell target may also refer to a functional fragment, splice variant, or domain of a specified target.

In some embodiments, immunogenicity refers to the initiation of a humoral or cell-mediated immune response. In certain embodiments, undesirable immunogenicity may result from graft versus host disease (GvHD) or graft versus host response, e.g., following an allogeneic transplant, in which the donor/grafted cells or tissues attack the donee/host cells or tissues as foreign. In other embodiments, undesirable immunogenicity may result from host versus graft disease (HvGD), e.g., following an allogeneic transplant, in which the donee/host cells or tissues attack the donor/grafted cells or tissues as foreign.

In a non-limiting example, the protein that mediates or contributes to a graft versus host response or host versus graft response is one or more components of the T cell receptor. In an embodiment, the component of the T cell receptor is the T cell receptor alpha, for example the constant domain of the TCR alpha. In an embodiment, the component of the T cell receptor is the T cell receptor beta chain, for example the constant domain 1 or constant domain 2 of the TCR beta. In an embodiment, the component of the T cell receptor is the T cell receptor delta chain. In an embodiment, the component of the T cell receptor is the T cell receptor epsilon chain. In an embodiment, the component of the T cell receptor is the T cell receptor zeta chain. In an embodiment, the component of the T cell receptor is the T cell receptor gamma chain. Thus, in embodiments where the protein encoded by the allogeneic T cell target is a component of the TCR, the gene encoding the allogeneic T cell target may be, for example, TRAC, TRBC1, TRBC2, CD3D, CD3E, CD3G or CD247, and combinations thereof.

In a non-limiting example, the protein that mediates or contributes to a graft versus host response or host versus graft response is an HLA protein or B2M. Examples of HLA proteins include HLA-A, HLA-B and HLA-C. Thus, in embodiments where the allogeneic T cell target protein is a HLA or B2M protein, the gene encoding the allogeneic T cell target may be, for example, HLA-A, HLA-B, HLA-C or B2M, and combinations thereof. In other embodiments, the allogeneic T cell target protein is NLRC5, and the gene encoding the allogeneic T cell target may be, for example, NLRC5.

In some embodiments, the protein that mediates or contributes to a graft versus host response or a host versus graft response is selected from: HLA-DM, HLA-DO, HLA-DR, HLA-DQ, HLA-DP, CIITA, RFXANK, RFXAP, RFX1, RFX5, NF-YA, NF-YB, NF-YC, X2BP, OCAB, HLA-A, HLA-B, HLA-C, B2M, NLRC5, TRAC, TRBC1, TRBC2, CD247, CD3, CD3D, CD3E, CD3G, DCK, CD52, FKBP1A, and NR3C1. In a non-limiting example, the protein that mediates or contributes to a graft versus host response or host versus graft response is a major histocompatibility complex class II (MHC II) molecule (e.g., HLA-Dx (where x refers to a letter of a MHC II protein, e.g., HLA-DM, HLA-DO, HLA-DR, HLA-DQ and/or HLA-DP)), or a regulatory factor for expression of a MHC II, and combinations thereof. A non-limiting example is CIITA (also referred to herein as C2TA). Thus, in embodiments where the allogeneic T cell target protein is a CIITA, the gene encoding the allogeneic T cell target may be, for example, CIITA. In another non-limiting example, the protein that mediates or contributes to a graft versus host response or host versus graft response is RFXANK. In another non-limiting example, the protein that mediates or contributes to a graft versus host response or host versus graft response is RFXAP. In another non-limiting example, the protein that mediates or contributes to a graft versus host response or host versus graft response is RFX5. In another non-limiting example, the protein that mediates or contributes to a graft versus host response or host versus graft response is RFX1.

In some embodiments, gene editing systems, e.g., CRISPR systems, comprising one or more gRNA molecules comprising a targeting domain to a sequence of an allogenic T cell target are used alone or in conjunction with the other features disclosed herein (e.g., a CRISPR system to a TET2 intron). In embodiments, CRISPR systems targeting TRAC, B2M and/or CIITA are used in conjunction with the other features disclosed herein (e.g., a CRISPR system to a TET2 intron).

The term "target for an immunosuppressant" as used herein refers to a molecular target, for example a receptor or other protein, for an immunosuppressant agent (the terms, "immunosuppressant" and "immunosuppressive" are used interchangeably herein in connection with an agent, or target for an agent). An immunosuppressant agent is an agent that suppresses immune function by one or more mechanisms of action. In other words, an immunosuppressive agent is a role played by a compound which is exhibited by a capability to diminish the extent and/or voracity of an immune response. One example of a type of activity exhibited by an immunosuppressant agent is eliminating T-cells, for example, activated T-cells. Another example of a type of activity exhibited by an immunosuppressant agent is reducing the activity or activation level of T-cells.

As a non-limiting example, an immunosuppressive agent can be a calcineurin inhibitor, a target of rapamycin, an interleukin-2 a-chain blocker, an inhibitor of inosine monophosphate dehydrogenase, an inhibitor of dihydrofolic acid reductase, a corticosteroid, cyclosporine, or an immunosuppressive antimetabolite. Classical cytotoxic immunosuppressants act by inhibiting DNA synthesis. Others may act through activation of T-cells or by inhibiting the activation of helper cells. As non-limiting examples, targets for immunosuppressive agent can be a receptor for an immunosuppressive agent such as: deoxycytidine kinase, CD52, glucocorticoid receptor (GR), a FKBP family gene member, e.g., FKBP12, and a cyclophilin family gene member. In an embodiment, the target for an immunosuppressant is deoxycytidine kinase (DCK), and the immunosuppressant is a nucleoside analog-based drug such as cytarabine (cytosine arabinoside) or gemcitabine. In an embodiment, the target for an immunosuppressant is GR, and the immunosuppressant is a corticosteroid such as dexamethasone. In an embodiment, the target for an immunosuppressant is CD52, and the immunosuppressant is an anti-CD52 antibody or antigen-binding fragment thereof such as alemtuzumab (CAMPATH®). In an embodiment, the target for an immunosuppressant is FKBP12, and the immunosuppressant is FK506 (or analog or FKBP12-binding fragment thereof), cyclosporine, rapamycin or rapalog, or mTor inhibitor such as RAD001. Thus, in embodiments where the allogeneic T cell target is a target for an immunosuppressant protein, the gene encoding the allogeneic T cell target may be, for example, NR3C1, FKBP1A, CD52, or DCK, and combinations thereof. In some embodiments, gene editing systems, e.g., CRISPR systems, comprising one or more gRNA molecules comprising a targeting domain to a sequence of allogenic T cell target are used in conjunction with the other features disclosed herein (e.g., a CRISPR system to a TET2 intron). In embodiments, CRISPR systems targeting TRAC and FKBP1A are used in conjunction with the other features disclosed herein (e.g., a CRISPR system to a TET2 intron).

"Tet" as the term is used herein, refers to the family of genes, and the proteins encoded by said genes, of the ten-eleven translocation methlcytosine dioxygenase family. Tet includes, for example, Tet1, Tet2 and Tet3.

"Tet2" as the term is used herein, refers to gene, tet methylcytosine dioxygenase 2, and the protein encoded by said gene, the tet2 methylcytosine dioxygenase, which catalyzes the conversion of methylcytosine to 5-hydroxymethylcytosine. It is sometimes also referred to as "KIAA1546," "FLJ20032" and "tet oncogene family member 2." The encoded protein is involved in myelopoiesis, and defects in this gene have been associated with several myeloproliferative disorders. In the human genome, TET2 is located on chromosome 4q24. The Tet2 gene includes both the introns and exons of the associated gene. Currently six TET2 isoforms have been described and their Genebank numbers are: NM_001127208.2; XM_005263082.1; XM_006714242.2; NM_017628.4; XM_011532044.1; and XM_011532043.1.

An example of the protein sequence of human Tet2 is provided as UniProt accession number Q6N021:

[SEQ ID NO: 950]

```
          10         20         30         40
  MEQDRTNHVE GNRLSPFLIP SPPICQTEPL ATKLQNGSPL
          50         60         70         80
  PERAHPEVNG DTKWHSFKSY YGIPCMKGSQ NSRVSPDFTQ
          90        100        110        120
  ESRGYSKCLQ NGGIKRTVSE PSLSGLLQIK KLKQDQKANG
         130        140        150        160
  ERRNFGVSQE RNPGESSQPN VSDLSDKKES VSSVAQENAV
         170        180        190        200
  KDFTSFSTHN CSGPENPELQ ILNEQEGKSA NYHDKNIVLL
         210        220        230        240
  KNKAVLMPNG ATVSASSVEH THGELLEKTL SQYYPDCVSI
         250        260        270        280
  AVQKTTSHIN AINSQATNEL SCEITHPSHT SGQINSAQTS
         290        300        310        320
  NSELPPKPAA VVSEACDADD ADNASKLAAM LNTCSFQKPE
         330        340        350        360
  QLQQQKSVFE ICPSPAENNI QGTTKLASGE EFCSGSSSNL
         370        380        390        400
  QAPGGSSERY LKQNEMNGAY FKQSSVFTKD SFSATTTPPP
         410        420        430        440
  PSQLLLSPPP PLPQVPQLPS EGKSTLNGGV LEEHHHYPNQ
         450        460        470        480
  SNTTLLREVK IEGKPEAPPS QSPNPSTHVC SPSPMLSERP
         490        500        510        520
  QNNCVNRNDI QTAGTMTVPL CSEKTRPMSE HLKHNPPIFG
         530        540        550        560
  SSGELQDNCQ QLMRNKEQEI LKGRDKEQTR DLVPPTQHYL
         570        580        590        600
  KPGWIELKAP RFHQAESHLK RNEASLPSIL QYQPNLSNQM
         610        620        630        640
  TSKQYTGNSN MPGGLPRQAY TQKTTQLEHK SQMYQVEMNQ
         650        660        670        680
  GQSQGTVDQH LQFQKPSHQV HFSKTDHLPK AHVQSLCGTR
         690        700        710        720
  FHFQQRADSQ TEKLMSPVLK QHLNQQASET EPFSNSHLLQ
         730        740        750        760
  HKPHKQAAQT QPSQSSHLPQ NQQQQQKLQI KNKEEILQTF
         770        780        790        800
  PHPQSNNDQQ REGSFFGQTK VEECFHGENQ YSKSSEFETH
         810        820        830        840
  NVQMGLEEVQ NINRRNSPYS QTMKSSACKI QVSCSNNTHL
         850        860        870        880
  VSENKEQTTH PELFAGNKTQ NLHHMQYFPN NVIPKQDLLH
         890        900        910        920
  RCFQEQEQKS QQASVLQGYK NRNQDMSGQQ AAQLAQQRYL
         930        940        950        960
  IHNHANVFPV PDQGGSHTQT PPQKDTQKHA ALRWHLLQKQ
         970        980        990       1000
  EQQQTQQPQT ESCHSQMHRP IKVEPGCKPH ACMHTAPPEN
        1010       1020       1030       1040
  KTWKKVTKQE NPPASCDNVQ QKSIIETMEQ HLKQFHAKSL
        1050       1060       1070       1080
  FDHKALTLKS QKQVKVEMSG PVTVLTRQTT AAELDSHTPA
        1090       1100       1110       1120
  LEQQTTSSEK TPTKRTAASV LNNFIESPSK LLDTPIKNLL
        1130       1140       1150       1160
  DTPVKTQYDF PSCRCVEQII EKDEGPFYTH LGAGPNVAAI
        1170       1180       1190       1200
  REIMEERFGQ KGKAIRIERV IYTGKEGKSS QGCPIAKWVV
        1210       1220       1230       1240
  RRSSSEEKLL CLVRERAGHT CEAAVIVILI LVWEGIPLSL
        1250       1260       1270       1280
  ADKLYSELTE TLRKYGTLTN RRCALNEERT CACQGLDPET
        1290       1300       1310       1320
  CGASFSFGCS WSMYYNGCKF ARSKIPRKFK LLGDDPKEEE
        1330       1340       1350       1360
  KLESHLQNLS TLMAPTYKKL APDAYNNQIE YEHRAPECRL
        1370       1380       1390       1400
  GLKEGRPFSG VTACLDFCAH AHRDLHNMQN GSTLVCTLTR
        1410       1420       1430       1440
  EDNREFGGKP EDEQLHVLPL YKVSDVDEFG SVEAQEEKKR
        1450       1460       1470       1480
  SGAIQVLSSF RRKVRMLAEP VKTCRQRKLE AKKAAAEKLS
        1490       1500       1510       1520
  SLENSSNKNE KEKSAPSRTK QTENASQAKQ LAELLRLSGP
        1530       1540       1550       1560
  VMQQSQQPQP LQKQPPQPQQ QQRPQQQQPH HPQTESVNSY
        1570       1580       1590       1600
  SASGSTNPYM RRPNPVSPYP NSSHTSDIYG STSPMNFYST
        1610       1620       1630       1640
  SSQAAGSYLN SSNPMNPYPG LLNQNTQYPS YQCNGNLSVD
        1650       1660       1670       1680
  NCSPYLGSYS PQSQPMDLYR YPSQDPLSKL SLPPIHTLYQ
        1690       1700       1710       1720
  PRFGNSQSFT SKYLGYGNQN MQGDGFSSCT IRPNVHHVGK
        1730       1740       1750       1760
  LPPYPTHEMD GHFMGATSRL PPNLSNPNMD YKNGEHHSPS
        1770       1780       1790       1800
  HIIHNYSAAP GMFNSSLHAL HLQNKENDML SHTANGLSKM
        1810       1820       1830       1840
  LPALNHDRTA CVQGGLHKLS DANGQEKQPL ALVQGVASGA
        1850       1860       1870       1880
  EDNDEVWSDS EQSFLDPDIG GVAVAPTHGS ILIECAKREL
        1890       1900       1910       1920
  HATTPLKNPN RNHPTRISLV FYQHKSMNEP KHGLALWEAK
```

```
              1930       1940       1950       1960
       MAEKAREKEE ECEKYGPDYV PQKSHGKKVK REPAEPHETS 1970       1980       1990       2000
       EPTYLRFIKS LAERTMSVTT DSTVTTSPYA FTRVTGPYNR

2002
       YI
```

The tet2 gene is located on chromosome 4, location GRCh38.p2 (GCF_000001405.28) (NC_000004.12 (105145875 to 105279803); Gene ID 54790.

Examples of nucleic acid sequences encoding Tet2 are provided below. There are 6 identified isoforms of human Tet2 have been identified. The mRNA sequences are provided below (In embodiments, in each sequence, T may be replaced with U). In embodiments, Tet2 includes the proteins encoded by each of the sequences below:

| Name | NCBI Reference Sequence | Sequence |
|---|---|---|
| *Homo sapiens* tet methylcytosine dioxygenase 2 (TET2), transcript variant 1, mRNA [SEQ ID NO: 951] | NM_001127208.2 | GGCAGTGGCAGCGGCGAGAGCTTGGGCGGCCGCCGCCG CCTCCTCGCGAGCGCCGCGCGCCCGGGTCCCG CTCGCATGCAAGTCACGTCCGCCCCCTCGGCGCGGCCGC CCCGAGACGCCGGCCCCGCTGAGTGATGAGA ACAGACGTCAAACTGCCTTATGAATATTGATGCGGAGGC TAGGCTGCTTTCGTAGAGAAGCAGAAGGAAG CAAGATGGCTGCCCTTTAGGATTTGTTAGAAAGGAGACC CGACTGCAACTGCTGGATTGCTGCAAGGCTG AGGGACGAGAACGAGGCTGGCAAACATTCAGCAGCACA CCCTCTCAAGATTGTTTACTTGCCTTTGCTCC TGTTGAGTTACAACGCTTGGAAGCAGGAGATGGGCTCAG CAGCAGCCAATAGGACATGATCCAGGAAGAG CAGTAAGGGACTGAGCTGCTGAATTCAACTAGAGGGCA GCCTTGTGGATGGCCCCGAAGCAAGCCTGATG GAACAGGATAGAACCAACCATGTTGAGGGCAACAGACT AAGTCCATTCCTGATACCATCACCTCCCATTT GCCAGACAGAACCTCTGGCTACAAAGCTCCAGAATGGA AGCCCACTGCCTGAGAGAGCTCATCCAGAAGT AAATGGAGACACCAAGTGGCACTCTTTCAAAAGTTATTA TGGAATACCCTGTATGAAGGGAAGCCAGAAT AGTCGTGTGAGTCCTGACTTTACACAAGAAAGTAGAGGG TATTCCAAGTGTTTGCAAAATGGAGGAATAA AACGCACAGTTAGTGAACCTTCTCTCTCTGGGCTCCTTCA GATCAAGAAATTGAAACAAGACCAAAAGGC TAATGGAGAAAGACGTAACTTCGGGGTAAGCCAAGAAA GAAATCCAGGTGAAAGCAGTCAACCAAATGTC TCCGATTTGAGTGATAAGAAAGAATCTGTGAGTTCTGTA GCCCAAGAAAATGCAGTTAAAGATTTCACCA GTTTTTCAACACATAACTGCAGTGGGCCTGAAAATCCAG AGCTTCAGATTCTGAATGAGCAGGAGGGGAA AAGTGCTAATTACCATGACAAGAACATTGTATTACTTAA AAACAAGGCAGTGCTAATGCCTAATGGTGCT ACAGTTTCTGCCTCTTCCGTGGAACACACACATGGTGAA CTCCTGGAAAAAACACTGTCTCAATATTATC CAGATTGTGTTTCCATTGCGGTGCAGAAAACCACATCTC ACATAAATGCCATTAACAGTCAGGCTACTAA TGAGTTGTCCTGTGAGATCACTCACCCATCGCATACCTCA GGGCAGATCAATTCCGCACAGACCTCTAAC TCTGAGCTGCCTCCAAAGCCAGCTGCAGTGGTGAGTGAG GCCTGTGATGCTGATGATGCTGATAATGCCA GTAAACTAGCTGCAATGCTAAATACCTGTTCCTTTCAGA AACCAGAACAACTACAACAACAAAATCAGT TTTTGAGATATGCCCATCTCCTGCAGAAAATAACATCCA GGGAACCACAAAGCTAGCGTCTGGTGAAGAA TTCTGTTCAGGTTCCAGCAGCAATTTGCAAGCTCCTGGTG GCAGCTCTGAACGGTATTTAAAACAAAATG AAATGAATGGTGCTTACTTCAAGCAAAGCTCAGTGTTCA CTAAGGATTCCTTTTCTGCCACTACCACACC ACCACCACCATCACAATTGCTTCTTTCTCCCCCTCCTCCT CTTCCACAGGTTCCTCAGCTTCCTTCAGAA GGAAAAAGCACTCTGAATGGTGGAGTTTTAGAAGAACA CCACCACTACCCCAACCAAAGTAACACAACAC TTTTAAGGGAAGTGAAAATAGAGGGTAAACCTGAGGCA CCACCTTCCCAGAGTCCTAATCCATCTACACA TGTATGCAGCCCTTCTCCGATGCTTTCTGAAAGGCCTCAG AATAATTGTGTGAACAGGAATGACATACAG ACTGCAGGGACAATGACTGTTCCATTGTGTTCTGAGAAA ACAAGACCAATGTCAGAACACCTCAAGCATA ACCCACCAATTTTTGGTAGCAGTGGAGAGCTACAGGACA ACTGCCAGCAGTTGATGAGAAACAAAGAGCA AGAGATTCTGAAGGGTCGAGACAAGGAGCAAACACGAG ATCTTGTGCCCCAACACAGCACTATCTGAAA CCAGGATGGATTGAATTGAAGGCCCCTCGTTTTCACCAA GCGGAATCCCATCTAAAACGTAATGAGGCAT |

-continued

| Name | NCBI Reference Sequence | Sequence |
|---|---|---|
| | | CACTGCCATCAATTCTTCAGTATCAACCCAATCTCTCCAA TCAAATGACCTCCAAACAATACACTGGAAA TTCCAACATGCCTGGGGGGCTCCCAAGGCAAGCTTACAC CCAGAAAACAACACAGCTGGAGCACAAGTCA CAAATGTACCAAGTTGAAATGAATCAAGGGCAGTCCCAA GGTACAGTGGACCAACATCTCCAGTTCCAAA AACCCTCACACCAGGTGCACTTCTCCAAAACAGACCATT TACCAAAAGCTCATGTGCAGTCACTGTGTGG CACTAGATTTCATTTTCAACAAAGAGCAGATTCCCAAAC TGAAAAACTTATGTCCCCAGTGTTGAAACAG CACTTGAATCAACAGGCTTCAGAGACTGAGCCATTTTCA AACTCACACCTTTTGCAACATAAGCCTCATA AACAGGCAGCACAAACACAACCATCCCAGAGTTCACATC TCCCTCAAAACCAGCAACAGCAGCAAAAATT ACAAATAAAGAATAAAGAGGAAATACTCCAGACTTTTCC TCACCCCCAAAGCAACAATGATCAGCAAAGA GAAGGATCATTCTTTGGCCAGACTAAAGTGGAAGAATGT TTTCATGGTGAAAATCAGTATTCAAAATCAA GCGAGTTCGAGACTCATAATGTCCAAATGGGACTGGAGG AAGTACAGAATATAAATCGTAGAAATTCCCC TTATAGTCAGACCATGAAATCAAGTGCATGCAAAATACA GGTTTCTTGTTCAAACAATACACACCTAGTT TCAGAGAATAAAGAACAGACTACACATCCTGAACTTTTT GCAGGAAACAAGACCCAAAACTTGCATCACA TGCAATATTTTCCAAATAATGTGATCCCAAAGCAAGATC TTCTTCACAGGTGCTTTCAAGAACAGGAGCA GAAGTCACAACAAGCTTCAGTTCTACAGGGATATAAAAA TAGAAACCAAGATATGTCTGGTCAACAAGCT GCGCAACTTGCTCAGCAAAGGTACTTGATACATAACCAT GCAAATGTTTTTCCTGTGCCTGACCAGGGAG GAAGTCACACTCAGACCCCTCCCCAGAAGGACACTCAAA AGCATGCTGCTCTAAGGTGGCATCTCTTACA GAAGCAAGAACAGCAGCAAACACAGCAACCCCAAACTG AGTCTTGCCATAGTCAGATGCACAGGCCAATT AAGGTGGAACCTGGATGCAAGCCACATGCCTGTATGCAC ACAGCACCACCAGAAAACAAAACATGGAAAA AGGTAACTAAGCAAGAGAATCCACCTGCAAGCTGTGATA ATGTGCAGCAAAAGAGCATCATTGAGACCAT GGAGCAGCATCTGAAGCAGTTTCACGCCAAGTCGTTATT TGACCATAAGGCTCTTACTCTCAAATCACAG AAGCAAGTAAAAGTTGAAATGTCAGGGCCAGTCACAGTT TTGACTAGACAAACCACTGCTGCAGAACTTG ATAGCCACACCCCAGCTTTAGAGCAGCAAACAACTTCTT CAGAAAAGACACCAACCAAAAGAACAGCTGC TTCTGTTCTCAATAATTTTATAGAGTCACCTTCCAAATTA CTAGATACTCCTATAAAAAATTTATTGGAT ACACCTGTCAAGACTCAATATGATTTCCCATCTTGCAGAT GTGTAGAGCAAATTATTGAAAAAGATGAAG GTCCTTTTTATACCCATCTAGGAGCAGGTCCTAATGTGGC AGCTATTAGAGAAATCATGGAAGAAAGGTT TGGACAGAAGGGTAAAGCTATTAGGATTGAAAGAGTCA TCTATACTGGTAAAGAAGGCAAAAGTTCTCAG GGATGTCCTATTGCTAAGTGGGTGGTTCGCAGAAGCAGC AGTGAAGAGAAGCTACTGTGTTTGGTGCGGG AGCGAGCTGGCCACACCTGTGAGGCTGCAGTGATTGTGA TTCTCATCCTGGTGTGGGAAGGAATCCCGCT GTCTCTGGCTGACAAACTCTACTCGGAGCTTACCGAGAC GCTGAGGAAATACGGCACGCTCACCAATCGC CGGTGTGCCTTGAATGAAGAGAACTTGCGCCTGTCAG GGGCTGGATCCAGAAACCTGTGGTGCCTCCT TCTCTTTTGGTTGTTCATGGAGCATGTACTACAATGGATG TAAGTTTGCCAGAAGCAAGATCCCAAGGAA GTTTAAGCTGCTTGGGGATGACCCAAAAGAGGAAGAGA AACTGGAGTCTCATTTGCAAAACCTGTCCACT CTTATGGCACCAACATATAAGAAACTTGCACCTGATGCA TATAATAATCAGATTGAATATGAACACAGAG CACCAGAGTGCCGTCTGGGTCTGAAGGAAGGCCGTCCAT TCTCAGGGGTCACTGCATGTTTGGACTTCTG TGCTCATGCCCACAGAGACTTGCACAACATGCAGAATGG CAGCACATTGGTATGCACTCTCACTAGAGAA GACAATCGAGAATTTGGAGGAAAACCTGAGGATGAGCA GCTTCACGTTCTGCCTTTATACAAAGTCTCTG ACGTGGATGAGTTTGGGAGTGTGGAAGCTCAGGAGGAG AAAAAACGGAGTGGTGCCATTCAGGTACTGAG TTCTTTTCGGCGAAAAGTCAGGATGTTAGCAGAGCCAGT |

-continued

| Name | NCBI Reference Sequence | Sequence |
|---|---|---|
| | | CAAGACTTGCCGACAAAGGAAACTAGAAGCC
AAGAAAGCTGCAGCTGAAAAGCTTTCCTCCCTGGAGAAC
AGCTCAAATAAAAATGAAAAGGAAAAGTCAG
CCCCATCACGTACAAAACAAACTGAAAACGCAAGCCAG
GCTAAACAGTTGGCAGAACTTTTGCGACTTTC
AGGACCAGTCATGCAGCAGTCCCAGCAGCCCCAGCCTCT
ACAGAAGCAGCCACCACAGCCCCAGCAGCAG
CAGAGACCCCAGCAGCAGCAGCCACATCACCCTCAGAC
AGAGTCTGTCAACTCTTATTCTGCTTCTGGAT
CCACCAATCCATACATGAGACGGCCCAATCCAGTTAGTC
CTTATCCAAACTCTTCACACACTTCAGATAT
CTATGGAAGCACCAGCCCTATGAACTTCTATTCCACCTC
ATCTCAAGCTGCAGGTTCATATTTGAATTCT
TCTAATCCCATGAACCCTTACCCTGGGCTTTTGAATCAGA
ATACCCAATATCCATCATATCAATGCAATG
GAAACCTATCAGTGGACAACTGCTCCCCATATCTGGGTT
CCTATTCTCCCCAGTCTCAGCCGATGGATCT
GTATAGGTATCCAAGCCAAGACCCTCTGTCTAAGCTCAG
TCTACCACCCATCCATACACTTTACCAGCCA
AGGTTTGGAAATAGCCAGAGTTTTACATCTAAATACTTA
GGTTATGGAAACCAAAATATGCAGGGAGATG
GTTTCAGCAGTTGTACCATTAGACCAAATGTACATCATG
TAGGGAAATTGCCTCCTTATCCCACTCATGA
GATGGATGGCCACTTCATGGGAGCCACCTCTAGATTACC
ACCCAATCTGAGCAATCCAAACATGGACTAT
AAAAATGGTGAACATCATTCACCTTCTCACATAATCCAT
AACTACAGTGCAGCTCCGGGCATGTTCAACA
GCTCTCTTCATGCCCTGCATCTCCAAAACAAGGAGAATG
ACATGCTTTCCCACACAGCTAATGGGTTATC
AAAGATGCTTCCAGCTCTTAACCATGATAGAACTGCTTG
TGTCCAAGGAGGCTTACACAAATTAAGTGAT
GCTAATGGTCAGGAAAAGCAGCCATTGGCACTAGTCCAG
GGTGTGGCTTCTGGTGCAGAGGACAACGATG
AGGTCTGGTCAGACAGCGAGCAGAGCTTTCTGGATCCTG
ACATTGGGGAGTGGCCGTGGCTCCAACTCA
TGGGTCAATTCTCATTGAGTGTGCAAAGCGTGAGCTGCA
TGCCACAACCCCTTTAAAGAATCCCAATAGG
AATCACCCCACCAGGATCTCCCTCGTCTTTTACCAGCATA
AGAGCATGAATGAGCCAAAACATGGCTTGG
CTCTTTGGGAAGCCAAAATGGCTGAAAAAGCCCGTGAGA
AAGAGGAAGAGTGTGAAAAGTATGGCCCAGA
CTATGTGCCTCAGAAATCCCATGGCAAAAAAGTGAAACG
GGAGCCTGCTGAGCCACATGAAACTTCAGAG
CCCACTTACCTGCGTTTCATCAAGTCTCTTGCCGAAAGGA
CCATGTCCGTGACCACAGACTCCACAGTAA
CTACATCTCCATATGCCTTCACTCGGGTCACAGGGCCTTA
CAACAGATATATATGATATCACCCCCTTTT
GTTGGTTACCTCACTTGAAAAGACCACAACCAACCTGTC
AGTAGTATAGTTCTCATGACGTGGGCAGTGG
GGAAAGGTCACAGTATTCATGACAAATGTGGTGGGAAA
AACCTCAGCTCACCAGCAACAAAAGAGGTTAT
CTTACCATAGCACTTAATTTTCACTGGCTCCCAAGTGGTC
ACAGATGGCATCTAGGAAAAGACCAAAGCA
TTCTATGCAAAAAGAAGGTGGGGAAGAAAGTGTTCCGC
AATTTACATTTTTAAACACTGGTTCTATTATT
GGACGAGATGATATGTAAATGTGATCCCCCCCCCCCCGCT
TACAACTCTACACATCTGTGACCACTTTTAA
TAATATCAAGTTTGCATAGTCATGGAACACAAATCAAAC
AAGTACTGTAGTATTACAGTGACAGGAATCT
TAAAATACCATCTGGTGCTGAATATATGATGTACTGAAA
TACTGGAATTATGGCTTTTTGAAATGCAGTT
TTTACTGTAATCTTAACTTTTATTTATCAAAATAGCTACA
GGAAACATGAATAGCAGGAAAACACTGAAT
TTGTTTGGATGTTCTAAGAAATGGTGCTAAGAAAATGGT
GTCTTTAATAGCTAAAAATTTAATGCCTTTA
TATCATCAAGATGCTATCAGTGTACTCCAGTGCCCTTGA
ATAATAGGGGTACCTTTTCATTCAAGTTTTT
ATCATAATTACCTATTCTTACACAAGCTTAGTTTTTAAAA
TGTGGACATTTTAAAGGCCTCTGGATTTTG
CTCATCCAGTGAAGTCCTTGTAGGACAATAAACGTATAT
ATGTACATATATACACAAACATGTATATGTG
CACACACATGTATATGTATAAATATTTTAAATGGTGTTTT
AGAAGCACTTTGTCTACCTAAGCTTTGACA
ACTTGAACAATGCTAAGGTACTGAGATGTTTAAAAAACA
AGTTTACTTTCATTTTAGAATGCAAAGTTGA |

| Name | NCBI Reference Sequence | Sequence |
|---|---|---|
| | | TTTTTTTAAGGAAACAAAGAAAGCTTTTAAAATATTTTTG<br>CTTTTAGCCATGCATCTGCTGATGAGCAAT<br>TGTGTCCATTTTTAACACAGCCAGTTAAATCCACCATGG<br>GGCTTACTGGATTCAAGGGAATACGTTAGTC<br>CACAAAACATGTTTTCTGGTGCTCATCTCACATGCTATAC<br>TGTAAAACAGTTTTATACAAAATTGTATGA<br>CAAGTTCATTGCTCAAAAATGTACAGTTTTAAGAATTTTC<br>TATTAACTGCAGGTAATAATTAGCTGCATG<br>CTGCAGACTCAACAAAGCTAGTTCACTGAAGCCTATGCT<br>ATTTTATGGATCATAGGCTCTTCAGAGAACT<br>GAATGGCAGTCTGCCTTTGTGTTGATAATTATGTACATTG<br>TGACGTTGTCATTTCTTAGCTTAAGTGTCC<br>TCTTTAACAAGAGGATTGAGCAGACTGATGCCTGCATAA<br>GATGAATAAACAGGGTTAGTTCCATGTGAAT<br>CTGTCAGTTAAAAAGAAACAAAAACAGGCAGCTGGTTTG<br>CTGTGGTGGTTTTAAATCATTAATTTGTATA<br>AAGAAGTGAAAGAGTTGTATAGTAAATTAAATTGTAAAC<br>AAAACTTTTTAATGCAATGCTTTAGTATTT<br>TAGTACTGTAAAAAAATTAAATATATACATATATATATA<br>TATATATATATATATATATGAGTTTGAAG<br>CAGAATTCACATCATGATGGTGCTACTCAGCCTGCTACA<br>AATATATCATAATGTGAGCTAAGAATTCATT<br>AAATGTTTGAGTGATGTTCCTACTTGTCATATACCTCAAC<br>ACTAGTTTGGCAATAGGATATTGAACTGAG<br>AGTGAAAGCATTGTGTACCATCATTTTTTTCCAAGTCCTT<br>TTTTTTATTGTTAAAAAAAAAAGCATACCT<br>TTTTTCAATACTTGATTTCTTAGCAAGTATAACTTGAACT<br>TCAACCTTTTTGTTCTAAAAATTCAGGGAT<br>ATTTCAGCTCATGCTCTCCCTATGCCAACATGTCACCTGT<br>GTTTATGTAAAATTGTTGTAGGTTAATAAA<br>TATATTCTTTGTCAGGGATTTAACCCTTTTATTTTGAATC<br>CCTTCTATTTTACTTGTACATGTGCTGATG<br>TAACTAAAACTAATTTTGTAAATCTGTTGGCTCTTTTTAT<br>TGTAAAGAAAAGCATTTTAAAAGTTTGAGG<br>AATCTTTTGACTGTTTCAAGCAGGAAAAAAAAATTACAT<br>GAAAATAGAATGCACTGAGTTGATAAAGGGA<br>AAAATTGTAAGGCAGGAGTTTGGCAAGTGGCTGTTGGCC<br>AGAGACTTACTTGTAACTCTCTAAATGAAGT<br>TTTTTTGATCCTGTAATCACTGAAGGTACATACTCCATGT<br>GGACTTCCCTTAAACAGGCAAACACCTACA<br>GGTATGGTGTGCAACAGATTGTACAATTACATTTTGGCC<br>TAAATACATTTTTGCTTACTAGTATTTAAAA<br>TAAATTCTTAATCAGAGGAGGCCTTTGGGTTTTATTGGTC<br>AAATCTTTGTAAGCTGGCTTTTGTCTTTTT<br>AAAAAATTTCTTGAATTTGTGGTTGTGTCCAATTTGCAAA<br>CATTTCCAAAAATGTTTGCTTTGCTTACAA<br>ACCACATGATTTTAATGTTTTTTGTATACCATAATATCTA<br>GCCCCAAACATTTGATTACTACATGTGCAT<br>TGGTGATTTTGATCATCCATTCTTAATATTTGATTTCTGT<br>GTCACCTACTGTCATTTGTTAAACTGCTGG<br>CCAACAAGAACAGGAAGTATAGTTTGGGGGGTTGGGGA<br>GAGTTTACATAAGGAAGAGAAGAAATTGAGTG<br>GCATATTGTAAATATCAGATCTATAATTGTAAATATAAA<br>ACCTGCCTCAGTTAGAATGAATGGAAAGCAG<br>ATCTACAATTTGCTAATATAGGAATATCAGGTTGACTAT<br>ATAGCCATACTTGAAAATGCTTCTGAGTGGT<br>GTCAACTTTACTTGAATGAATTTTTCATCTTGATTGACGC<br>ACAGTGATGTACAGTTCACTTCTGAAGCTA<br>GTGGTTAACTTGTGTAGGAAACTTTTGCAGTTTGACACTA<br>AGATAACTTCTGTGTGCATTTTTCTATGCT<br>TTTTTAAAAACTAGTTTCATTTCATTTTCATGAGATGTTT<br>GGTTTATAAGATCTGAGGATGGTTATAAAT<br>ACTGTAAGTATTGTAATGTTATGAATGCAGGTTATTTGA<br>AAGCTGTTTATTATTATATCATTCCTGATAA<br>TGCTATGTGAGTGTTTTAATAAAATTTATATTTATTTAA<br>TGCACTCTAAAAAAAAAAAAAAAAAA |

| Name | NCBI Reference Sequence | Sequence |
|---|---|---|
| PREDICTED: *Homo sapiens* tet methylcytosine dioxygenase 2 (TET2), transcript variant X1, mRNA [SEQ ID NO: 952] | XM_005263082.1 | AAGCAGAAGGAAGCAAGATGGCTGCCCTTTAGGATTTGT TAGAAAGGAGACCCGACTGCAACTGCTGGAT TGCTGCAAGGCTGAGGGACGAGAACGAGAATTCAACTA GAGGGCAGCCTTGTGATGGCCCCGAAGCAAG CCTGATGGAACAGGATAGAACCAACCATGTTGAGGGCA ACAGACTAAGTCCATTCCTGATACCATCACCT CCCATTTGCCAGACAGAACCTCTGGCTACAAAGCTCCAG AATGGAAGCCCACTGCCTGAGAGAGCTCATC CAGAAGTAAATGGAGACACCAAGTGGCACTCTTTCAAAA GTTATTATGGAATACCCTGTATGAAGGGAAG CCAGAATAGTCGTGTGAGTCCTGACTTTACACAAGAAAG TAGAGGGTATTCCAAGTGTTTGCAAAATGGA GGAATAAAACGCACAGTTAGTGAACCTTCTCTCTCTGGG CTCCTTCAGATCAAGAAATTGAAACAAGACC AAAAGGCTAATGGAGAAAGACGTAACTTCGGGGTAAGC CAAGAAAGAAATCCAGGTGAAAGCAGTCAACC AAATGTCTCCGATTTGAGTGATAAGAAAGAATCTGTGAG TTCTGTAGCCCAAGAAAATGCAGTTAAAGAT TTCACCAGTTTTTCAACACATAACTGCAGTGGGCCTGAA AATCCAGAGCTTCAGATTCTGAATGAGCAGG AGGGGAAAAGTGCTAATTACCATGACAAGAACATTGTAT TACTTAAAAACAAGGCAGTGCTAATGCCTAA TGGTGCTACAGTTTCTGCCTCTTCCGTGGAACACACACAT GGTGAACTCCTGGAAAAAACACTGTCTCAA TATTATCCAGATTGTGTTTCCATTGCGGTGCAGAAAACC ACATCTCACATAAATGCCATTAACAGTCAGG CTACTAATGAGTTGTCCTGTGAGATCACTCACCCATCGC ATACCTCAGGGCAGATCAATTCCGCACAGAC CTCTAACTCTGAGCTGCCTCCAAAGCCAGCTGCAGTGGT GAGTGAGGCCTGTGATGCTGATGATGCTGAT AATGCCAGTAAACTAGCTGCAATGCTAAATACCTGTTCC TTTCAGAAACCAGAACAACTACAACAACAAA AATCAGTTTTTGAGATATGCCCATCTCCTGCAGAAAATA ACATCCAGGGAACCACAAAGCTAGCGTCTGG TGAAGAATTCTGTTCAGGTTCCAGCAGCAATTTGCAAGC TCCTGGTGGCAGCTCTGAACGGTATTTAAAA CAAAATGAAATGAATGGTGCTTACTTCAAGCAAAGCTCA GTGTTCACTAAGGATTCCTTTTCTGCCACTA CCACACCACCACCACCATCACAATTGCTTCTTTCTCCCCC TCCTCCTCTTCCACAGGTTCCTCAGCTTCC TTCAGAAGGAAAAAGCACTCTGAATGGTGGAGTTTTAGA AGAACACCACCACTACCCCAACCAAAGTAAC ACAACACTTTTAAGGGAAGTGAAAATAGAGGGTAAACC TGAGGCACCACCTTCCCAGAGTCCTAATCCAT CTACACATGTATGCAGCCCTTCTCCGATGCTTTCTGAAAG GCCTCAGAATAATTGTGTGAACAGGAATGA CATACAGACTGCAGGGACAATGACTGTTCCATTGTGTTC TGAGAAAACAAGACCAATGTCAGAACACCTC AAGCATAACCCACCAATTTTTGGTAGCAGTGGAGAGCTA CAGGACAACTGCCAGCAGTTGATGAGAAACA AAGAGCAAGAGATTCTGAAGGGTCGAGACAAGGAGCAA ACACGAGATCTTGTGCCCCCAACACAGCACTA TCTGAAACCAGGATGGATTGAATTGAAGGCCCCTCGTTT TCACCAAGCGGAATCCCATCTAAAACGTAAT GAGGCATCACTGCCATCAATTCTTCAGTATCAACCCAAT CTCTCCAATCAAATGACCTCCAAACAATACA CTGGAAATTCCAACATGCCTGGGGGGCTCCCAAGGCAAG CTTACACCCAGAAAACAACACAGCTGGAGCA CAAGTCACAAATGTACCAAGTTGAAATGAATCAAGGGC AGTCCCAAGGTACAGTGGACCAACATCTCCAG TTCCAAAAACCCTCACACCAGGTGCACTTCTCCAAAACA GACCATTTACCAAAAGCTCATGTGCAGTCAC TGTGTGGCACTAGATTTCATTTTCAACAAAGAGCAGATT CCCAAACTGAAAAACTTATGTCCCCAGTGTT GAAACAGCACTTGAATCAACAGGCTTCAGAGACTGAGCC ATTTTCAAACTCACACCTTTTGCAACATAAG CCTCATAAACAGGCAGCACAAACACAACCATCCCAGAGT TCACATCTCCCTCAAAACCAGCAACAGCAGC AAAAAATTACAAATAAAGAATAAAGAGGAAATACTCCAG ACTTTTCCTCACCCCCAAAGCAACAATGATCA GCAAAGAGAAGGATCATTCTTTGGCCAGACTAAAGTGGA AGAATGTTTTCATGGTGAAAATCAGTATTCA AAATCAAGCGAGTTCGAGACTCATAATGTCCAAATGGGA CTGGAGGAAGTACAGAATATAAATCGTAGAA |

-continued

| Name | NCBI Reference Sequence | Sequence |
|---|---|---|
| | | ATTCCCCTTATAGTCAGACCATGAAATCAAGTGCATGCA
AAATACAGGTTTCTTGTTCAAACAATACACA
CCTAGTTTCAGAGAATAAAGAACAGACTACACATCCTGA
ACTTTTTGCAGGAAACAAGACCCAAAACTTG
CATCACATGCAATATTTTCCAAATAATGTGATCCCAAAG
CAAGATCTTCTTCACAGGTGCTTTCAAGAAC
AGGAGCAGAAGTCACAACAAGCTTCAGTTCTACAGGGAT
ATAAAAATAGAAACCAAGTATGTCTGGTCA
ACAAGCTGCGCAACTTGCTCAGCAAAGGTACTTGATACA
TAACCATGCAAATGTTTTTCCTGTGCCTGAC
CAGGGAGGAAGTCACACTCAGACCCCTCCCCAGAAGGA
CACTCAAAAGCATGCTGCTCTAAGGTGGCATC
TCTTACAGAAGCAAGAACAGCAGCAAACACAGCAACCC
CAAACTGAGTCTTGCCATAGTCAGATGCACAG
GCCAATTAAGGTGGAACCTGGATGCAAGCCACATGCCTG
TATGCACACAGCACCACCAGAAAACAAAACA
TGGAAAAAGGTAACTAAGCAAGAGAATCCACCTGCAAG
CTGTGATAATGTGCAGCAAAAGAGCATCATTG
AGACCATGGAGCAGCATCTGAAGCAGTTTCACGCCAAGT
CGTTATTTGACCATAAGGCTCTTACTCTCAA
ATCACAGAAGCAAGTAAAAGTTGAAATGTCAGGGCCAG
TCACAGTTTTGACTAGACAAACCACTGCTGCA
GAACTTGATAGCCACACCCCAGCTTTAGAGCAGCAAACA
ACTTCTTCAGAAAAGACACCAACCAAAAGAA
CAGCTGCTTCTGTTCTCAATAATTTTATAGAGTCACCTTC
CAAATTACTAGATACTCCTATAAAAAATTT
ATTGGATACACCTGTCAAGACTCAATATGATTTCCCATCT
TGCAGATGTGTAGAGCAAATTATTGAAAAA
GATGAAGGTCCTTTTTATACCCATCTAGGAGCAGGTCCT
AATGTGGCAGCTATTAGAGAAATCATGGAAG
AAAGGTTTGGACAGAAGGGTAAAGCTATTAGGATTGAA
AGAGTCATCTATACTGGTAAAGAAGGCAAAAG
TTCTCAGGGATGTCCTATTGCTAAGTGGGTGGTTCGCAG
AAGCAGCAGTGAAGAGAAGCTACTGTGTTTG
GTGCGGGAGCGAGCTGGCCACACCTGTGAGGCTGCAGTG
ATTGTGATTCTCATCCTGGTGTGGGAAGGAA
TCCCGCTGTCTCTGGCTGACAAACTCTACTCGGAGCTTAC
CGAGACGCTGAGGAAATACGGCACGCTCAC
CAATCGCCGGTGTGCCTTGAATGAAGAGAGAACTTGCGC
CTGTCAGGGGCTGGATCCAGAAACCTGTGGT
GCCTCCTTCTCTTTTGGTTGTTCATGGAGCATGTACTACA
ATGGATGTAAGTTTGCCAGAAGCAAGATCC
CAAGGAAGTTTAAGCTGCTTGGGGATGACCCAAAAGAG
GAAGAGAAACTGGAGTCTCATTTGCAAAACCT
GTCCACTCTTATGGCACCAACATATAAGAAACTTGCACC
TGATGCATATAATAATCAGATTGAATATGAA
CACAGAGCACCAGAGTGCCGTCTGGGTCTGAAGGAAGG
CCGTCCATTCTCAGGGGTCACTGCATGTTTGG
ACTTCTGTGCTCATGCCCACAGAGACTTGCACAACATGC
AGAATGGCAGCACATTGGTATGCACTCTCAC
TAGAGAAGACAATCGAGAATTTGGAGGAAAACCTGAGG
ATGAGCAGCTTCACGTTCTGCCTTTATACAAA
GTCTCTGACGTGGATGAGTTTGGGAGTGTGGAAGCTCAG
GAGGAGAAAAAACGGAGTGGTGCCATTCAGG
TACTGAGTTCTTTTCGGCGAAAAGTCAGGATGTTAGCAG
AGCCAGTCAAGACTTGCCGACAAAGGAAACT
AGAAGCCAAGAAAGCTGCAGCTGAAAAGCTTTCCTCCCT
GGGAGAACAGCTCAAATAAAAATGAAAAGGAA
AAGTCAGCCCCATCACGTACAAAACAAACTGAAAACGC
AAGCCAGGCTAAACAGTTGGCAGAACTTTTGC
GACTTTCAGGACCAGTCATGCAGCAGTCCCAGCAGCCCC
AGCCTCTACAGAAGCAGCCACCACAGCCCCA
GCAGCAGCAGAGACCCCAGCAGCAGCAGCCACATCACC
CTCAGACAGAGTCTGTCAACTCTTATTCTGCT
TCTGGATCCACCAATCCATACATGAGACGGCCCAATCCA
GTTAGTCCTTATCCAAACTCTTCACACACTT
CAGATATCTATGGAAGCACCAGCCCTATGAACTTCTATT
CCACCTCATCTCAAGCTGCAGGTTCATATTT
GAATTCTTCTAATCCCATGAACCCTTACCCTGGGCTTTTG
AATCAGAATACCCAATATCCATCATATCAA
TGCAATGGAAACCTATCAGTGGACAACTGCTCCCCATAT
CTGGGTTCCTATTCTCCCCAGTCTCAGCCGA
TGGATCTGTATAGGTATCCAAGCCAAGACCCTCTGTCTA
AGCTCAGTCTACCACCCATCCATACACTTTA
CCAGCCAAGGTTTGGAAATAGCCAGAGTTTTACATCTAA |

| Name | NCBI Reference Sequence | Sequence |
|---|---|---|
| | | ATACTTAGGTTATGGAAACCAAAATATGCAG |
| | | GGAGATGGTTTCAGCAGTTGTACCATTAGACCAAATGTA |
| | | CATCATGTAGGGAAATTGCCTCCTTATCCCA |
| | | CTCATGAGATGGATGGCCACTTCATGGGAGCCACCTCTA |
| | | GATTACCACCCAATCTGAGCAATCCAAACAT |
| | | GGACTATAAAAATGGTGAACATCATTCACCTTCTCACAT |
| | | AATCCATAACTACAGTGCAGCTCCGGGCATG |
| | | TTCAACAGCTCTCTTCATGCCCTGCATCTCCAAAACAAG |
| | | GAGAATGACATGCTTTCCCACACAGCTAATG |
| | | GGTTATCAAAGATGCTTCCAGCTCTTAACCATGATAGAA |
| | | CTGCTTGTGTCCAAGGAGGCTTACACAAATT |
| | | AAGTGATGCTAATGGTCAGGAAAAGCAGCCATTGGCACT |
| | | AGTCCAGGGTGTGGCTTCTGGTGCAGAGGAC |
| | | AACGATGAGGTCTGGTCAGACAGCGAGCAGAGCTTTCTG |
| | | GATCCTGACATTGGGGGAGTGGCCGTGGCTC |
| | | CAACTCATGGGTCAATTCTCATTGAGTGTGCAAAGCGTG |
| | | AGCTGCATGCCACAACCCCTTTAAAGAATCC |
| | | CAATAGGAATCACCCCACCAGGATCTCCCTCGTCTTTTAC |
| | | CAGCATAAGAGCATGAATGAGCCAAAACAT |
| | | GGCTTGGCTCTTTGGGAAGCCAAATGGCTGAAAAAGCC |
| | | CGTGAGAAAGAGGAAGAGTGTGAAAAGTATG |
| | | GCCCAGACTATGTGCCTCAGAAATCCCATGGCAAAAAAG |
| | | TGAAACGGGAGCCTGCTGAGCCACATGAAAC |
| | | TTCAGAGCCCACTTACCTGCGTTTCATCAAGTCTCTTGCC |
| | | GAAAGGACCATGTCCGTGACCACAGACTCC |
| | | ACAGTAACTACATCTCCATATGCCTTCACTCGGGTCACA |
| | | GGGCCTTACAACAGATATATATGATATCACC |
| | | CCCTTTTGTTGGTTACCTCACTTGAAAAGACCACAACCA |
| | | ACCTGTCAGTAGTATAGTTCTCATGACGTGG |
| | | GCAGTGGGGAAAGGTCACAGTATTCATGACAAATGTGGT |
| | | GGGAAAAACCTCAGCTCACCAGCAACAAAAG |
| | | AGGTTATCTTACCATAGCACTTAATTTTCACTGGCTCCCA |
| | | AGTGGTCACAGATGGCATCTAGGAAAAGAC |
| | | CAAAGCATTCTATGCAAAAAGAAGGTGGGGAAGAAAGT |
| | | GTTCCGCAATTTACATTTTTAAACACTGGTTC |
| | | TATTATTGGACGAGATGATATGTAAATGTGATCCCCCCC |
| | | CCCCGCTTACAACTCTACACATCTGTGACCA |
| | | CTTTTAATAATATCAAGTTTGCATAGTCATGGAACACAA |
| | | ATCAAACAAGTACTGTAGTATTACAGTGACA |
| | | GGAATCTTAAAATACCATCTGGTGCTGAATATATGATGT |
| | | ACTGAAATACTGGAATTATGGCTTTTTGAAA |
| | | TGCAGTTTTTACTGTAATCTTAACTTTTATTTATCAAAAT |
| | | AGCTACAGGAAACATGAATAGCAGGAAAAC |
| | | ACTGAATTTGTTTGGATGTTCTAAGAAATGGTGCTAAGA |
| | | AAATGGTGTCTTTAATAGCTAAAAATTTAAT |
| | | GCCTTTATATCATCAAGATGCTATCAGTGTACTCCAGTGC |
| | | CCTTGAATAATAGGGGTACCTTTTCATTCA |
| | | AGTTTTTATCATAATTACCTATTCTTACACAAGCTTAGTT |
| | | TTTAAAATGTGGACATTTTAAAGGCCTCTG |
| | | GATTTTGCTCATCCAGTGAAGTCCTTGTAGGACAATAAA |
| | | CGTATATATGTACATATATACACAAACATGT |
| | | ATATGTGCACACACATGTATATGTATAAATATTTTAAAT |
| | | GGTGTTTTAGAAGCACTTTGTCTACCTAAGC |
| | | TTTGACAACTTGAACAATGCTAAGGTACTGAGATGTTTA |
| | | AAAAACAAGTTTACTTTCATTTTAGAATGCA |
| | | AAGTTGATTTTTTAAGGAAACAAAGAAAGCTTTTAAAA |
| | | TATTTTTGCTTTTAGCCATGCATCTGCTGAT |
| | | GAGCAATTGTGTCCATTTTAACACAGCCAGTTAAATCC |
| | | ACCATGGGCTTACTGGATTCAAGGGAATAC |
| | | GTTAGTCCACAAAACATGTTTTCTGGTGCTCATCTCACAT |
| | | GCTATACTGTAAAACAGTTTTATACAAAAT |
| | | TGTATGACAAGTTCATTGCTCAAAAATGTACAGTTTTAA |
| | | GAATTTTCTATTAACTGCAGGTAATAATTAG |
| | | CTGCATGCTGCAGACTCAACAAAGCTAGTTCACTGAAGC |
| | | CTATGCTATTTTATGGATCATAGGCTCTTCA |
| | | GAGAACTGAATGGCAGTCTGCCTTTGTGTTGATAATTAT |
| | | GTACATTGTGACGTTGTCATTTCTTAGCTTA |
| | | AGTGTCCTCTTTAACAAGAGGATTGAGCAGACTGATGCC |
| | | TGCATAAGATGAATAAACAGGGTTAGTTCCA |
| | | TGTGAATCTGTCAGTTAAAAAGAAACAAAAACAGGCAG |
| | | CTGGTTTGCTGTGGTGGTTTTAAATCATTAAT |
| | | TTGTATAAAGAAGTGAAAGAGTTGTATAGTAAATTAAAT |
| | | TGTAAACAAAACTTTTTTAATGCAATGCTTT |
| | | AGTATTTTAGTACTGTAAAAAAATTAAATATATACATAT |
| | | ATATATATATATATATATATATATATATGAG |

| Name | NCBI Reference Sequence | Sequence |
|---|---|---|
| | | TTTGAAGCAGAATTCACATCATGATGGTGCTACTCAGCC TGCTACAAATATATCATAATGTGAGCTAAGA ATTCATTAAATGTTTGAGTGATGTTCCTACTTGTCATATA CCTCAACACTAGTTTGGCAATAGGATATTG AACTGAGAGTGAAAGCATTGTGTACCATCATTTTTTTCCA AGTCCTTTTTTTTATTGTTAAAAAAAAAAG CATACCTTTTTTCAATACTTGATTTCTTAGCAAGTATAAC TTGAACTTCAACCTTTTGTTCTAAAAATT CAGGGATATTTCAGCTCATGCTCTCCCTATGCCAACATGT CACCTGTGTTTATGTAAAATTGTTGTAGGT TAATAAATATATTCTTTGTCAGGGATTTAACCCTTTTATT TTGAATCCCTTCTATTTTACTTGTACATGT GCTGATGTAACTAAAACTAATTTTGTAAATCTGTTGGCTC TTTTTATTGTAAAGAAAAGCATTTTAAAAG TTTGAGGAATCTTTTGACTGTTTCAAGCAGGAAAAAAAA ATTACATGAAAATAGAATGCACTGAGTTGAT AAAGGGAAAAATTGTAAGGCAGGAGTTTGGCAAGTGGC TGTTGGCCAGAGACTTACTTGTAACTCTCTAA ATGAAGTTTTTTTGATCCTGTAATCACTGAAGGTACATAC TCCATGTGGACTTCCCTTAAACAGGCAAAC ACCTACAGGTATGGTGTGCAACAGATTGTACAATTACAT TTTGGCCTAAATACATTTTTGCTTACTAGTA TTTAAAATAAATTCTTAATCAGAGGAGGCCTTTGGGTTTT ATTGGTCAAATCTTTGTAAGCTGGCTTTTG TCTTTTTAAAAAATTTCTTGAATTTGTGGTTGTGTCCAAT TTGCAAACATTTCCAAAAATGTTTGCTTTG CTTACAAACCACATGATTTTAATGTTTTTTGTATACCATA ATATCTAGCCCCAAACATTTGATTACTACA TGTGCATTGGTGATTTTGATCATCCATTCTTAATATTTGA TTTCTGTGTCACCTACTGTCATTTGTTAAA CTGCTGGCCAACAAGAACAGGAAGTATAGTTTGGGGGGT TGGGGAGAGTTTACATAAGGAAGAGAAGAAA TTGAGTGGCATATTGTAAATATCAGATCTATAATTGTAA ATATAAAACCTGCCTCAGTTAGAATGAATGG AAAGCAGATCTACAATTTGCTAATATAGGAATATCAGGT TGACTATATAGCCATACTTGAAAATGCTTCT GAGTGGTGTCAACTTTACTTGAATGAATTTTTCATCTTGA TTGACGCACAGTGATGTACAGTTCACTTCT GAAGCTAGTGGTTAACTTGTGTAGGAAACTTTTGCAGTT TGACACTAAGATAACTTCTGTGTGCATTTTT CTATGCTTTTTTAAAAACTAGTTTCATTTCATTTTCATGA GATGTTTGGTTTATAAGATCTGAGGATGGT TATAAATACTGTAAGTATTGTAATGTTATGAATGCAGGT TATTTGAAAGCTGTTTATTATTATATCATTC CTGATAATGCTATGTGAGTGTTTTTAATAAAATTTATATT TATTTAATGCACTCTAA |
| PREDICTED: Homo sapiens tet methylcytosine dioxygenase 2 (TET2), transcript variant X2, mRNA [SEQ ID NO: 953] | XM_006714242.2 | GTAGAGAAGCAGAAGGAAGCAAGATGGCTGCCCTTTAG GATTTGTTAGAAAGGAGACCCGACTGCAACTG CTGGATTGCTGCAAGGCTGAGGGACGAGAACGAGGCTG GCAAACATTCAGCAGCACACCCTCTCAAGATT GTTTACTTGCCTTTGCTCCTGTTGAGTTACAACGCTTGGA AGCAGGAGATGGGCTCAGCAGCAGCCAATA GGACATGATCCAGGAAGAGCAGTAAGGGACTGAGCTGC TGAATTCAACTAGAGGGCAGCCTTGTGGATGG CCCCGAAGCAAGCCTGATGGAACAGGATAGAACCAACC ATGTTGAGGGCAACAGACTAAGTCCATTCCTG ATACCATCACCTCCCATTTGCCAGACAGAACCTCTGGCT ACAAAGCTCCAGAATGGAAGCCCACTGCCTG AGAGAGCTCATCCAGAAGTAAATGGAGACACCAAGTGG CACTCTTTCAAAAGTTATTATGGAATACCCTG TATGAAGGGAAGCCAGAATAGTCGTGTGAGTCCTGACTT TACACAAGAAAGTAGAGGGTATTCCAAGTGT TTGCAAAATGGAGGAATAAAACGCACAGTTAGTGAACCT TCTCTCTCTGGGCTCCTTCAGATCAAGAAAT TGAAACAAGACCAAAAGGCTAATGGAGAAAGACGTAAC TTCGGGGTAAGCCAAGAAAGAAATCCAGGTGA AAGCAGTCAACCAAATGTCTCCGATTTGAGTGATAAGAA AGAATCTGTGAGTTCTGTAGCCCAAGAAAAT GCAGTTAAAGATTTCACCAGTTTTTCAACACATAACTGC AGTGGGCCTGAAAATCCAGAGCTTCAGATTC TGAATGAGCAGGAGGGGAAAAGTGCTAATTACCATGAC AAGAACATTGTATTACTTAAAAACAAGGCAGT GCTAATGCCTAATGGTGCTACAGTTTCTGCCTCTTCCGTG GAACACACACATGGTGAACTCCTGGAAAAA |

| Name | NCBI Reference Sequence | Sequence |
|---|---|---|
| | | ACACTGTCTCAATATTATCCAGATTGTGTTTCCATTGCGG<br>TGCAGAAAACCACATCTCACATAAATGCCA<br>TTAACAGTCAGGCTACTAATGAGTTGTCCTGTGAGATCA<br>CTCACCCATCGCATACCTCAGGGCAGATCAA<br>TTCCGCACAGACCTCTAACTCTGAGCTGCCTCCAAAGCC<br>AGCTGCAGTGGTGAGTGAGGCCTGTGATGCT<br>GATGATGCTGATAATGCCAGTAAACTAGCTGCAATGCTA<br>AATACCTGTTCCTTTCAGAAACCAGAACAAC<br>TACAACAACAAAAATCAGTTTTTGAGATATGCCCATCTC<br>CTGCAGAAAATAACATCCAGGGAACCACAAA<br>GCTAGCGTCTGGTGAAGAATTCTGTTCAGGTTCCAGCAG<br>CAATTTGCAAGCTCCTGGTGGCAGCTCTGAA<br>CGGTATTTAAAACAAAATGAAATGAATGGTGCTTACTTC<br>AAGCAAAGCTCAGTGTTCACTAAGGATTCCT<br>TTTCTGCCACTACCACACCACCACCACCATCACAATTGCT<br>TCTTTCTCCCCTCCTCCTCTTCCACAGGT<br>TCCTCAGCTTCCTTCAGAAGGAAAAAGCACTCTGAATGG<br>TGGAGTTTTAGAAGAACACCACCACTACCCC<br>AACCAAAGTAACACAACACTTTTAAGGGAAGTGAAAAT<br>AGAGGGTAAACCTGAGGCACCACCTTCCCAGA<br>GTCCTAATCCATCTACACATGTATGCAGCCCTTCTCCGAT<br>GCTTTCTGAAAGGCCTCAGAATAATTGTGT<br>GAACAGGAATGACATACAGACTGCAGGGACAATGACTG<br>TTCCATTGTGTTCTGAGAAAACAAGACCAATG<br>TCAGAACACCTCAAGCATAACCCACCAATTTTTGGTAGC<br>AGTGGAGAGCTACAGGACAACTGCCAGCAGT<br>TGATGAGAAACAAAGAGCAAGAGATTCTGAAGGGTCGA<br>GACAAGGAGCAAACACGAGATCTTGTGCCCCC<br>AACACAGCACTATCTGAAACCAGGATGGATTGAATTGAA<br>GGCCCCTCGTTTTCACCAAGCGGAATCCCAT<br>CTAAAACGTAATGAGGCATCACTGCCATCAATTCTTCAG<br>TATCAACCCAATCTCTCCAATCAAATGACCT<br>CCAAACAATACACTGGAAATTCCAACATGCCTGGGGGC<br>TCCCAAGGCAAGCTTACACCCAGAAAACAAC<br>ACAGCTGGAGCACAAGTCACAAATGTACCAAGTTGAAAT<br>GAATCAAGGGCAGTCCCAAGGTACAGTGGAC<br>CAACATCTCCAGTTCCAAAAACCCTCACACCAGGTGCAC<br>TTCTCCAAAACAGACCATTTACCAAAAGCTC<br>ATGTGCAGTCACTGTGTGGCACTAGATTTCATTTTCAACA<br>AAGAGCAGATTCCCAAACTGAAAAACTTAT<br>GTCCCCAGTGTTGAAACAGCACTTGAATCAACAGGCTTC<br>AGAGACTGAGCCATTTTCAAACTCACACCTT<br>TTGCAACATAAGCCTCATAAACAGGCAGCACAAACACA<br>ACCATCCCAGAGTTCACATCTCCCTCAAAACC<br>AGCAACAGCAGCAAAAATTACAAATAAAGAATAAAGAG<br>GAAATACTCCAGACTTTTCCTCACCCCCAAAG<br>CAACAATGATCAGCAAAGAGAAGGATCATTCTTTGGCCA<br>GACTAAAGTGGAAGAATGTTTTCATGGTGAA<br>AATCAGTATTCAAAATCAAGCGAGTTCGAGACTCATAAT<br>GTCCAAATGGGACTGGAGGAAGTACAGAATA<br>TAAATCGTAGAAATTCCCCTTATAGTCAGACCATGAAAT<br>CAAGTGCATGCAAAATACAGGTTTCTTGTTC<br>AAACAATACACACCTAGTTTCAGAGAATAAAGAACAGA<br>CTACACATCCTGAACTTTTTGCAGGAAACAAG<br>ACCCAAAACTTGCATCACATGCAATATTTTCCAAATAAT<br>GTGATCCCAAAGCAAGATCTTCTTCACAGGT<br>GCTTTCAAGAACAGGAGCAGAAGTCACAACAAGCTTCA<br>GTTCTACAGGGATATAAAAATAGAAACCAAGA<br>TATGTCTGGTCAACAAGCTGCGCAACTTGCTCAGCAAAG<br>GTACTTGATACATAACCATGCAAATGTTTTT<br>CCTGTGCCTGACCAGGGAGGAAGTCACACTCAGACCCCT<br>CCCCAGAAGGACACTCAAAAGCATGCTGCTC<br>TAAGGTGGCATCTCTTACAGAAGCAAGAACAGCAGCAA<br>ACACAGCAACCCCAAACTGAGTCTTGCCATAG<br>TCAGATGCACAGGCCAATTAAGGTGGAACCTGGATGCAA<br>GCCACATGCCTGTATGCACACAGCACCACCA<br>GAAAACAAAACATGGAAAAAGGTAACTAAGCAAGAGAA<br>TCCACCTGCAAGCTGTGATAATGTGCAGCAAA<br>AGAGCATCATTGAGACCATGGAGCAGCATCTGAAGCAGT<br>TTCACGCCAAGTCGTTATTTGACCATAAGGC<br>TCTTACTCTCAAATCACAGAAGCAAGTAAAAGTTGAAAT<br>GTCAGGGCCAGTCACAGTTTTGACTAGACAA<br>ACCACTGCTGCAGAACTTGATAGCCACACCCCAGCTTTA<br>GAGCAGCAAACAACTTCTTCAGAAAAGACAC<br>CAACCAAAAGAACAGCTGCTTCTGTTCTCAATAATTTTAT |

-continued

| Name | NCBI Reference Sequence | Sequence |
|---|---|---|
| | | AGAGTCACCTTCCAAATTACTAGATACTCC |
| | | TATAAAAAATTTATTGGATACACCTGTCAAGACTCAATA |
| | | TGATTTCCCATCTTGCAGATGTGTAGGTTTG |
| | | GACAGAAGGGTAAAGCTATTAGGATTGAAAGAGTCATCT |
| | | ATACTGGTAAAGAAGGCAAAAGTTCTCAGGG |
| | | ATGTCCTATTGCTAAGTGGGAGAACTTGCGCCTGTCAGG |
| | | GGCTGGATCCAGAAACCTGTGGTGCCTCCTT |
| | | CTCTTTTGGTTGTTCATGGAGCATGTACTACAATGGATGT |
| | | AAGTTTGCCAGAAGCAAGATCCCAAGGAAG |
| | | TTTAAGCTGCTTGGGGATGACCCAAAAGAGGAAGAGAA |
| | | ACTGGAGTCTCATTTGCAAAACCTGTCCACTC |
| | | TTATGGCACCAACATATAAGAAACTTGCACCTGATGCAT |
| | | ATAATAATCAGATTGAATATGAACACAGAGC |
| | | ACCAGAGTGCCGTCTGGGTCTGAAGGAAGGCCGTCCATT |
| | | CTCAGGGGTCACTGCATGTTTGGACTTCTGT |
| | | GCTCATGCCCACAGAGACTTGCACAACATGCAGAATGGC |
| | | AGCACATTGGTATGCACTCTCACTAGAGAAG |
| | | ACAATCGAGAATTTGGAGGAAAAACCTGAGGATGAGCAG |
| | | CTTCACGTTCTGCCTTTATACAAAGTCTCTGA |
| | | CGTGGATGAGTTTGGGAGTGTGGAAGCTCAGGAGGAGA |
| | | AAAAACGGAGTGGTGCCATTCAGGTACTGAGT |
| | | TCTTTTCGGCGAAAAGTCAGGATGTTAGCAGAGCCAGTC |
| | | AAGACTTGCCGACAAAGGAAACTAGAAGCCA |
| | | AGAAAGCTGCAGCTGAAAAGCTTTCCTCCCTGGAGAACA |
| | | GCTCAAATAAAAATGAAAAGGAAAAGTCAGC |
| | | CCCATCACGTACAAAACAAACTGAAAACGCAAGCCAGG |
| | | CTAAACAGTTGGCAGAACTTTTGCGACTTTCA |
| | | GGACCAGTCATGCAGCAGTCCCAGCAGCCCCAGCCTCTA |
| | | CAGAAGCAGCCACCACAGCCCCAGCAGCAGC |
| | | AGAGACCCCAGCAGCAGCAGCCACATCACCCTCAGACA |
| | | GAGTCTGTCAACTCTTATTCTGCTTCTGGATC |
| | | CACCAATCCATACATGAGACGGCCCAATCCAGTTAGTCC |
| | | TTATCCAAACTCTTCACACACTTCAGATATC |
| | | TATGGAAGCACCAGCCCTATGAACTTCTATTCCACCTCAT |
| | | CTCAAGCTGCAGGTTCATATTTGAATTCTT |
| | | CTAATCCCATGAACCCTTACCCTGGGCTTTTGAATCAGA |
| | | ATACCCAATATCCATCATATCAATGCAATGG |
| | | AAACCTATCAGTGGACAACTGCTCCCCATATCTGGGTTC |
| | | CTATTCTCCCCAGTCTCAGCCGATGGATCTG |
| | | TATAGGTATCCAAGCCAAGACCCTCTGTCTAAGCTCAGT |
| | | CTACCACCCATCCATACACTTTACCAGCCAA |
| | | GGTTTGGAAATAGCCAGAGTTTTACATCTAAATACTTAG |
| | | GTTATGGAAACCAAAATATGCAGGGAGATGG |
| | | TTTCAGCAGTTGTACCATTAGACCAAATGTACATCATGT |
| | | AGGGAAATTGCCTCCTTATCCCACTCATGAG |
| | | ATGGATGGCCACTTCATGGGAGCCACCTCTAGATTACCA |
| | | CCCAATCTGAGCAATCCAAACATGGACTATA |
| | | AAAATGGTGAACATCATTCACCTTCTCACATAATCCATA |
| | | ACTACAGTGCAGCTCCGGGCATGTTCAACAG |
| | | CTCTCTTCATGCCCTGCATCTCCAAAACAAGGAGAATGA |
| | | CATGCTTTCCCACACAGCTAATGGGTTATCA |
| | | AAGATGCTTCCAGCTCTTAACCATGATAGAACTGCTTGT |
| | | GTCCAAGGAGGCTTACACAAATTAAGTGATG |
| | | CTAATGGTCAGGAAAAGCAGCCATTGGCACTAGTCCAGG |
| | | GTGTGGCTTCTGGTGCAGAGGACAACGATGA |
| | | GGTCTGGTCAGACAGCGAGCAGAGCTTTCTGGATCCTGA |
| | | CATTGGGGGAGTGGCCGTGGCTCCAACTCAT |
| | | GGGTCAATTCTCATTGAGTGTGCAAAGCGTGAGCTGCAT |
| | | GCCACAACCCCTTTAAAGAATCCCAATAGGA |
| | | ATCACCCCACCAGGATCTCCCTCGTCTTTTACCAGCATAA |
| | | GAGCATGAATGAGCCAAAACATGGCTTGGC |
| | | TCTTTGGGAAGCCAAATGGCTGAAAAAGCCCGTGAGA |
| | | AAGAGGAAGAGTGTGAAAAGTATGGCCCAGAC |
| | | TATGTGCCTCAGAAATCCCATGGCAAAAAAGTGAAACGG |
| | | GAGCCTGCTGAGCCACATGAAACTTCAGAGC |
| | | CCACTTACCTGCGTTTCATCAAGTCTCTTGCCGAAAGGAC |
| | | CATGTCCGTGACCACAGACTCCACAGTAAC |
| | | TACATCTCCATATGCCTTCACTCGGGTCACAGGGCCTTAC |
| | | AACAGATATATATGATATCACCCCCTTTTG |
| | | TTGGTTACCTCACTTGAAAAGACCACAACCAACCTGTCA |
| | | GTAGTATAGTTCTCATGACGTGGGCAGTGGG |
| | | GAAAGGTCACAGTATTCATGACAAATGTGGTGGGAAAA |
| | | ACCTCAGCTCACCAGCAACAAAAGAGGTTATC |
| | | TTACCATAGCACTTAATTTTCACTGGCTCCCAAGTGGTCA |
| | | CAGATGGCATCTAGGAAAAGACCAAAGCAT |

| Name | NCBI Reference Sequence | Sequence |
|---|---|---|
| | | TCTATGCAAAAGAAGGTGGGGAAGAAAGTGTTCCGCA
ATTTACATTTTTAAACACTGGTTCTATTATTG
GACGAGATGATATGTAAATGTGATCCCCCCCCCCCGCTT
ACAACTCTACACATCTGTGACCACTTTTAAT
AATATCAAGTTTGCATAGTCATGGAACACAAATCAAACA
AGTACTGTAGTATTACAGTGACAGGAATCTT
AAAATACCATCTGGTGCTGAATATATGATGTACTGAAAT
ACTGGAATTATGGCTTTTTGAAATGCAGTTT
TTACTGTAATCTTAACTTTTATTTATCAAAATAGCTACAG
GAAACATGAATAGCAGGAAAACACTGAATT
TGTTTGGATGTTCTAAGAAATGGTGCTAAGAAAATGGTG
TCTTTAATAGCTAAAAATTTAATGCCTTTAT
ATCATCAAGATGCTATCAGTGTACTCCAGTGCCCTTGAA
TAATAGGGGTACCTTTTCATTCAAGTTTTTA
TCATAATTACCTATTCTTACACAAGCTTAGTTTTTAAAAT
GTGGACATTTTAAAGGCCTCTGGATTTTGC
TCATCCAGTGAAGTCCTTGTAGGACAATAAACGTATATA
TGTACATATATACACAAACATGTATATGTGC
ACACACATGTATATGTATAAATATTTTAAATGGTGTTTTA
GAAGCACTTTGTCTACCTAAGCTTTGACAA
CTTGAACAATGCTAAGGTACTGAGATGTTTAAAAAACAA
GTTTACTTTCATTTTAGAATGCAAAGTTGAT
TTTTTTAAGGAAACAAAGAAAGCTTTTAAAATATTTTTGC
TTTTTAGCCATGCATCTGCTGATGAGCAATT
GTGTCCATTTTTAACACAGCCAGTTAAATCCACCATGGG
GCTTACTGGATTCAAGGGAATACGTTAGTCC
ACAAAACATGTTTTCTGGTGCTCATCTCACATGCTATACT
GTAAAACAGTTTTATACAAAATTGTATGAC
AAGTTCATTGCTCAAAAATGTACAGTTTTAAGAATTTTCT
ATTAACTGCAGGTAATAATTAGCTGCATGC
TGCAGACTCAACAAAGCTAGTTCACTGAAGCCTATGCTA
TTTTATGGATCATAGGCTCTTCAGAGAACTG
AATGGCAGTCTGCCTTTGTGTTGATAATTATGTACATTGT
GACGTTGTCATTTCTTAGCTTAAGTGTCCT
CTTTAACAAGAGGATTGAGCAGACTGATGCCTGCATAAG
ATGAATAAACAGGGTTAGTTCCATGTGAATC
TGTCAGTTAAAAGAAACAAAAACAGGCAGCTGGTTTGC
TGTGGTGGTTTTAAATCATTAATTTGTATAA
AGAAGTGAAAGAGTTGTATAGTAAATTAAATTGTAAACA
AAACTTTTTTAATGCAATGCTTTAGTATTTT
AGTACTGTAAAAAAATTAAATATATACATATATATATAT
ATATATATATATATATATGAGTTTGAAGC
AGAATTCACATCATGATGGTGCTACTCAGCCTGCTACAA
ATATATCATAATGTGAGCTAAGAATTCATTA
AATGTTTGAGTGATGTTCCTACTTGTCATATACCTCAACA
CTAGTTTGGCAATAGGATATTGAACTGAGA
GTGAAAGCATTGTGTACCATCATTTTTTTCCAAGTCCTTT
TTTTTATTGTTAAAAAAAAAAGCATACCTT
TTTTCAATACTTGATTTCTTAGCAAGTATAACTTGAACTT
CAACCTTTTTGTTCTAAAAATTCAGGGATA
TTTCAGCTCATGCTCTCCCTATGCCAACATGTCACCTGTG
TTTATGTAAAATTGTTGTAGGTTAATAAAT
ATATTCTTTGTCAGGGATTTAACCCTTTTATTTTGAATCC
CTTCTATTTTACTTGTACATGTGCTGATGT
AACTAAAACTAATTTTGTAAATCTGTTGGCTCTTTTTATT
GTAAAGAAAAGCATTTTAAAAGTTTGAGGA
ATCTTTTGACTGTTTCAAGCAGGAAAAAAAAAATTACATG
AAAATAGAATGCACTGAGTTGATAAAGGGAA
AAATTGTAAGGCAGGAGTTTGGCAAGTGGCTGTTGGCCA
GAGACTTACTTGTAACTCTCTAAATGAAGTT
TTTTTGATCCTGTAATCACTGAAGGTACATACTCCATGTG
GACTTCCCTTAAACAGGCAAACACCTACAG
GTATGGTGTGCAACAGATTGTACAATTACATTTTGGCCT
AAATACATTTTTGCTTACTAGTATTTAAAAT
AAATTCTTAATCAGAGGAGGCCTTTGGGTTTTATTGGTCA
AATCTTTGTAAGCTGGCTTTTGTCTTTTTA
AAAAATTTCTTGAATTTGTGGTTGTGTCCAATTTGCAAAC
ATTTCCAAAAATGTTTGCTTTGCTTACAAA
CCACATGATTTTAATGTTTTTTGTATACCATAATATCTAG
CCCCAAACATTTGATTACTACATGTGCATT
GGTGATTTTGATCATCCATTCTTAATATTTGATTTCTGTG
TCACCTACTGTCATTTGTTAAACTGCTGGC
CAACAAGAACAGGAAGTATAGTTTGGGGGGTTGGGGAG
AGTTTACATAAGGAAGAGAAGAAATTGAGTGG
CATATTGTAAATATCAGATCTATAATTGTAAATATAAAA |

-continued

| Name | NCBI Reference Sequence | Sequence |
|---|---|---|
| | | CCTGCCTCAGTTAGAATGAATGGAAAGCAGA<br>TCTACAATTTGCTAATATAGGAATATCAGGTTGACTATAT<br>AGCCATACTTGAAAATGCTTCTGAGTGGTG<br>TCAACTTTACTTGAATGAATTTTTCATCTTGATTGACGCA<br>CAGTGATGTACAGTTCACTTCTGAAGCTAG<br>TGGTTAACTTGTGTAGGAAACTTTTGCAGTTTGACACTAA<br>GATAACTTCTGTGTGCATTTTCTATGCTT<br>TTTTAAAAACTAGTTTCATTTCATTTTCATGAGATGTTTG<br>GTTTATAAGATCTGAGGATGGTTATAAATA<br>CTGTAAGTATTGTAATGTTATGAATGCAGGTTATTTGAA<br>AGCTGTTTATTATTATATCATTCCTGATAAT<br>GCTATGTGAGTGTTTTTAATAAAATTTATATTTATTTAAT<br>GCACTCTAA |
| Homo sapiens tet methylcytosine dioxygenase 2 (TET2), transcript variant 2, mRNA<br>[SEQ ID NO: 954] | NM_017628.4 | AAACAGAAGGTGGGCCGGGGCGGGGAGAAACAGAACTC<br>GGTCAATTTCCCAGTTTGTCGGGTCTTTAAAA<br>ATACAGGCCCCTAAAGCACTAAGGGCATGCCCTCGGTGA<br>AACAGGGGAGCGCTTCTGCTGAATGAGATTA<br>AAGCGACAGAAAAGGGAAAGGAGAGCGCGGGCAACGG<br>GATCTAAAGGGAGATAGAGACGCGGGCCTCTGA<br>GGGCTGGCAAACATTCAGCAGCACACCCTCTCAAGATTG<br>TTTACTTGCCTTTGCTCCTGTTGAGTTACAA<br>CGCTTGGAAGCAGGAGATGGGCTCAGCAGCAGCCAATA<br>GGACATGATCCAGGAAGAGCAGTAAGGGACTG<br>AGCTGCTGAATTCAACTAGAGGGCAGCCTTGTGGATGGC<br>CCCGAAGCAAGCCTGATGGAACAGGATAGAA<br>CCAACCATGTTGAGGGCAACAGACTAAGTCCATTCCTGA<br>TACCATCACCTCCCATTTGCCAGACAGAACC<br>TCTGGCTACAAAGCTCCAGAATGGAAGCCCACTGCCTGA<br>GAGAGCTCATCCAGAAGTAAATGGAGACACC<br>AAGTGGCACTCTTTCAAAAGTTATTATGGAATACCCTGT<br>ATGAAGGGAAGCCAGAATAGTCGTGTGAGTC<br>CTGACTTTACACAAGAAAGTAGAGGGTATTCCAAGTGTT<br>TGCAAAATGGAGGAATAAAACGCACAGTTAG<br>TGAACCTTCTCTCTCTGGGCTCCTTCAGATCAAGAAATTG<br>AAACAAGACCAAAAGGCTAATGGAGAAAGA<br>CGTAACTTCGGGGTAAGCCAAGAAAGAAATCCAGGTGA<br>AAGCAGTCAACCAAATGTCTCCGATTTGAGTG<br>ATAAGAAAGAATCTGTGAGTTCTGTAGCCCAAGAAAATG<br>CAGTTAAAGATTTCACCAGTTTTTCAACACA<br>TAACTGCAGTGGGCCTGAAAATCCAGAGCTTCAGATTCT<br>GAATGAGCAGGAGGGGAAAAGTGCTAATTAC<br>CATGACAAGAACATTGTATTACTTAAAAACAAGGCAGTG<br>CTAATGCCTAATGGTGCTACAGTTTCTGCCT<br>CTTCCGTGGAACACACACATGGTGAACTCCTGGAAAAAA<br>CACTGTCTCAATATTATCCAGATTGTGTTTC<br>CATTGCGGTGCAGAAAACCACATCTCACATAAATGCCAT<br>TAACAGTCAGGCTACTAATGAGTTGTCCTGT<br>GAGATCACTCACCCATCGCATACCTCAGGGCAGATCAAT<br>TCCGCACAGACCTCTAACTCTGAGCTGCCTC<br>CAAAGCCAGCTGCAGTGGTGAGTGAGGCCTGTGATGCTG<br>ATGATGCTGATAATGCCAGTAAACTAGCTGC<br>AATGCTAAATACCTGTTCCTTTCAGAAACCAGAACAACT<br>ACAACAACAAAAATCAGTTTTTGAGATATGC<br>CCATCTCCTGCAGAAAATAACATCCAGGGAACCACAAAG<br>CTAGCGTCTGGTGAAGAATTCTGTTCAGGTT<br>CCAGCAGCAATTTGCAAGCTCCTGGTGGCAGCTCTGAAC<br>GGTATTTAAAACAAAATGAAATGAATGGTGC<br>TTACTTCAAGCAAAGCTCAGTGTTCACTAAGGATTCCTTT<br>TCTGCCACTACCACACCACCACCACCATCA<br>CAATTGCTTCTTTCTCCCCCTCCTCCTCTTCCACAGGTTCC<br>TCAGCTTCCTTCAGAAGGAAAAAGCACTC<br>TGAATGGTGGAGTTTTAGAAGAACACCACCACTACCCCA<br>ACCAAAGTAACACAACACTTTTAAGGGAAGT<br>GAAAATAGAGGGTAAACCTGAGGCACCACCTTCCCAGA<br>GTCCTAATCCATCTACACATGTATGCAGCCCT<br>TCTCCGATGCTTTCTGAAAGGCCTCAGAATAATTGTGTG<br>AACAGGAATGACATACAGACTGCAGGGACAA<br>TGACTGTTCCATTGTGTTCTGAGAAAACAAGACCAATGT<br>CAGAACACCTCAAGCATAACCCACCAATTTT<br>TGGTAGCAGTGGAGAGCTACAGGACAACTGCCAGCAGTT<br>GATGAGAAACAAAGAGCAAGAGATTCTGAAG<br>GGTCGAGACAAGGAGCAAACACGAGATCTTGTGCCCCC<br>AACACAGCACTATCTGAAACCAGGATGGATTG<br>AATTGAAGGCCCCTCGTTTTCACCAAGCGGAATCCCATC |

| Name | NCBI Reference Sequence | Sequence |
|---|---|---|
| | | TAAAACGTAATGAGGCATCACTGCCATCAAT |
| | | TCTTCAGTATCAACCCAATCTCTCCAATCAAATGACCTCC |
| | | AAACAATACACTGGAAATTCCAACATGCCT |
| | | GGGGGGCTCCCAAGGCAAGCTTACACCCAGAAAACAAC |
| | | ACAGCTGGAGCACAAGTCACAAATGTACCAAG |
| | | TTGAAATGAATCAAGGGCAGTCCCAAGGTACAGTGGACC |
| | | AACATCTCCAGTTCCAAAAACCCTCACACCA |
| | | GGTGCACTTCTCCAAAACAGACCATTTACCAAAAGCTCA |
| | | TGTGCAGTCACTGTGTGGCACTAGATTTCAT |
| | | TTTCAACAAAGAGCAGATTCCCAAACTGAAAAACTTATG |
| | | TCCCCAGTGTTGAAACAGCACTTGAATCAAC |
| | | AGGCTTCAGAGACTGAGCCATTTTCAAACTCACACCTTTT |
| | | GCAACATAAGCCTCATAAACAGGCAGCACA |
| | | AACACAACCATCCCAGAGTTCACATCTCCCTCAAAACCA |
| | | GCAACAGCAGCAAAAATTACAAATAAAGAAT |
| | | AAAGAGGAAATACTCCAGACTTTTCCTCACCCCCAAAGC |
| | | AACAATGATCAGCAAAGAGAAGGATCATTCT |
| | | TTGGCCAGACTAAAGTGGAAGAATGTTTTCATGGTGAAA |
| | | ATCAGTATTCAAAATCAAGCGAGTTCGAGAC |
| | | TCATAATGTCCAAATGGGACTGGAGGAAGTACAGAATAT |
| | | AAATCGTAGAAATTCCCCTTATAGTCAGACC |
| | | ATGAAATCAAGTGCATGCAAAATACAGGTTTCTTGTTCA |
| | | AACAATACACACCTAGTTTCAGAGAATAAAG |
| | | AACAGACTACACATCCTGAACTTTTTGCAGGAAACAAGA |
| | | CCCAAAACTTGCATCACATGCAATATTTTCC |
| | | AAATAATGTGATCCCAAAGCAAGATCTTCTTCACAGGTG |
| | | CTTTCAAGAACAGGAGCAGAAGTCACAACAA |
| | | GCTTCAGTTCTACAGGGATATAAAAATAGAAACCAAGAT |
| | | ATGTCTGGTCAACAAGCTGCGCAACTTGCTC |
| | | AGCAAAGGTACTTGATACATAACCATGCAAATGTTTTTC |
| | | CTGTGCCTGACCAGGGAGGAAGTCACACTCA |
| | | GACCCCTCCCCAGAAGGACACTCAAAAGCATGCTGCTCT |
| | | AAGGTGGCATCTCTTACAGAAGCAAGAACAG |
| | | CAGCAAACACAGCAACCCCAAACTGAGTCTTGCCATAGT |
| | | CAGATGCACAGGCCAATTAAGGTGGAACCTG |
| | | GATGCAAGCCACATGCCTGTATGCACACAGCACCACCAG |
| | | AAAACAAACATGGAAAAAGGTAACTAAGCA |
| | | AGAGAATCCACCTGCAAGCTGTGATAATGTGCAGCAAAA |
| | | GAGCATCATTGAGACCATGGAGCAGCATCTG |
| | | AAGCAGTTTCACGCCAAGTCGTTATTTGACCATAAGGCT |
| | | CTTACTCTCAAATCACAGAAGCAAGTAAAAG |
| | | TTGAAATGTCAGGGCCAGTCACAGTTTTGACTAGACAAA |
| | | CCACTGCTGCAGAACTTGATAGCCACACCCC |
| | | AGCTTTAGAGCAGCAAACAACTTCTTCAGAAAAGACACC |
| | | AACCAAAAGAACAGCTGCTTCTGTTCTCAAT |
| | | AATTTTATAGAGTCACCTTCCAAATTACTAGATACTCCTA |
| | | TAAAAAATTTATTGGATACACCTGTCAAGA |
| | | CTCAATATGATTTCCCATCTTGCAGATGTGTAGGTAAGTG |
| | | CCAGAAATGTACTGAGACACATGGCGTTTA |
| | | TCCAGAATTAGCAAATTTATCTTCAGATATGGGATTTTCC |
| | | TTCTTTTTTTAAATCTTGAGTCTGGCAGCA |
| | | ATTTGTAAAGGCTCATAAAAATCTGAAGCTTACATTTTTT |
| | | GTCAAGTTACCGATGCTTGTGTCTTGTGAA |
| | | AGAGAACTTCACTTACATGCAGTTTTTCCAAAAGAATTA |
| | | AATAATCGTGCATGTTTATTTTTCCCTCTCT |
| | | TCAGATCCTGTAAAATTTGAATGTATCTGTTTTAGATCAA |
| | | TTCGCCTATTTAGCTCTTTGTATATTATCT |
| | | CCTGGAGAGACAGCTAGGCAGCAAAAAAACAATCTATT |
| | | AAAATGAGAAAATAACGACCATAGGCAGTCTA |
| | | ATGTACGAACTTTAAATATTTTTAATTCAAGGTAAAATA |
| | | TATTAGTTTCACAAGATTTCTGGCTAATAG |
| | | GGAAATTATTATCTTCAGTCTTCATGAGTTGGGGGAAAT |
| | | GATAATGCTGACACTCTTAGTGCTCCTAAAG |
| | | TTTCCTTTTCTCCATTTATACATTTGGAATGTTGTGATTTA |
| | | TATTCATTTTGATTCCCTTTTCTCTAAAA |
| | | TTTCATCTTTTTGATTAAAAAATATGATACAGGCATACCT |
| | | CAGAGATATTGTGGGTTTGGCTCCATACCA |
| | | CAATAAAATGAATATTACAATAAAGCAAGTTGTAAGGAC |
| | | TTTTTGGTTTCTCACTGTATGTAAAAGTTAT |
| | | TTATATACTATACTGTAACATACTAAGTGTGCAATAGCA |
| | | TTGTGTCTAAAAAATATATACTTTAAAAATA |
| | | ATTTATTGTTAAAAAAATGCCAACAATTATCTGGGCCTTT |
| | | AGTGAGTGCTAATCTTTTTGCTGGTGGAGG |
| | | GTCGTGCTTCAGTATTGATCGCTGTGGACTGATCATGGTG |
| | | GTAGTTGCTGAAGGTTGCTGGGATGGCTGT |

| Name | NCBI Reference Sequence | Sequence |
|---|---|---|
| | | GTGTGTGGCAATTTCTTAAAATAAGACAACAGTGAAGTG |
| | | CTGTATCAATTGATTTTTCCATTCACAAAAG |
| | | ATTTCTCTGTAGCATGCAATGCTGTTTGATAGCATTTAAC |
| | | CCACAGCAGAATTTCTTTGAAAATTGGACT |
| | | CAGTCCTCTCAAACTGTGCTGCTGCTTTATCAACTAAGTT |
| | | TTTGTAATTTTCTGAATCCTTTGTTGTCAT |
| | | TTCAGCAGTTTACAGCATCTTCATTGGAAGTATATTCCAT |
| | | CTCAAACATTCTTTGTTCATCCATAAGAAG |
| | | CAACTTCTTATCAAGTTTTTTCATGACATTGCAGTAACTC |
| | | AGCCCCATCTTCAGGCTCTACTTCTAATTC |
| | | TGGTTCTCTTGCTACATCTCCCTCATCTGCAGTGACCTCT |
| | | CCACGGAAGTCTTGAACTCCTCAAAGTAAT |
| | | CCATGAGGGTTGGAATCAACTTCTAAACTCCTGTTAATG |
| | | TTGATATATTGACCCCCTCCCATGAATTATG |
| | | AATGTTCTTAATAACTTCTAAATGGTGATACCTTTCCAGA |
| | | AGGCTTTCAATGTACTTTGCCCGGATCCAT |
| | | CAGAAGACTATCTTGGCAGCTGTAGACTAACAATATATT |
| | | TCTTAAATGATAAGACTTGAAAGTCAAAAGT |
| | | ACTCCTTAATCCATAGGCTGCAGAATCAATGTTGTATTA |
| | | ACAGGCACGAAAACAGCATTAATCTTGTGCA |
| | | TCTCCATCGGAGCTCTTGGGTGACTAGGTGCCTTGAGCA |
| | | GTAATATTTTGAAAGGAGGTTTTGGTTTTGT |
| | | TTTTTGTTTTTTTTTTTGTTTTTTAGCAGTAAGTCTCAAC |
| | | ACTGGGCTTAAAATATTCAGTAAACTATG |
| | | TTGTAAAAAGATGTGTTATCATCCAGACTTTGTTGTTCCA |
| | | TTACTCTACACAAGCAGGGTACACTTAGCA |
| | | TAATTCTTAAGGGCCTTGGAATTTTCAGAATGGTAAATG |
| | | AGTATGGGCTTCAACTTAAAATCATCAACTG |
| | | CATTAGCCTGTAACAAGAGAGTCAGCCTGTCCTTTGAAG |
| | | CAAGGCATTGACTTCTATCTATGAAAGTCTT |
| | | AGATGGCACCTTGTTTCAATAGTAGGCTGTTTAGTACAG |
| | | CCACCTTCATCAGTGATCTTAGCTAGATCTT |
| | | CTGCATAACTTGCTGCAGCTTCTACATCAGCACTTGCTGC |
| | | CTCACCTTGTCCTTTTATGTTATAGAGACA |
| | | GCTGCGCTTCTTAAACTTTATAAACCAACTTCTGCTAGCT |
| | | TCCAACTTCTCTTCTGCAGCTTCCTCATTC |
| | | TCTTCATAGAACTGAAGGGAGTCAAGGCCTTGCTCTGGA |
| | | TTAAGCTTTGGCTTAAGGAATGTTGTGGCTG |
| | | ACGTGATCTTCTATCCAGACCACTAAAGCGCTCTCCATAT |
| | | CAGCAATAAGGCCGTTTTGCTTTCTTACCT |
| | | TTCATGTGTTCACTGGAGTAATTTCCTTCAAGAATTTTTC |
| | | CTTTACATTCACAACTTGGCTAACTGGCAT |
| | | GCAAGGCCTAGCTTTCAGCCTGTCTTGGCTTTTGACATGC |
| | | CTTCCTCACTTAGCTCGTCATATCTAGCTT |
| | | TTGATTTAAAGTGGCAGGCATACAACTCTTCCTTTCACTT |
| | | GAACACTTAGAGGCCACTGTAGGGTTATTA |
| | | ATTGGCCTAATTTCAATATTGTTGTGTTTTAGGGAATAGA |
| | | GAGGCCCAGGGAGAGGGAGAGAGCCCAAAC |
| | | GGCTGGTTGATAGAGCAGGCAGAATGCACACAACATTTA |
| | | TCAGATTATGTTTGCACCATTTACCAGATTA |
| | | TGGGTACGGTTTGTGGCACCCCCCAAAAATTAGAATAGT |
| | | AACATCAAAGATCACTGATCACAGATCGCCA |
| | | TAACATAAATAATAATAAACTTTAAAATACTGTGAGAAT |
| | | TACCAAAATGTGATACAGAGACATGAAGTGA |
| | | GCACATGCTGTTGAAAAAAATGACACTGATAGACATACT |
| | | TAACACGTGGGATTGCCACAAACCTTCAGTT |
| | | TGTAAAAGTCACAGTAACTGTGACTCACAAAAGAACAA |
| | | AGCACAATAAAACGAGGTATGCCTGTATTTTT |
| | | AAAAAAAGCTTTTTGTTAAAATTCAGGATATGTAATAGG |
| | | TCTGTAGGAATAGTGAAATATTTTTGCTGAT |
| | | GGATGTAGATATATACGTGGATAGAGATGAAGATCTTAA |
| | | TTATAGCTATGCAGCATAGATTTAGTCAAAG |
| | | ACATTTGAAAAGACAAATGTTAAATTAGTGTGGCTAATG |
| | | ACCTACCCGTGCCATGTTTTCCCTCTTGCAA |
| | | TGAGATACCCCACACTGTGTAGAAGGATGGAGGGAGGA |
| | | CTCCTACTGTCCCTCTTTGCGTGTGGTTATTA |
| | | AGTTGCCTCACTGGGCTAAAACACCACACATCTCATAGA |
| | | TAATATTTGGTAAGTTGTAATCGTCTTCACT |
| | | CTTCTCTTATCACCCACCCCTATCTTCCCACTTTTCCATCT |
| | | TTGTTGGTTTGCAACAGCCCCTTCTTTTT |
| | | GCCTGACTCTCCAGGATTTTCTCTCATCATAAATTGTTCT |
| | | AAAGTACATACTAATATGGGTCTGGATTGA |
| | | CTATTCTTATTTGCAAAACAGCAATTAAATGTTATAGGG |
| | | AAGTAGGAAGAAAAAGGGGTATCCTTGACAA |
| | | TAAACCAAGCAATATTCTGGGGGTGGGATAGAGCAGGA |

-continued

| Name | NCBI Reference Sequence | Sequence |
|---|---|---|
| | | AATTTTATTTTTAATCTTTTAAAATCCAAGTA<br>ATAGGTAGGCTTCCAGTTAGCTTTAAATGTTTTTTTTTC<br>CAGCTCAAAAAATTGGATTGTAGTTGATAC<br>TACATATAATACATTCTAATTCCCTCACTGTATTCTTTGT<br>TTAGTTTCATTTATTTGGTTTAAAATAATT<br>TTTTATCCCATATCTGAAATGTAATATATTTTTATCCAAC<br>AACCAGCATGTACATATACTTAATTATGTG<br>GCACATTTTCTAATAGATCAGTCCATCAATCTACTCATTT<br>TAAAGAAAAAAAAATTTTAAAGTCACTTTT<br>AGAGCCCTTAATGTGTAGTTGGGGGTTAAGCTTTGTGGA<br>TGTAGCCTTTATATTTAGTATAATTGAGGTC<br>TAAAATAATAATCTTCTATTATCTCAACAGAGCAAATTA<br>TTGAAAAAGATGAAGGTCCTTTTTATACCCA<br>TCTAGGAGCAGGTCCTAATGTGGCAGCTATTAGAGAAAT<br>CATGGAAGAAAGGTAATTAACGCAAAGGCAC<br>AGGGCAGATTAACGTTTATCCTTTTGTATATGTCAGAATT<br>TTTCCAGCCTTCACACACAAAGCAGTAAAC<br>AATTGTAAATTGAGTAATTATTAGTAGGCTTAGCTATTCT<br>AGGGTTGCCAACACTACACACTGTGCTATT<br>CACCAGAGAGTCACAATATTTGACAGGACTAATAGTCTG<br>CTAGCTGGCACAGGCTGCCCACTTTGCGATG<br>GATGCCAGAAAACCCAGGCATGAACAGGAATCGGCCAG<br>CCAGGCTGCCAGCCACAAGGTACTGGCACAGG<br>CTCCAACGAGAGGTCCCACTCTGGCTTTCCCACCTGATA<br>ATAAAGTGTCAAAGCAGAAAGACTGGTAAAG<br>TGTGGTATAAGAAAAGAACCACTGAATTAAATTCACCTA<br>GTGTTGCAAATGAGTACTTATCTCTAAGTTT<br>TCTTTTACCATAAAAAGAGAGCAAGTGTGATATGTTGAA<br>TAGAAAGAGAAACATACTATTTACAGCTGCC<br>TTTTTTTTTTTTTTTCGCTATCAATCACAGGTATACAAGTA<br>CTTGCCTTTACTCCTGCATGTAGAAGACT<br>CTTATGAGCGAGATAATGCAGAGAAGGCCTTTCATATAA<br>ATTTTATACAGCTCTGAGCTGTTCTTCTTCTA<br>GGGTGCCTTTTCATTAAGAGGTAGGCAGTATTATTATTA<br>AAGTACTTAGGATACATTGGGGCAGCTAGGA<br>CATATTCAGTATCATTCTTGCTCCATTTCCAAATTATTCA<br>TTTCTAAATTAGCATGTAGAAGTTCACTAA<br>ATAATCATCTAGTGGCCTGGCAGAAATAGTGAATTTCCC<br>TAAGTGCCTTTTTTTTGTTGTTTTTTGTTT<br>TGTTTTTTAAACAAGCAGTAGGTGGTGCTTTGGTCATAA<br>GGGAAGATATAGTCTATTTCTAGGACTATTC<br>CATATTTTCCATGTGGCTGGATACTAACTATTTGCCAGCC<br>TCCTTTTCTAAATTGTGAGACATTCTTGGA<br>GGAACAGTTCTAACTAAAATCTATTATGACTCCCCAAGT<br>TTTAAAATAGCTAAATTTAGTAAGGGAAAAA<br>ATAGTTTATGTTTTAGAAGACTGAACTTAGCAAACTAAC<br>CTGAATTTTGTGCTTTGTGAAATTTTATATC<br>GAAATGAGCTTTCCCATTTTCACCCACATGTAATTTACAA<br>AATAGTTCATTACAATTATCTGTACATTTT<br>GATATTGAGGAAAAACAAGGCTTAAAAACCATTATCCAG<br>TTTGCTTGGCGTAGACCTGTTTAAAAAATAA<br>TAAACCGTTCATTTCTCAGGATGTGGTCATAGAATAAAG<br>TTATGCTCAAATGTTCAAATATTTAAA |
| PREDICTED: Homo sapiens tet methylcytosine dioxygenase 2 (TET2), transcript variant X9, mRNA [SEQ ID NO: 955] | XM_011532044.1 | TCAGGCTCTACTTCTAATTCTGGTTCTCTTGCTACATCTC<br>CCTCATCTGCAGTGACCTCTCCACGGAAGT<br>CTTGAACTCCTCAAAAGCAAATTATTGAAAAAGATGAAG<br>GTCCTTTTTATACCCATCTAGGAGCAGGTCC<br>TAATGTGGCAGCTATTAGAGAAATCATGGAAGAAAGGTT<br>TGGACAGAAGGGTAAAGCTATTAGGATTGAA<br>AGAGTCATCTATACTGGTAAAGAAGGCAAAAGTTCTCAG<br>GGATGTCCTATTGCTAAGTGGGTGGTTCGCA<br>GAAGCAGCAGTGAAGAGAAGCTACTGTGTTTGGTGCGG<br>GAGCGAGCTGGCCACACCTGTGAGGCTGCAGT<br>GATTGTGATTCTCATCCTGGTGTGGGAAGGAATCCCGCT<br>GTCTCTGGCTGACAAACTCTACTCGGAGCTT<br>ACCGAGACGCTGAGGAAATACGGCACGCTCACCAATCG<br>CCGGTGTGCCTTGAATGAAGAGAGAACTTGCG<br>CCTGTCAGGGGCTGGATCCAGAAACCTGTGGTGCCTCCT<br>TCTCTTTTGGTTGTTCATGGAGCATGTACTA<br>CAATGGATGTAAGTTTGCCAGAAGCAAGATCCCAAGGA<br>AGTTAAGCTGCTTGGGGATGACCCAAAAGAG<br>GAAGAGAAACTGGAGTCTCATTTGCAAAACCTGTCCACT<br>CTTATGGCACCAACATATAAGAAACTTGCAC<br>CTGATGCATATAATAATCAGATTGAATATGAACACAGAG |

| Name | NCBI Reference Sequence | Sequence |
|---|---|---|
| | | CACCAGAGTGCCGTCTGGGTCTGAAGGAAGG |
| | | CCGTCCATTCTCAGGGGTCACTGCATGTTTGGACTTCTGT |
| | | GCTCATGCCCACAGAGACTTGCACAACATG |
| | | CAGAATGGCAGCACATTGGTATGCACTCTCACTAGAGAA |
| | | GACAATCGAGAATTTGGAGGAAAACCTGAGG |
| | | ATGAGCAGCTTCACGTTCTGCCTTTATACAAAGTCTCTGA |
| | | CGTGGATGAGTTTGGGAGTGTGGAAGCTCA |
| | | GGAGGAGAAAAAACGGAGTGGTGCCATTCAGGTACTGA |
| | | GTTCTTTTCGGCGAAAAGTCAGGATGTTAGCA |
| | | GAGCCAGTCAAGACTTGCCGACAAAGGAAACTAGAAGC |
| | | CAAGAAAGCTGCAGCTGAAAAGCTTTCCTCCC |
| | | TGGAGAACAGCTCAAATAAAAATGAAAAGGAAAAGTCA |
| | | GCCCCATCACGTACAAAACAAACTGAAAACGC |
| | | AAGCCAGGCTAAACAGTTGGCAGAACTTTTGCGACTTTC |
| | | AGGACCAGTCATGCAGCAGTCCCAGCAGCCC |
| | | CAGCCTCTACAGAAGCAGCCACCACAGCCCCAGCAGCA |
| | | GCAGAGACCCCAGCAGCAGCAGCCACATCACC |
| | | CTCAGACAGAGTCTGTCAACTCTTATTCTGCTTCTGGATC |
| | | CACCAATCCATACATGAGACGGCCCAATCC |
| | | AGTTAGTCCTTATCCAAACTCTTCACACACTTCAGATATC |
| | | TATGGAAGCACCAGCCCTATGAACTTCTAT |
| | | TCCACCTCATCTCAAGCTGCAGGTTCATATTTGAATTCTT |
| | | CTAATCCCATGAACCCTTACCCTGGGCTTT |
| | | TGAATCAGAATACCCAATATCCATCATATCAATGCAATG |
| | | GAAACCTATCAGTGGACAACTGCTCCCCATA |
| | | TCTGGGTTCCTATTCTCCCCAGTCTCAGCCGATGGATCTG |
| | | TATAGGTATCCAAGCCAAGACCCTCTGTCT |
| | | AAGCTCAGTCTACCACCCATCCATACACTTTACCAGCCA |
| | | AGGTTTGGAAATAGCCAGAGTTTTACATCTA |
| | | AATACTTAGGTTATGGAAACCAAAATATGCAGGGAGATG |
| | | GTTTCAGCAGTTGTACCATTAGACCAAATGT |
| | | ACATCATGTAGGGAAATTGCCTCCTTATCCCACTCATGA |
| | | GATGGATGGCCACTTCATGGGAGCCACCTCT |
| | | AGATTACCACCCAATCTGAGCAATCCAAACATGGACTAT |
| | | AAAAATGGTGAACATCATTCACCTTCTCACA |
| | | TAATCCATAACTACAGTGCAGCTCCGGGCATGTTCAACA |
| | | GCTCTCTTCATGCCCTGCATCTCCAAAACAA |
| | | GGAGAATGACATGCTTTCCCACACAGCTAATGGGTTATC |
| | | AAAGATGCTTCCAGCTCTTAACCATGATAGA |
| | | ACTGCTTGTGTCCAAGGAGGCTTACACAAATTAAGTGAT |
| | | GCTAATGGTCAGGAAAAGCAGCCATTGGCAC |
| | | TAGTCCAGGGTGTGGCTTCTGGTGCAGAGGACAACGATG |
| | | AGGTCTGGTCAGACAGCGAGCAGAGCTTTCT |
| | | GGATCCTGACATTGGGGGAGTGGCCGTGGCTCCAACTCA |
| | | TGGGTCAATTCTCATTGAGTGTGCAAAGCGT |
| | | GAGCTGCATGCCACAACCCCTTTAAAGAATCCCAATAGG |
| | | AATCACCCCACCAGGATCTCCCTCGTCTTTT |
| | | ACCAGCATAAGAGCATGAATGAGCCAAAACATGGCTTG |
| | | GCTCTTTGGGAAGCCAAAATGGCTGAAAAAGC |
| | | CCGTGAGAAAGAGGAAGAGTGTGAAAAGTATGGCCCAG |
| | | ACTATGTGCCTCAGAAATCCCATGGCAAAAAA |
| | | GTGAAACGGAGCCTGCTGAGCCACATGAAACTTCAGA |
| | | GCCCACTTACCTGCGTTTCATCAAGTCTCTTG |
| | | CCGAAAGGACCATGTCCGTGACCACAGACTCCACAGTAA |
| | | CTACATCTCCATATGCCTTCACTCGGGTCAC |
| | | AGGGCCTTACAACAGATATATATGATATCACCCCCTTTT |
| | | GTTGGTTACCTCACTTGAAAAGACCACAACC |
| | | AACCTGTCAGTAGTATAGTTCTCATGACGTGGGCAGTGG |
| | | GGAAAGGTCACAGTATTCATGACAAATGTGG |
| | | TGGGAAAAACCTCAGCTCACCAGCAACAAAAGAGGTTA |
| | | TCTTACCATAGCACTTAATTTTCACTGGCTCC |
| | | CAAGTGGTCACAGATGGCATCTAGGAAAAGACCAAAGC |
| | | ATTCTATGCAAAAGAAGGTGGGAAGAAAGT |
| | | GTTCCGCAATTTACATTTTTAAACACTGGTTCTATTATTG |
| | | GACGAGATGATATGTAAATGTGATCCCCCC |
| | | CCCCCGCTTACAACTCTACACATCTGTGACCACTTTTAAT |
| | | AATATCAAGTTTGCATAGTCATGGAACACA |
| | | AATCAAACAAGTACTGTAGTATTACAGTGACAGGAATCT |
| | | TAAAATACCATCTGGTGCTGAATATATGATG |
| | | TACTGAAATACTGGAATTATGGCTTTTTGAAATGCAGTTT |
| | | TTACTGTAATCTTAACTTTTATTTATCAAA |
| | | ATAGCTACAGGAAACATGAATAGCAGGAAAACACTGAA |
| | | TTTGTTTGGATGTTCTAAGAAATGGTGCTAAG |
| | | AAAATGGTGTCTTTAATAGCTAAAAATTTAATGCCTTTAT |
| | | ATCATCAAGATGCTATCAGTGTACTCCAGT |

| Name | NCBI Reference Sequence | Sequence |
|---|---|---|
| | | GCCCTTGAATAATAGGGGTACCTTTTCATTCAAGTTTTTA |
| | | TCATAATTACCTATTCTTACACAAGCTTAG |
| | | TTTTTAAAATGTGGACATTTTAAAGGCCTCTGGATTTTGC |
| | | TCATCCAGTGAAGTCCTTGTAGGACAATAA |
| | | ACGTATATATGTACATATATACACAAACATGTATATGTG |
| | | CACACACATGTATATGTATAAATATTTTAAA |
| | | TGGTGTTTTAGAAGCACTTTGTCTACCTAAGCTTTGACAA |
| | | CTTGAACAATGCTAAGGTACTGAGATGTTT |
| | | AAAAAACAAGTTTACTTTCATTTTAGAATGCAAAGTTGA |
| | | TTTTTTTAAGGAAACAAAGAAAGCTTTTAAA |
| | | ATATTTTTGCTTTTAGCCATGCATCTGCTGATGAGCAATT |
| | | GTGTCCATTTTTAACACAGCCAGTTAAATC |
| | | CACCATGGGGCTTACTGGATTCAAGGGAATACGTTAGTC |
| | | CACAAAACATGTTTTCTGGTGCTCATCTCAC |
| | | ATGCTATACTGTAAAACAGTTTTATACAAAATTGTATGA |
| | | CAAGTTCATTGCTCAAAAATGTACAGTTTTA |
| | | AGAATTTTCTATTAACTGCAGGTAATAATTAGCTGCATG |
| | | CTGCAGACTCAACAAAGCTAGTTCACTGAAG |
| | | CCTATGCTATTTTATGGATCATAGGCTCTTCAGAGAACTG |
| | | AATGGCAGTCTGCCTTTGTGTTGATAATTA |
| | | TGTACATTGTGACGTTGTCATTTCTTAGCTTAAGTGTCCT |
| | | CTTTAACAAGAGGATTGAGCAGACTGATGC |
| | | CTGCATAAGATGAATAAACAGGGTTAGTTCCATGTGAAT |
| | | CTGTCAGTTAAAAAGAAACAAAACAGGCAG |
| | | CTGGTTTGCTGTGGTGGTTTTAAATCATTAATTTGTATAA |
| | | AGAAGTGAAAGAGTTGTATAGTAAATTAAA |
| | | TTGTAAACAAAACTTTTTTAATGCAATGCTTTAGTATTTT |
| | | AGTACTGTAAAAAAATTAAATATATACATA |
| | | TATATATATATATATATATATATATATGAGTTTGAAGC |
| | | AGAATTCACATCATGATGGTGCTACTCAGC |
| | | CTGCTACAAATATATCATAATGTGAGCTAAGAATTCATT |
| | | AAATGTTTGAGTGATGTTCCTACTTGTCATA |
| | | TACCTCAACACTAGTTTGGCAATAGGATATTGAACTGAG |
| | | AGTGAAAGCATTGTGTACCATCATTTTTTTC |
| | | CAAGTCCTTTTTTTATTGTTAAAAAAAAAAGCATACCTT |
| | | TTTTCAATACTTGATTTCTTAGCAAGTATA |
| | | ACTTGAACTTCAACCTTTTTGTTCTAAAAATTCAGGGATA |
| | | TTTCAGCTCATGCTCTCCCTATGCCAACAT |
| | | GTCACCTGTGTTTATGTAAAATTGTTGTAGGTTAATAAAT |
| | | ATATTCTTTGTCAGGGATTTAACCCTTTTA |
| | | TTTTGAATCCCTTCTATTTTACTTGTACATGTGCTGATGT |
| | | AACTAAAACTAATTTTGTAAATCTGTTGGC |
| | | TCTTTTTATTGTAAAGAAAAGCATTTTAAAAGTTTGAGG |
| | | AATCTTTTGACTGTTTCAAGCAGGAAAAAAA |
| | | AATTACATGAAAATAGAATGCACTGAGTTGATAAAGGG |
| | | AAAAATTGTAAGGCAGGAGTTTGGCAAGTGGC |
| | | TGTTGGCCAGAGACTTACTTGTAACTCTCTAAATGAAGTT |
| | | TTTTTGATCCTGTAATCACTGAAGGTACAT |
| | | ACTCCATGTGGACTTCCCTTAAACAGGCAAACACCTACA |
| | | GGTATGGTGTGCAACAGATTGTACAATTACA |
| | | TTTTGGCCTAAATACATTTTTGCTTACTAGTATTTAAAAT |
| | | AAATTCTTAATCAGAGGAGGCCTTTGGGTT |
| | | TTATTGGTCAAATCTTTGTAAGCTGGCTTTTGTCTTTTTA |
| | | AAAAATTTCTTGAATTTGTGGTTGTGTCCA |
| | | ATTTGCAAACATTTCCAAAAATGTTTGCTTTGCTTACAAA |
| | | CCACATGATTTTAATGTTTTTTGTATACCA |
| | | TAATATCTAGCCCCAAACATTTGATTACTACATGTGCATT |
| | | GGTGATTTTGATCATCCATTCTTAATATTT |
| | | GATTTCTGTGTCACCTACTGTCATTTGTTAAACTGCTGGC |
| | | CAACAAGAACAGGAAGTATAGTTTGGGGGG |
| | | TTGGGGAGAGTTTACATAAGGAAGAGAAGAAATTGAGT |
| | | GGCATATTGTAAATATCAGATCTATAATTGTA |
| | | AATATAAAACCTGCCTCAGTTAGAATGAATGGAAAGCAG |
| | | ATCTACAATTTGCTAATATAGGAATATCAGG |
| | | TTGACTATATAGCCATACTTGAAAATGCTTCTGAGTGGT |
| | | GTCAACTTTACTTGAATGAATTTTTCATCTT |
| | | GATTGACGCACAGTGATGTACAGTTCACTTCTGAAGCTA |
| | | GTGGTTAACTTGTGTAGGAAACTTTTGCAGT |
| | | TTGACACTAAGATAACTTCTGTGTGCATTTTTCTATGCTT |
| | | TTTTAAAAACTAGTTTCATTTCATTTTCAT |
| | | GAGATGTTTGGTTTATAAGATCTGAGGATGGTTATAAAT |
| | | ACTGTAAGTATTGTAATGTTATGAATGCAGG |
| | | TTATTTGAAAGCTGTTTATTATTATATCATTCCTGATAAT |
| | | GCTATGTGAGTGTTTTTAATAAAATTTATA |
| | | TTTATTTAATGCACTCTAA |

| Name | NCBI Reference Sequence | Sequence |
|---|---|---|
| PREDICTED: *Homo sapiens* tet methylcytosine dioxygenase 2 (TET2), transcript variant X7, mRNA [SEQ ID NO: 956] | XM_011532043.1 | GTAGAGAAGCAGAAGGAAGCAAGATGGCTGCCCTTTAG GATTTGTTAGAAAGGAGACCCGACTGCAACTG CTGGATTGCTGCAAGGCTGAGGGACGAGAACGAGGCTG GCAAACATTCAGCAGCACACCCTCTCAAGATT GTTTACTTGCCTTTGCTCCTGTTGAGTTACAACGCTTGGA AGCAGGAGATGGGCTCAGCAGCAGCCAATA GGACATGATCCAGGAAGAGCAGTAAGGGACTGAGCTGC TGAATTCAACTAGAGGGCAGCCTTGTGGATGG CCCCGAAGCAAGCCTGATGGAACAGGATAGAACCAACC ATGTTGAGGGCAACAGACTAAGTCCATTCCTG ATACCATCACCTCCCATTTGCCAGACAGAACCTCTGGCT ACAAAGCTCCAGAATGGAAGCCCACTGCCTG AGAGAGCTCATCCAGAAGTAAATGGAGACACCAAGTGG CACTCTTTCAAAAGTTATTATGGAATACCCTG TATGAAGGGAAGCCAGAATAGTCGTGTGAGTCCTGACTT TACACAAGAAAGTAGAGGGTATTCCAAGTGT TTGCAAAATGGAGGAATAAAACGCACAGTTAGTGAACCT TCTCTCTCTGGGCTCCTTCAGATCAAGAAAT TGAAACAAGACCAAAAGGCTAATGGAGAAAGACGTAAC TTCGGGGTAAGCCAAGAAAGAAATCCAGGTGA AAGCAGTCAACCAAATGTCTCCGATTTGAGTGATAAGAA AGAATCTGTGAGTTCTGTAGCCCAAGAAAAT GCAGTTAAAGATTTCACCAGTTTTTCAACACATAACTGC AGTGGGCCTGAAAATCCAGAGCTTCAGATTC TGAATGAGCAGGAGGGGAAAAGTGCTAATTACCATGAC AAGAACATTGTATTACTTAAAAACAAGGCAGT GCTAATGCCTAATGGTGCTACAGTTTCTGCCTCTTCCGTG GAACACACACATGGTGAACTCCTGGAAAAA ACACTGTCTCAATATTATCCAGATTGTGTTTCCATTGCGG TGCAGAAAACCACATCTCACATAAATGCCA TTAACAGTCAGGCTACTAATGAGTTGTCCTGTGAGATCA CTCACCCATCGCATACCTCAGGGCAGATCAA TTCCGCACAGACCTCTAACTCTGAGCTGCCTCCAAAGCC AGCTGCAGTGGTGAGTGAGGCCTGTGATGCT GATGATGCTGATAATGCCAGTAAACTAGCTGCAATGCTA AATACCTGTTCCTTTCAGAAACCAGAACAAC TACAACAACAAAAATCAGTTTTTGAGATATGCCCATCTC CTGCAGAAAATAACATCCAGGGAACCACAAA GCTAGCGTCTGGTGAAGAATTCTGTTCAGGTTCCAGCAG CAATTTGCAAGCTCCTGGTGGCAGCTCTGAA CGGTATTTAAAACAAAATGAAATGAATGGTGCTTACTTC AAGCAAAGCTCAGTGTTCACTAAGGATTCCT TTTCTGCCACTACCACACCACCACCACCATCACAATTGCT TCTTTCTCCCCCTCCTCCTCTTCCACAGGT TCCTCAGCTTCCTTCAGAAGGAAAAAGCACTCTGAATGG TGGAGTTTTAGAAGAACACCACCACTACCCC AACCAAAGTAACACAACACTTTTAAGGGAAGTGAAAAT AGAGGGTAAACCTGAGGCACCACCTTCCCAGA GTCCTAATCCATCTACACATGTATGCAGCCCTTCTCCGAT GCTTTCTGAAAGGCCTCAGAATAATTGTGT GAACAGGAATGACATACAGACTGCAGGGACAATGACTG TTCCATTGTGTTCTGAGAAAACAAGACCAATG TCAGAACACCTCAAGCATAACCCACCAATTTTTGGTAGC AGTGGAGAGCTACAGGACAACTGCCAGCAGT TGATGAGAAACAAAGAGCAAGAGATTCTGAAGGGTCGA GACAAGGAGCAAACACGAGATCTTGTGCCCCC AACACAGCACTATCTGAAACCAGGATGGATTGAATTGAA GGCCCCTCGTTTTCACCAAGCGGAATCCCAT CTAAAACGTAATGAGGCATCACTGCCATCAATTCTTCAG TATCAACCCAATCTCTCCAATCAAATGACCT CCAAACAATACACTGGAAATTCCAACATGCCTGGGGGC TCCCAAGGCAAGCTTACACCCAGAAAACAAC ACAGCTGGAGCACAAGTCACAAATGTACCAAGTTGAAAT GAATCAAGGGCAGTCCCAAGGTACAGTGGAC CAACATCTCCAGTTCCAAAACCCTCACACCAGGTGCAC TTCTCCAAAACAGACCATTTACCAAAAGCTC ATGTGCAGTCACTGTGTGGCACTAGATTTCATTTTCAACA AAGAGCAGATTCCCAAACTGAAAAACTTAT GTCCCCAGTGTTGAAACAGCACTTGAATCAACAGGCTTC AGAGACTGAGCCATTTTCAAACTCACACCTT TTGCAACATAAGCCTCATAAACAGGCAGCACAAACACA ACCATCCCAGAGTTCACATCTCCCTCAAACC AGCAACAGCAGCAAAAATTACAAATAAAGAATAAAGAG GAAATACTCCAGACTTTTCCTCACCCCCAAAG |

-continued

| Name | NCBI Reference Sequence | Sequence |
|---|---|---|
| | | CAACAATGATCAGCAAAGAGAAGGATCATTCTTTGGCCA<br>GACTAAAGTGGAAGAATGTTTTCATGGTGAA<br>AATCAGTATTCAAAATCAAGCGAGTTCGAGACTCATAAT<br>GTCCAAATGGGACTGGAGGAAGTACAGAATA<br>TAAATCGTAGAAATTCCCCTTATAGTCAGACCATGAAAT<br>CAAGTGCATGCAAAATACAGGTTTCTTGTTC<br>AAACAATACACACCTAGTTTCAGAGAATAAAGAACAGA<br>CTACACATCCTGAACTTTTTGCAGGAAACAAG<br>ACCCAAAACTTGCATCACATGCAATATTTTCCAAATAAT<br>GTGATCCCAAAGCAAGATCTTCTTCACAGGT<br>GCTTTCAAGAACAGGAGCAGAAGTCACAACAAGCTTCA<br>GTTCTACAGGGATATAAAAATAGAAACCAAGA<br>TATGTCTGGTCAACAAGCTGCGCAACTTGCTCAGCAAAG<br>GTACTTGATACATAACCATGCAAATGTTTTT<br>CCTGTGCCTGACCAGGGAGGAAGTCACACTCAGACCCCT<br>CCCCAGAAGGACACTCAAAAGCATGCTGCTC<br>TAAGGTGGCATCTCTTACAGAAGCAAGAACAGCAGCAA<br>ACACAGCAACCCCAAACTGAGTCTTGCCATAG<br>TCAGATGCACAGGCCAATTAAGGTGGAACCTGGATGCAA<br>GCCACATGCCTGTATGCACACAGCACCACCA<br>GAAAACAAAACATGGAAAAAGGTAACTAAGCAAGAGAA<br>TCCACCTGCAAGCTGTGATAATGTGCAGCAAA<br>AGAGCATCATTGAGACCATGGAGCAGCATCTGAAGCAGT<br>TTCACGCCAAGTCGTTATTTGACCATAAGGC<br>TCTTACTCTCAAATCACAGAAGCAAGTAAAAGTTGAAAT<br>GTCAGGGCCAGTCACAGTTTTGACTAGACAA<br>ACCACTGCTGCAGAACTTGATAGCCACACCCCAGCTTTA<br>GAGCAGCAAACAACTTCTTCAGAAAAGACAC<br>CAACCAAAAGAACAGCTGCTTCTGTTCTCAATAATTTTAT<br>AGAGTCACCTTCCAAATTACTAGATACTCC<br>TATAAAAAATTTATTGGATACACCTGTCAAGACTCAATA<br>TGATTTCCCATCTTGCAGATGTGTAGAGCAA<br>ATTATTGAAAAGATGAAGGTCCTTTTTATACCCATCTA<br>GGAGCAGGTCCTAATGTGGCAGCTATTAGAG<br>AAATCATGGAAGAAAGGTATACAAGTACTTGCCTTTACT<br>CCTGCATGTAGAAGACTCTTATGAGCGAGAT<br>AATGCAGAGAAGGCCTTTCATATAAATTTATACAGCTCT<br>GAGCTGTTCTTCTTCTAGGGTGCCTTTTCAT<br>TAAGAGGTAGGCAGTATTATTATTAAAGTACTTAGGATA<br>CATTGGGGCAGCTAGGACATATTCAGTATCA<br>TTCTTGCTCCATTTCCAAATTATTCATTTCTAAATTAGCA<br>TGTAGAAGTTCACTAAATAATCATCTAGTG<br>GCCTGGCAGAAATAGTGAATTTCCCTAAGTGCCTTTTTTT<br>TGTTGTTTTTTGTTTTGTTTTTTAAACAA<br>GCAGTAGGTGGTGCTTTGGTCATAAGGGAAGATATAGTC<br>TATTTCTAGGACTATTCCATATTTTCCATGT<br>GGCTGGATACTAACTATTTGCCAGCCTCCTTTTCTAAATT<br>GTGAGACATTCTTGGAGGAACAGTTCTAAC<br>TAAAATCTATTATGACTCCCCAAGTTTTAAAATAGCTAA<br>ATTTAGTAAGGGAAAAAATAGTTTATGTTTT<br>AGAAGACTGAACTTAGCAAACTAACCTGAATTTTGTGCT<br>TTGTGAAATTTTATATCGAAATGAGCTTTCC<br>CATTTTCACCCACATGTAATTTACAAAATAGTTCATTACA<br>ATTATCTGTACATTTTGATATTGAGGAAAA<br>ACAAGGCTTAAAAACCATTATCCAGTTTGCTTGGCGTAG<br>ACCTGTTTAAAAAATAATAAACCGTTCATTT<br>CTCAGGATGTGGTCATAGAATAAAGTTATGCTCAAATGT<br>TCAAA |

The term "gene" or "gene sequence" is meant to refer to a genetic sequence, e.g., a nucleic acid sequence. The term "gene" is intended to encompass a complete gene sequence or a partial gene sequence. The term "gene" refers to a sequence that encodes a protein or polypeptide or a sequence that does not encode a protein or polypeptide, e.g., a regulatory sequence, leader sequence, signal sequence, intron, or other non-protein coding sequence. The term "intron" refers to nucleic acid sequence within a gene which is noncoding for the protein expressed from said gene. Intronic sequence may be transcribed from DNA into RNA, but may be removed before the protein is expressed.

The term "exon" refers to nucleic acid sequence within a gene which encodes a protein expressed from said gene.

The term "intron-exon junction," when used in connection with a gene editing system or gRNA molecule, refers to a sequence which includes nucleotides of an exon and nucleotides of an intron. In exemplary embodiments, an intron-exon junction is a gRNA target sequence, whereby, when recognized by a CRISPR system comprising a gRNA comprising a targeting domain complementary to the intron-exon junction target sequence, said CRISPR system modifies, e.g., produces a break, at or near the target sequence between two nucleotides of an intron. In other exemplary embodiments, an intron-exon junction is a gRNA target sequence, whereby, when recognized by a CRISPR system comprising a gRNA comprising a targeting domain complementary to the intron-exon junction target sequence, said CRISPR system modifies, e.g., produces a break, at or near the target sequence between two nucleotides of an exon. In other exemplary embodiments, an intron-exon junction is a gRNA target sequence, whereby, when recognized by a CRISPR system comprising a gRNA comprising a targeting domain complementary to the intron-exon junction target sequence, said CRISPR system modifies, e.g., produces a break, at or near the target sequence between a nucleotide of an exon and a nucleotide of an intron.

The term "a," "an," or "the" refers to one or to more than one of the grammatical object of the article. The term may mean "one," "one or more," "at least one," or "one or more than one." By way of example, "an element" means one element or more than one element. The term "or" means "and/or" unless otherwise stated. The term "including" or "containing" is not limiting.

The term "about" when referring to a measurable value such as an amount, a temporal duration, and the like, is meant to encompass variations of +20% or in some instances +10%, or in some instances +5%, or in some instances +1%, or in some instances +0.1% from the specified value, as such variations are appropriate to perform the disclosed methods.

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some aspects, the set of polypeptides are contiguous with each other. In some embodiments, the set of polypeptides include a dimerization switch that, upon the presence of a dimerization molecule, can couple the polypeptides to one another, e.g., can couple an antigen binding domain to an intracellular signaling domain. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 41BB (i.e., CD137), CD27 and/or CD28. In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

A CAR that comprises an antigen binding domain (e.g., a scFv, or TCR) that targets a specific tumor marker X, such as those described herein, is also referred to as XCAR. For example, a CAR that comprises an antigen binding domain that targets CD19 is referred to as CD19CAR. As another example, a CAR that comprises an antigen binding domain that targets BCMA is referred to as a BCMA CAR.

The term "signaling domain" refers to the functional portion derived from protein which acts by transmitting information within a cell to regulate cellular activity via defined signaling pathways, for example, by generating second messengers or functioning as effectors by responding to such messengers. In embodiments, a signaling domain refers to a variant or homolog, e.g., a functional variant or homolog, of a naturally occurring signaling domain, for example a signaling domain variant having at least about 90%, 95%, 96%, 97%, 98%, or 99% sequence identity to a naturally-occurring signaling domain.

The term "antibody," as used herein, refers to one or more proteins or polypeptide sequence derived from an immunoglobulin molecule which specifically binds an antigen. Antibodies can be polyclonal or monoclonal, multiple or single chain, functional fragments (e.g., Fab fragments or scFv), or intact immunoglobulins, and may be derived from natural sources or from recombinant sources. Antibodies can be, e.g., dimers or tetramers of immunoglobulin molecules. Antibodies can be from any species or chimeric, including human or humanized antibodies.

The term "antibody fragment" refers to at least one portion of an antibody, that retains the ability to specifically interact with (e.g., by binding, steric hindrance, stabilizing/destabilizing, spatial distribution) an epitope of an antigen. In some embodiments, the antibody fragment retains an affinity for the epitope of an antigen broadly comparable to that of the intact immunoglobulin. For example, the antibody fragment may retain 80%, 85%, 90%, 95%, 99%, or more of the affinity seen with the intact immunoglobulin, as measured, e.g., by ELISA, Biacore, or other suitable assays. Examples of antibody fragments include, but are not limited to, Fab, Fab', F(ab')2, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., directly or via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The portion of the CAR comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition comprises an antibody fragment. In a further aspect, the CAR comprises an antibody fragment that comprises a scFv. In another aspect, the CAR comprises a full antibody including the Fc region.

The portion of the CAR comprising a full antibody may be of any type (e.g., IgG, IgE, IgM, IgD, IgA and IgY), any class (e.g., IgG 1, IgG2, IgG 3, IgG4, IgA1 and IgA2) or any subclass. In some embodiments the Fc region is an IgG type constant region. In certain embodiments the Fc region of the full antibody includes an Fc region from IgG1, IgG2, IgG3, IgG4, IgA, IgA1, IgA2, IgM, IgE, IgD, and IgY, or a fragment thereof. In some embodiments the Fc region is an IgG1. The Fc region may be a native sequence Fc region, or a variant Fc region. In one embodiment, the Fc region is a human Fc region.

The portion of the CAR comprising an antibody or antibody fragment thereof may comprise the CDR sequences of an antibody coupled with human or other antibody framework sequences. The framework sequences may be the same or different from those in a starting antibody. The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), A1-Lazikani et al., (1997) JMB 273,927-948 ("Chothia" numbering scheme), or a combination thereof. As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments, as well as multispecific binding constructs. In an embodiment, an antibody molecule is a multispecific antibody molecule, e.g., it comprises a plurality of immunoglobulin variable domain sequences forming antigen-binding sites for different epitopes of antigens, when a first immunoglobulin variable domain sequence of the plurality has binding specificity for a first epitope and at least a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In other embodiments, a "binding domain" or "antibody molecule" encompasses multivalent antibody molecules, e.g., it comprises a plurality of immunoglobulin variable domain sequences forming two or more antigen binding sites for the same epitope of an antigen.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (K) and lambda (k) light chains refer to the two major antibody light chain isotypes.

The term "recombinant antibody" refers to an antibody which is generated using recombinant DNA technology, such as, for example, an antibody expressed by a bacteriophage or yeast expression system or in any other host cell. The term also includes an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The term also refers to any peptide bound by an antibody or antibody fragment thereof. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present disclosure includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies in prevention of the occurrence of cancer in the first place. The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival.

The term "autologous" refers to any material derived from the same individual into whom it is introduced.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically The term "xenogeneic" refers to a graft derived from an animal of a different species.

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not connote or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connote or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of a tumor antigen as described herein" includes, but is not limited to, a disease associated with expression of a tumor antigen as described herein or condition associated with cells which express a tumor antigen as described herein including, e.g., proliferative diseases such as a cancer or malignancy or a precancerous condition such as a myelodysplasia, a myelodysplastic syndrome or a preleukemia; or a noncancer-related indication associated with cells which express a tumor antigen as described herein. In one aspect, a cancer associated with expression of a tumor antigen as described herein is a hematological cancer. In one aspect, a cancer associated with expression of a tumor antigen as described herein is a solid cancer. Further diseases associated with expression of a tumor antigen described herein include, but not limited to, e.g., atypical and/or non-classical cancers, malignancies, precancerous conditions or proliferative diseases associated with expression of a tumor antigen as described herein. Non-cancer related indications associated with expression of a tumor antigen as described herein include, but are not limited to, e.g., autoimmune disease, (e.g., lupus), inflammatory disorders (allergy and asthma) and transplantation. In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment described herein by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the disclosure can be replaced with other amino acid residues from the same side chain family and the altered CAR can be tested using the functional assays described herein.

The term "stimulation," refers to a primary response induced by binding of a stimulatory molecule (e.g., a TCR/CD3 complex or CAR) with its cognate ligand (or tumor antigen in the case of a CAR) thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use includes, but is not limited to, those derived from CD3 zeta, common FcR gamma (FCERIG), Fc gamma RIIa, FcR beta (Fc Epsilon R1b), CD3 gamma, CD3 delta, CD3 epsilon, CD79a, CD79b, DAP10, and DAP12. In a specific CAR embodiment, the intracellular signaling domain in any one or more CARS of the disclosure comprises an intracellular signaling sequence, e.g., a primary signaling sequence of CD3-zeta. In a specific CAR of the disclosure, the primary signaling sequence of CD3-zeta is the sequence provided as SEQ ID NO:21, or the equivalent residues from a non-human species, e.g., mouse, rodent, monkey, ape and the like. In a specific CAR of the disclosure, the primary signaling sequence of CD3-zeta is the sequence as provided in SEQ ID NO: 24, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion derived from a molecule, e.g., a stimulatory or costimulatory molecule. The intracellular signaling domain generates a signal that promotes an immune effector function of the CAR containing cell, e.g., a CART cell. Examples of immune effector function, e.g., in a CART cell, include cytolytic activity and helper activity, including the secretion of cytokines.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO: 21. In one aspect, the "zeta stimulatory domain" or a "CD3-zeta stimulatory domain" is the sequence provided as SEQ ID NO: 24.

The term "costimulatory molecule" refers to a cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are contribute to an efficient immune response. Costimulatory molecules include, but are not limited to an MHC class I molecule, BTLA and a Toll ligand receptor, as well as OX40, CD27, CD28, CDS, ICAM-1, LFA-1 (CD11a/CD18), ICOS (CD278), and 4-1BB (CD137). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Lyl08), SLAM (SLAMFi, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CDS, CD7, CD287, LIGHT, NKG2C, NKG2D, SLAMF7, NKp80, NKp30, NKp44, NKp46, CD160, B7-H3, and a ligand that specifically binds with CD83, and the like.

The intracellular signaling domain can comprise the entire intracellular portion, or the entire native intracellular signaling domain, of the molecule from which it is derived, or a functional fragment or derivative thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO: 16 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which one or more, e.g., all six, complementary-determining regions (CDRs) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences as long as the same antigen specificity is retained. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. The promoter or regulatory sequence may be a cis-acting element or a trans-acting element. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

A "constitutive" promoter refers to a nucleotide sequence which, when operably linked with a polynucleotide which encodes or specifies a gene product, causes the gene product to be produced in a cell under most or all physiological conditions of the cell.

An "inducible" promoter refers to a nucleotide sequence which, when operably linked with a polynucleotide which encodes or specifies a gene product, causes the gene product to be produced in a cell substantially only when an inducer which corresponds to the promoter is present in the cell.

A "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen" or "tumor antigen" interchangeably refers to a molecule (typically a protein, carbohydrate or lipid) that is expressed on the surface of a cancer cell, either entirely or as a fragment (e.g., MHC or peptide fragment), and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a tumor antigen is a cell surface molecule that is underexpressed in a cancer cell in comparison to a normal cell, for instance, 1-fold underexpression, 2-fold underexpression, 3-fold underexpression or more in comparison to a normal cell. In some embodiments, a tumor antigen is a cell surface molecule that is inappropriately synthesized in the cancer cell, for instance, a molecule that contains deletions, additions or mutations in comparison to the molecule expressed on a normal cell.

In some embodiments, a tumor antigen will be expressed exclusively on the cell surface of a cancer cell, entirely or as a fragment (e.g., MHC or peptide fragment), and not synthesized or expressed on the surface of a normal cell. In some embodiments, the CARs of the present disclosure includes CARs comprising an antigen binding domain (e.g., antibody or antibody fragment) that binds to a tumor antigen or fragment, e.g., a MHC presented peptide.

Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "tumor-supporting antigen" or "cancer-supporting antigen" interchangeably refer to a molecule (typically a protein, carbohydrate or lipid) that is expressed on the surface of a cell that is, itself, not cancerous, but supports the cancer cells, e.g., by promoting their growth or survival e.g., resistance to immune cells. Exemplary cells of this type include stromal cells and myeloid-derived suppressor cells (MDSCs). The tumor-supporting antigen itself need not play a role in supporting the tumor cells so long as the antigen is present on a cell that supports cancer cells.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)n, where n is a positive integer equal to or greater than 1. For example, n=1, n=2, n=3. n=4, n=5 and n=6, n=7, n=8, n=9 and n=10 (SEQ ID NO: 32). In one embodiment, the flexible polypeptide linkers include, but are not limited to, (Gly4 Ser)4 (SEQ ID NO: 34) or (Gly4 Ser)3 (SEQ ID NO: 35). In another embodiment, the linkers include multiple repeats of (Gly2Ser), (GlySer) or (Gly3Ser) (SEQ ID NO: 36). Also included within the scope of the disclosure are linkers described in WO2012/138475, incorporated herein by reference).

As used herein in connection with a messenger RNA (mRNA), a 5' cap (also termed an RNA cap, an RNA 7-methylguanosine cap or an RNA m7G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 10517), preferably greater than 64, more preferably greater than 100, most preferably greater than 300 or 400. Poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase.

In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

As used herein, the terms "treat", "treatment" and "treating" refer to a partial or complete reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the disclosure). In specific embodiments, the terms "treat", "treatment" and "treating" refer to the amelioration of at least one measurable physical parameter of a proliferative disorder, such as growth of a tumor, as well as parameters not necessarily discernible by the patient. In other embodiments the terms "treat", "treatment" and "treating"-refer to the inhibition of the progression of a proliferative disorder, such as stabilization of a tumor size, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

A "signal transduction pathway" refers to the biochemical relationship between two or more signal transduction molecules that play a role in the transmission of a signal from one portion of a cell to another portion of the cell or to another cell. The phrase "cell surface receptor" includes molecules and complexes of molecules capable of receiving a signal and transmitting signal across the membrane of a cell.

A "subject" is intended to include living organisms in which an immune response can be elicited (e.g., a mammal such as a human).

A "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

A "therapeutic" as used herein means a treatment. A therapeutic effect is obtained by partial or complete reduction, suppression, remission, or eradication of a disease state or symptom.

The term "prophylaxis" as used herein means the partial or complete prevention of or protective treatment for a disease or disease state.

In the context of the present disclosure, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present disclosure are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to a molecule that preferentially recognizes and binds a binding partner (e.g., a protein or nucleic acid) over other molecules present in a sample.

"Membrane anchor" or "membrane tethering domain", as that term is used herein, refers to a polypeptide or moiety, e.g., a myristoyl group, sufficient to anchor an extracellular or intracellular domain to the plasma membrane.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive T cells and/or an increase in the number of PD-1 negative T cells, or an increase in the ratio of PD-1 negative T cells/PD-1 positive T cells. In an embodiment, the low, immune enhancing, dose of mTOR inhibitor results in an increase in the number of naive T cells. In an embodiment, the low, immune enhancing, dose of mTOR inhibitor results in one or more of the following:

- an increase in the expression of one or more of the following markers: CD62Lhigh, CD127high, CD27+, and BCL2, e.g., on memory T cells, e.g., memory T cell precursors;
- a decrease in the expression of KLRG1, e.g., on memory T cells, e.g., memory T cell precursors; and
- an increase in the number of memory T cell precursors, e.g., cells with any one or combination of the following characteristics: increased CD62Lhigh, increased CD127high, increased CD27+, decreased KLRG1, and increased BCL2;
- wherein any of the changes described above occurs, e.g., at least transiently, e.g., as compared to a non-treated subject.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" as used herein refers to the return of a disease (e.g., cancer) or the signs and symptoms of a disease such as cancer after a period of improvement, e.g., after prior treatment of a therapy, e.g., cancer therapy.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range. All specified ranges also include the endpoints unless otherwise stated.

DETAILED DESCRIPTION

The gRNA molecules, compositions and methods described herein relate to genome editing, for example, gene editing in eukaryotic cells, in particular at a tet gene intron or intron-exon junction, for example at a TET2 intron or intron-exon junction, for example, using a CRISPR/Cas system, e.g., a Cas9 system, e.g., described herein. In particular embodiments, the gRNA molecules, compositions and methods described herein provide for the targeting of a CRISPR system to a target sequence of an intron, or intron-exon junction of a tet gene, for example a tet2 gene. In further aspects, the disclosure provides for modification (e.g., insertion or deletion) of a target sequence of an intron or intron-exon junction of a tet gene, for example, a tet2 gene. In further aspects, the disclosure provides for insertion of a nucleic acid sequence encoding a heterologous protein, for example a CAR molecule, for example as described herein, at or near the target sequence bound by a gene editing system, e.g., bound by a gRNA molecule described herein, e.g., at an intron, or intron-exon junction, of a tet gene, for example a tet2 gene. Such nucleic acid sequence encoding a heterologous protein may be separately introduced into the cell as a template nucleic acid as described herein, for example, including homology arms, or as part of a vector, or introduced at the same time as the gene editing system.

Missense, nonsense, and frameshift mutations (i.e., loss-of-function mutations) in the TET2 gene are associated with various cancers, e.g., hematological cancers. See, e.g., Pan et al., IUBMB Life 67(6): 438-45 (June 2015). Nevertheless, without being bound by theory, the disclosure is based in part on the finding that a CAR gene insertion into the TET2 gene, and in particular into an intron of the TET2 gene, for example the intron between exon 9 and exon 10, results in a CAR-expressing T cell with improved properties. For instance, in some embodiments, a CART cell comprising a CAR gene inserted into one or more copies of the TET2 gene, e.g., an intron of the TET2 gene, is capable of disrupting the expression and/or function of TET2. In some embodiments, the resulting CART cell with TET2 loss-of-function surprisingly is capable of avoiding uncontrolled proliferation and useful in the treatment of cancer, e.g., hematological cancers.

Without being bound by theory, the insertion of a CAR gene into one or more alleles of the TET2 gene, e.g., an intron of the TET2 gene, may be capable of producing a truncated and/or dominant negative form of TET2 that is capable of partially or fully disrupting full-length form(s) of TET2.

The disclosure is further based in part on the discovery that partial (but not full) inhibition of the function and/or expression of TET2 may be beneficial to immune effector cell function. In some embodiments, a CAR gene insertion into the TET2 gene, e.g., an intron of the TET2 gene, disrupts one allele of the TET2 gene and results in partial inhibition of the function and/or expression of TET2. In some embodiments, a CAR gene insertion into the TET2 gene, e.g., an intron of the TET2 gene, disrupts both alleles of the TET2 gene and results in full inhibition of the function and/or expression of TET2. The disclosure is also based in part on the recognition of the need for targeted insertion of nucleic acid encoding a heterologous protein, for example a CAR molecule, for example as described herein, into the genome of a cell, for example an immune effector cell, for example specifically at an intron of a tet gene, e.g., at in intron of a TET2 gene, e.g., at the intron between exon 9 and exon 10 of TET2. Thus, in an aspect, the disclosure provides gene editing systems, gRNA molecules, CRISPR systems and methods useful for insertion of nucleic acid sequence encoding a heterologous protein, for example a CAR molecule, for example as described herein, within an intron of the TET2 gene of a cell, for example an immune effector cell, for example as described herein.

The disclosure is further based in part on the discovery that targeting an intron, e.g., the intron between exon 9 and exon 10 of TET2, may provide a number of advantages. First, for example, the disclosure provides gRNAs that are able to create indels, including 1- or 2-nucleotide deletion indels, at or near target sequences with surprisingly high frequencies, and in particular, combining CRISPR systems comprising these gRNA molecules with a template nucleic acid, e.g., a template nucleic acid encoding a CAR (e.g., as described herein), results in unexpectedly and surprisingly high frequencies of incorporation of sequence of the template nucleic acid at or near the site targeted by the gRNA molecule. These indels and insertions (e.g., insertions of sequence of the template nucleic acid), when created within an exon, can lead to a frameshift mutation and thus significant (e.g., total) inhibition of expression of the protein encoded by the gene. Because of the high frequency of indel formation by these gRNAs, such frameshifts can occur at both alleles of the gene in a high percentage of the cells. Without being bound by theory, targeting an intron sequence with a CRISPR system as disclosed herein, particularly as a site for insertion of nucleic acid encoding a heterologous protein (e.g., sequence of a template nucleic acid), may therefore be beneficial where reduced, but not eliminated, function and/or expression of the target gene is desired because, for example, indels of less than 50 nt, 100 nt, or 150 nt in an intronic region, even if occurring at both alleles of the gene, are not expected to disrupt expression of the functional protein. Because insertion may be a relatively low-frequency event, insertion of the nucleic acid encoding the heterologous protein (e.g., CAR molecule as described herein) may occur in most cells at only one allele of the gene targeted by the CRISPR system. In some embodiments, targeting an intron with a CRISPR system allows for targeted insertion of nucleic acid encoding a heterologous sequence (e.g., CAR molecule, e.g., as described herein) while preserving at least a portion of the expression and/or function of the gene, for example, through the allele which does not comprise the inserted nucleic acid sequence. In alternate embodiments, for example, using the gRNA molecules described herein which result in a surprisingly high rate of incorporation of sequence of the template nucleic acid, targeting an intron with a CRISPR system (e.g., as described herein) allows for targeted insertion of nucleic acid encoding a heterologous sequence (e.g., CAR molecule, e.g., as described herein) while disrupting the expression and/or function of both alleles of the gene. In an aspect, the cell is an immune effector cell, e.g., an NK cell or T cell. In an aspect, the cell is an autologous cell.

Thus, in an aspect, the disclosure provides a cell, e.g., an immune effector cell, e.g., an immune effector cell comprising a CAR molecule, comprising an indel at or near a target sequence within an intron of a Tet gene, for example within an intron of a Tet2 gene. In an aspect, the disclosure provides a cell, e.g., an immune effector cell, e.g., an immune effector cell comprising a CAR molecule, comprising an indel at or near a target sequence complementary to the targeting domain of a gRNA molecule to a Tet intron sequence, e.g., a Tet2 intron sequence, e.g., complementary to the targeting domain of a gRNA molecule described herein. In an aspect, the disclosure provides a cell, e.g., an immune effector cell, e.g., an immune effector cell comprising a CAR molecule, comprising nucleic acid sequence encoding a heterologous protein (e.g., a CAR molecule, e.g., described herein) integrated into the genome of said cell at or near a target sequence complementary to the targeting domain of a gRNA molecule to a Tet intron sequence, e.g., Tet2 intron sequence, or intron-exon junction sequence, e.g., complementary to the targeting domain of a gRNA molecule described herein. The disclosure further provides methods and compositions useful in connection with said cells In any of the aforementioned aspects and embodiments the cell is an autologous cell. Alternatively, In any of the aforementioned aspects and embodiments, the cell is an allogeneic cell. Examples of allogenic cells include those in which expression and/or function of a T cell receptor chain, for example, TRAC or TRBC, has been reduced or eliminated, for example using a genome editing system (e.g., CRISPR system) targeted to said gene. The cell may further comprise reduced or eliminated expression of one or more additional genes, for example, B2M and/or CIITA. In any of the aforementioned embodiments and aspects, the cell is or will be engineered to express a chimeric antigen receptor (CAR), e.g., as described herein. In any of the aforementioned aspects and embodiments, the cell is a T cell.

Additional features of the gene editing systems, gRNA molecules, the CRISPR systems, Cas9 molecules, cells, CAR molecules, methods and other aspects of the disclosure are described in detail below.

Gene Editing Systems

In an aspect, the disclosure provides gene editing systems which target a TET, e.g., TET2, intron sequence, e.g., a sequence selected from the sequences listed in Table 3. Various gene editing systems are described more fully below.

In some embodiments, the disclosure provides gene editing systems comprising a template nucleic acid encoding a CAR and capable of integrating a CAR nucleic acid sequence such that CAR is expressed and/or TET, e.g., TET2, is disrupted. In some embodiments, the TET, e.g., TET2, is partially disrupted. In some embodiments, the TET, e.g., TET2, is fully disrupted. In some embodiments, only one allele of TET, e.g., TET2, is modified. In some embodiments, both alleles of TET, e.g., TET2, are modified.

TALEN Gene Editing Systems

TALENs are produced artificially by fusing a TAL effector DNA binding domain to a DNA cleavage domain. Transcription activator-like effects (TALEs) can be engineered to bind any desired DNA sequence, including a sequence of a TET2 intron, e.g., a sequence within a sequence of Table 3. By combining an engineered TALE with a DNA cleavage domain, a restriction enzyme can be produced which is specific to any desired DNA sequence, including a TET2 intron. These can then be introduced into a cell, wherein they can be used for genome editing. Boch (2011) Nature Biotech. 29: 135-6; and Boch et al. (2009) Science 326: 1509-12; Moscou et al. (2009) Science 326: 3501.

TALEs are proteins secreted by *Xanthomonas* bacteria. The DNA binding domain contains a repeated, highly conserved 33-34 amino acid sequence, with the exception of the 12th and 13th amino acids. These two positions are highly variable, showing a strong correlation with specific nucleotide recognition. They can thus be engineered to bind to a desired DNA sequence.

To produce a TALEN, a TALE protein is fused to a nuclease (N), which is, for example, a wild-type or mutated FokI endonuclease. Several mutations to FokI have been made for its use in TALENs; these, for example, improve cleavage specificity or activity. Cermak et al. (2011) Nucl. Acids Res. 39: e82; Miller et al. (2011) Nature Biotech. 29: 143-8; Hockemeyer et al. (2011) Nature Biotech. 29: 731-734; Wood et al. (2011) Science 333: 307; Doyon et al. (2010) Nature Methods 8: 74-79; Szczepek et al. (2007) Nature Biotech. 25: 786-793; and Guo et al. (2010) J. Mol. Biol. 200: 96.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity. Miller et al. (2011) Nature Biotech. 29: 143-8.

A TALEN to a TET2 intron sequence, e.g., a sequence listed in Table 3, can be used inside a cell to produce a double-stranded break (DSB). A mutation can be introduced at the break site if the repair mechanisms improperly repair the break via non-homologous end joining. For example, improper repair may introduce a frame shift mutation. Alternatively, template nucleic acid, e.g., as described herein, can be introduced into the cell along with the TALEN, e.g., template nucleic acid encoding a CAR, e.g., as described herein; depending on the sequences of the template nucleic acid and chromosomal sequence, this process can be used to integrate heterologous nucleic acid sequence, e.g., sequence encoding the CAR, e.g., as described herein, at or near the site targeted by the TALEN. Without being bound by theory, such integration may lead to the expression of the CAR as well as disruption, e.g., partial disruption, e.g., disruption of one or more functions, e.g., disruption of only one allele of, TET2. In some embodiments, both alleles of TET, e.g., TET2, are disrupted.

TALENs specific to sequences in TET2 introns, can be constructed using any method known in the art, including various schemes using modular components. Zhang et al. (2011) *Nature Biotech.* 29: 149-53; Geibler et al. (2011) *PLoS ONE* 6: e19509; U.S. Pat. Nos. 8,420,782; 8,470,973, the contents of which are hereby incorporated by reference in their entirety.

Zinc Finger Nuclease ("ZFN") Gene Editing Systems to a TET2 Intron

"ZFN" or "zinc finger nuclease" refers to an artificial nuclease which can be used to modify, e.g., delete one or more nucleic acids of, a desired nucleic acid sequence, e.g., a TET2 intron, e.g., a sequence listed in Table 3. Mutant and variant ZFNs are also encompassed.

Like a TALEN, a ZFN comprises a FokI nuclease domain (or derivative thereof) fused to a DNA-binding domain. In the case of a ZFN, the DNA-binding domain comprises one or more zinc fingers. Carroll et al. (2011) *Genetics Society of America* 188: 773-782; and Kim et al. (1996) *Proc. Natl. Acad. Sci. USA* 93: 1156-1160.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart. Bitinaite et al. (1998) *Proc. Natl. Acad. Sci. USA* 95: 10570-5.

Also like a TALEN, a ZFN can create a double-stranded break in the DNA, which can create a frame-shift mutation if improperly repaired, leading to a decrease in the expression and/or function, e.g., one or more functions, of TET2, e.g., from one allele, in a cell. ZFNs can also be used with homologous recombination to mutate the TET2 intron, or to introduce nucleic acid, e.g., encoding a CAR, at or near a site of the target sequence. As discussed above, the nucleic acid encoding a CAR may be introduced as part of a template nucleic acid. In embodiments, the template nucleic acid further comprises homology arms 5' to, 3' to, or both 5' and 3' to the nucleic acid of the template nucleic acid which encodes the molecule or molecules of interest (e.g., which encodes a CAR described herein), wherein said homology arms are complementary to genomic DNA sequence flanking the target sequence.

ZFNs specific to sequences in a TET2 intron, e.g., a sequence of Table 3, can be constructed using any method known in the art. See, e.g., Provasi (2011) Nature Med. 18: 807-815; Torikai (2013) Blood 122: 1341-1349; Cathomen et al. (2008) *Mol. Ther.* 16: 1200-7; and Guo et al. (2010) *J. Mol. Biol.* 400: 96; U.S. Patent Publication 2011/0158957; and U.S. Patent Publication 2012/0060230, the contents of which are hereby incorporated by reference in their entirety. In embodiments, The ZFN gene editing system may also comprise nucleic acid encoding one or more components of the ZFN gene editing system, e.g., a ZFN gene editing system targeted to a TET2 intron, e.g., a sequence listed in Table 3.

In a preferred aspect, the gene editing system is a CRISPR system. Additional features of the gRNA molecules, the CRISPR systems, Cas9 molecules, cells, CAR molecules, methods and other aspects of the disclosure are described in detail below.

I. gRNA Molecules

A gRNA molecule may have a number of domains, as described more fully below; however, a gRNA molecule typically comprises at least a crRNA domain (comprising a targeting domain) and a tracr. In embodiments, the crRNA and the tracr are provided on a single contiguous polynucleotide molecule. In other embodiments, the crRNA and the tracr are provided on separate polynucleotide molecules, which are themselves capable of association, e.g., through non-covalent hybridization. The gRNA molecules, used as a component of a CRISPR system, are useful for modifying (e.g., modifying the sequence) DNA at or near a target site. Such modifications include deletions and or insertions that result in, for example, reduced or eliminated expression of a functional product of the gene comprising the target site. Such modifications can also include insertion of heterologous nucleic acid sequence, for example, nucleic acid sequence encoding a heterologous protein (e.g., a CAR molecule, e.g., as described herein), that may be provided to said cell as a template nucleic acid, as described herein. In some embodiments, the inserted heterologous nucleic acid also serves to eliminate expression of the functional product of the gene comprising the target site. In some embodiments, a separate gRNA molecule and CRISPR system are used to eliminate expression of the functional product of the gene comprising the target site before, at the same time as, or after the insertion of the heterologous nucleic acid. These uses, and others, are described more fully below.

In an embodiment, a unimolecular, or sgRNA comprises, preferably from 5' to 3': a crRNA (which comprises a targeting domain complementary to a target sequence and a region that forms part of a flagpole (i.e., a crRNA flagpole region)); a loop; and a tracr (which comprises a domain complementary to the crRNA flagpole region, and a domain which additionally binds a nuclease or other effector molecule, e.g., a Cas molecule, e.g., a Cas9 molecule), and may take the following format (from 5' to 3'):

[targeting domain]-[crRNA flagpole region]-[optional first flagpole extension]-[loop]-[optional first tracr extension]-[tracr flagpole region]-[tracr nuclease binding domain].

In embodiments, the tracr nuclease binding domain binds to a Cas protein, e.g., a Cas9 protein.

In an embodiment, a bimolecular, or dgRNA comprises two polynucleotides; the first, preferably from 5' to 3': a crRNA (which contains a targeting domain complementary to a target sequence and a region that forms part of a flagpole; and the second, preferably from 5' to 3': a tracr (which contains a domain complementary to the crRNA flagpole region, and a domain which additionally binds a nuclease or other effector molecule, e.g., a Cas molecule, e.g., Cas9 molecule), and may take the following format (from 5' to 3'):

Polynucleotide 1 (crRNA): [targeting domain]-[crRNA flagpole region]-[optional first flagpole extension]-[optional second flagpole extension]

Polynucleotide 2 (tracr): [optional first tracr extension]-[tracr flagpole region]-[tracr nuclease binding domain]

In embodiments, the tracr nuclease binding domain binds to a Cas protein, e.g., a Cas9 protein.

In some aspects, the targeting domain comprises or consists of a targeting domain sequence described herein, e.g., a targeting domain described in Table 1 or, preferably, a targeting domain described in Table 2, or a targeting domain comprising or consisting of 17, 18, 19, or 20 (preferably 20) consecutive nucleotides of a targeting domain sequence described in Table 1, or Table 2.

In some aspects, the flagpole, e.g., the crRNA flagpole region, comprises, from 5' to 3': GUUUUAGAGCUA (SEQ ID NO: 50).

In some aspects, the flagpole, e.g., the crRNA flagpole region, comprises, from 5' to 3': GUUUAAGAGCUA (SEQ ID NO: 51).

In some aspects the loop comprises, from 5' to 3': GAAA (SEQ ID NO: 52).

In some aspects the tracr comprises, from 5' to 3': UAGCAAGUUAAAAUAAGGCUAGUCCGUUAU-CAACUUGAAAAAGUGGCACCGAG UCGGUGC (SEQ ID NO: 53) and is preferably used in a gRNA molecule comprising SEQ ID NO: 50.

In some aspects the tracr comprises, from 5' to 3': UAGCAAGUUUAAAUAAGGCUAGUCCGUUAU-CAACUUGAAAAAGUGGCACCGAG UCGGUGC (SEQ ID NO: 54) and is preferably used in a gRNA molecule comprising SEQ ID NO: 51.

In some aspects, the gRNA may also comprise, at the 3' end, additional U nucleic acids. For example the gRNA may comprise an additional 1, 2, 3, 4, 5, 6, 7, 8, 9, or 10 U nucleic acids at the 3' end (SEQ ID NO: 58). In an embodiment, the gRNA comprises an additional 4 U nucleic acids at the 3' end. In the case of dgRNA, one or more of the polynucleotides of the dgRNA (e.g., the polynucleotide comprising the targeting domain and the polynucleotide comprising the tracr) may comprise, at the 3' end, additional U nucleic acids. For example, the case of dgRNA, one or more of the polynucleotides of the dgRNA (e.g., the polynucleotide comprising the targeting domain and the polynucleotide comprising the tracr) may comprise an additional 1, 2, 3, 4, 5, 6, 7, 8, 9, or 10 U nucleic acids at the 3' end (SEQ ID NO: 58). In an embodiment, in the case of dgRNA, one or more of the polynucleotides of the dgRNA (e.g., the polynucleotide comprising the targeting domain and the polynucleotide comprising the tracr) comprises an additional 4 U nucleic acids at the 3' end. In an embodiment of a dgRNA, only the polynucleotide comprising the tracr comprises the additional U nucleic acid(s), e.g., 4 U nucleic acids. In an embodiment of a dgRNA, only the polynucleotide comprising the targeting domain comprises the additional U nucleic acid(s). In an embodiment of a dgRNA, both the polynucleotide comprising the targeting domain and the polynucleotide comprising the tracr comprise the additional U nucleic acids, e.g., 4 U nucleic acids.

In some aspects, the gRNA may also comprise, at the 3' end, additional A nucleic acids. For example the gRNA may comprise an additional 1, 2, 3, 4, 5, 6, 7, 8, 9, or 10 A nucleic acids at the 3' end (SEQ ID NO: 59). In an embodiment, the gRNA comprises an additional 4 A nucleic acids at the 3' end. In the case of dgRNA, one or more of the polynucleotides of the dgRNA (e.g., the polynucleotide comprising the targeting domain and the polynucleotide comprising the tracr) may comprise, at the 3' end, additional A nucleic acids. For example, the case of dgRNA, one or more of the polynucleotides of the dgRNA (e.g., the polynucleotide comprising the targeting domain and the polynucleotide comprising the tracr) may comprise an additional 1, 2, 3, 4, 5, 6, 7, 8, 9, or 10 A nucleic acids at the 3' end (SEQ ID NO: 59). In an embodiment, in the case of dgRNA, one or more of the polynucleotides of the dgRNA (e.g., the polynucleotide comprising the targeting domain and the polynucleotide comprising the tracr) comprises an additional 4 A nucleic acids at the 3' end. In an embodiment of a dgRNA, only the polynucleotide comprising the tracr comprises the additional A nucleic acid(s), e.g., 4 A nucleic acids. In an embodiment of a dgRNA, only the polynucleotide comprising the targeting domain comprises the additional A nucleic acid(s). In an embodiment of a dgRNA, both the polynucleotide comprising the targeting domain and the polynucleotide comprising the tracr comprise the additional U nucleic acids, e.g., 4 A nucleic acids.

In embodiments, one or more of the polynucleotides of the gRNA molecule may comprise a cap at the 5' end.

In an embodiment, a unimolecular, or sgRNA comprises, preferably from 5' to 3': a crRNA (which contains a targeting domain complementary to a target sequence; a crRNA flagpole region; first flagpole extension; a loop; a first tracr extension (which contains a domain complementary to at least a portion of the first flagpole extension); and a tracr (which contains a domain complementary to the crRNA flagpole region, and a domain which additionally binds a Cas9 molecule). In some aspects, the targeting domain comprises a targeting domain sequence described herein, e.g., a targeting domain described in Table 1 or Table 2, or a targeting domain comprising or consisting of 17, 18, 19, 20 (preferably 20) consecutive nucleotides of a targeting domain sequence described in Table 1 or Table 2, for example the 3' 17, 18, 19 or 20 (preferably 20) consecutive nucleotides of a targeting domain sequence described in Table 1 or Table 2.

In aspects comprising a first flagpole extension and/or a first tracr extension, the flagpole, loop and tracr sequences may be as described above. In general any first flagpole extension and first tracr extension may be employed, provided that they are complementary. In embodiments, the first flagpole extension and first tracr extension consist of 3, 4, 5, 6, 7, 8, 9, 10 or more complementary nucleotides.

In some aspects, the first flagpole extension comprises, from 5' to 3': UGCUG (SEQ ID NO: 55). In some aspects, the first flagpole extension consists of SEQ ID NO: 55.

In some aspects, the first tracr extension comprises, from 5' to 3': CAGCA (SEQ ID NO: 56). In some aspects, the first tracr extension consists of SEQ ID NO: 56.

In an embodiment, a dgRNA comprises two nucleic acid molecules. In some aspects, the dgRNA comprises a first nucleic acid which contains, preferably from 5' to 3': a targeting domain complementary to a target sequence; a crRNA flagpole region; optionally a first flagpole extension; and, optionally, a second flagpole extension; and a second nucleic acid (which may be referred to herein as a tracr), and comprises at least a domain which binds a Cas molecule, e.g., a Cas9 molecule) comprising preferably from 5' to 3': optionally a first tracr extension; and a tracr (which contains a domain complementary to the crRNA flagpole region, and a domain which additionally binds a Cas, e.g., Cas9, molecule). The second nucleic acid may additionally comprise, at the 3' end (e.g., 3' to the tracr) additional U nucleic acids. For example the tracr may comprise an additional 1, 2, 3, 4, 5, 6, 7, 8, 9, or 10 U nucleic acids at the 3' end (e.g., 3' to the tracr) (SEQ ID NO: 58). The second nucleic acid may additionally or alternately comprise, at the 3' end (e.g., 3' to the tracr) additional A nucleic acids. For example the tracr may comprise an additional 1, 2, 3, 4, 5, 6, 7, 8, 9, or 10 A nucleic acids at the 3' end (e.g., 3' to the tracr) (SEQ ID NO: 59). In some aspects, the targeting domain comprises a targeting domain sequence described herein, e.g., a targeting domain described in Table 1 or Table 2, or a targeting domain comprising or consisting of 17, 18, 19, or 20 (preferably 20) consecutive nucleotides of a targeting domain sequence described in Table 1 or Table 2.

In aspects involving a dgRNA, the crRNA flagpole region, optional first flagpole extension, optional first tracr extension and tracr sequences may be as described above.

In some aspects, the optional second flagpole extension comprises, from 5' to 3': UUUUG (SEQ ID NO: 57).

In embodiments, the 3' 1, 2, 3, 4, or 5 nucleotides, the 5' 1, 2, 3, 4, or 5 nucleotides, or both the 3' and 5' 1, 2, 3, 4, or 5 nucleotides of the gRNA molecule (and in the case of a dgRNA molecule, the polynucleotide comprising the targeting domain and/or the polynucleotide comprising the tracr) are modified nucleic acids, as described more fully in section XIII, below.

The domains are discussed briefly below:
1) The Targeting Domain:

Guidance on the selection of targeting domains can be found, e.g., in Fu Y el al. NAT BIOTECHNOL 2014 (doi: 10.1038/nbt.2808) and Sternberg S H el al. NATURE 2014 (doi: 10.1038/nature13011).

The targeting domain comprises a nucleotide sequence that is complementary, e.g., at least 80, 85, 90, 95, or 99% complementary, or e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence.

In an embodiment, the targeting domain is 5 to 50, e.g., 10 to 40, e.g., 10 to 30, e.g., 15 to 30, e.g., 15 to 25 nucleotides in length. In an embodiment, the targeting domain is 15, 16, 17, 18, 19, 20, 21, 22, 23, 24 or 25 nucleotides in length. In an embodiment, the targeting domain is 16 nucleotides in length. In an embodiment, the targeting domain is 17 nucleotides in length. In an embodiment, the targeting domain is 18 nucleotides in length. In an embodiment, the targeting domain is 19 nucleotides in length. In an embodiment, the targeting domain is 20 nucleotides in length. In an embodiment, the targeting domain is 21 nucleotides in length. In an embodiment, the targeting domain is 22 nucleotides in length. In an embodiment, the targeting domain is 23 nucleotides in length. In an embodiment, the targeting domain is 24 nucleotides in length. In an embodiment, the targeting domain is 25 nucleotides in length. In embodiments, the aforementioned 16, 17, 18, 19, or 20 nucleotides comprise the 5'-16, 17, 18, 19 or 20 nucleotides from a targeting domain described in Table 1 or Table 2. In embodiments, the aforementioned 16, 17, 18, 19, or 20 nucleotides comprise the 3'-16, 17, 18, 19 or 20 nucleotides from a targeting domain described in Table 1 or Table 2. In embodiments, the aforementioned 16, 17, 18, 19, or 20 nucleotides consist of the 3'-16, 17, 18, 19 or 20 nucleotides from a targeting domain described in Table 1 or Table 2. In embodiments, the targeting domain consists of a targeting domain described in Table 1 or Table 2.

Without being bound by theory, it is believed that the 8, 9 or 10 nucleic acids of the targeting domain disposed at the 3' end of the targeting domain may be important for targeting the target sequence, and may thus be referred to as the "core" region of the targeting domain. In an embodiment, the core domain is fully complementary with the target sequence.

The strand of the target nucleic acid with which the targeting domain is complementary is referred to herein as the target sequence. In some aspects, the target sequence is disposed on a chromosome, e.g., is a target within a gene. In some aspects the target sequence is disposed within an exon of a gene. In some aspects the target sequence is disposed within an intron of a gene. In some aspects, the target sequence comprises, or is proximal (e.g., within 10, 20, 30, 40, 50, 100, 200, 300, 400, 500, or 1000 nucleic acids) to a binding site of a regulatory element, e.g., a promoter or transcription factor binding site, of a gene of interest. Some or all of the nucleotides of the targeting domain can have a modification, e.g., modification found in Section XIII herein.

2) crRNA Flagpole Region:

The flagpole comprises a portion of gRNA in which the crRNA and the tracr bind or hybridize to one another. The crRNA flagpole region is complementary with a portion of the tracr, and in an embodiment, has sufficient complementarity to a portion of the tracr to form a duplexed region under at least some physiological conditions, for example, normal physiological conditions. In an embodiment, the crRNA flagpole region is 5 to 30 nucleotides in length. In an embodiment, the crRNA flagpole region is 5 to 25 nucleotides in length. The crRNA flagpole region can share homology with, or be derived from, a naturally occurring portion of the repeat sequence from a bacterial CRISPR system. In an embodiment, it has at least 50% homology with a crRNA flagpole region disclosed herein, e.g., an S. pyogenes, or S. thermophilus, crRNA flagpole region.

In an embodiment, the flagpole, e.g., the crRNA flagpole region, comprises SEQ ID NO: 50. In an embodiment, the flagpole, e.g., the crRNA flagpole region, consists of SEQ ID NO: 50. In an embodiment, the flagpole, e.g., the crRNA flagpole region, comprises sequence having at least 50%, 60%, 70%, 80%, 85%, 90%, 95% or 99% homology with SEQ ID NO: 50. In an embodiment, the flagpole, e.g., the crRNA flagpole region, comprises at least 5, 6, 7, 8, 9, 10, or 11 nucleotides of SEQ ID NO: 50. In an embodiment, the flagpole, e.g., the crRNA flagpole region, comprises SEQ ID NO: 51. In an embodiment, the flagpole, e.g., the crRNA flagpole region, consists of SEQ ID NO: 51. In an embodiment, the flagpole comprises sequence having at least 50%, 60%, 70%, 80%, 85%, 90%, 95% or 99% homology with SEQ ID NO: 51. In an embodiment, the flagpole, e.g., the crRNA flagpole region, comprises at least 5, 6, 7, 8, 9, 10, or 11 nucleotides of SEQ ID NO: 51.

Some or all of the nucleotides of the domain can have a modification, e.g., modification described in Section XIII herein.

3) First Flagpole Extension

When a tracr comprising a first tracr extension is used, the crRNA may comprise a first flagpole extension. In general any first flagpole extension and first tracr extension may be employed, provided that they are complementary. In embodiments, the first flagpole extension and first tracr extension consist of 3, 4, 5, 6, 7, 8, 9, 10 or more complementary nucleotides.

The first flagpole extension may comprise nucleotides that are complementary, e.g., 80%, 85%, 90%, 95% or 99%, e.g., fully complementary, with nucleotides of the first tracr extension. In some aspects, the first flagpole extension nucleotides that hybridize with complementary nucleotides of the first tracr extension are contiguous. In some aspects, the first flagpole extension nucleotides that hybridize with complementary nucleotides of the first tracr extension are discontinuous, e.g., comprises two or more regions of hybridization separated by nucleotides that do not base pair with nucleotides of the first tracr extension. In some aspects, the first flagpole extension comprises at least 2, 3, 4, 5, 6, 7, 8, 9, 10, 11, 12, 13, 14, 15, 16, 17, 18, 19, 20 or more nucleotides. In some aspects, the first flagpole extension comprises, from 5' to 3': UGCUG (SEQ ID NO: 55). In some aspects, the first flagpole extension consists of, from 5' to 3': UGCUG (SEQ ID NO: 55). In some aspects, the first flagpole extension consists of SEQ ID NO: 55. In some aspects the first flagpole extension comprises nucleic acid that is at least 80%, 85%, 90%, 95% or 99% homology to SEQ ID NO: 55.

Some or all of the nucleotides of the first tracr extension can have a modification, e.g., modification found in Section XIII herein.

3) The Loop

A loop serves to link the crRNA flagpole region (or optionally the first flagpole extension, when present) with the tracr (or optionally the first tracr extension, when present) of a sgRNA. The loop can link the crRNA flagpole region and tracr covalently or non-covalently. In an embodiment, the linkage is covalent. In an embodiment, the loop covalently couples the crRNA flagpole region and tracr. In an embodiment, the loop covalently couples the first flagpole extension and the first tracr extension. In an embodiment, the loop is, or comprises, a covalent bond interposed between the crRNA flagpole region and the domain of the tracr which hybridizes to the crRNA flagpole region. Typically, the loop comprises one or more, e.g., 2, 3, 4, 5, 6, 7, 8, 9, or 10 nucleotides.

In dgRNA molecules the two molecules can be associated by virtue of the hybridization between at least a portion of the crRNA (e.g., the crRNA flagpole region) and at least a portion of the tracr (e.g., the domain of the tracr which is complementary to the crRNA flagpole region).

A wide variety of loops are suitable for use in sgRNAs. Loops can consist of a covalent bond, or be as short as one or a few nucleotides, e.g., 1, 2, 3, 4, or 5 nucleotides in length. In an embodiment, a loop is 2, 3, 4, 5, 6, 7, 8, 9, 10, 15, 20, or 25 or more nucleotides in length. In an embodiment, a loop is 2 to 50, 2 to 40, 2 to 30, 2 to 20, 2 to 10, or 2 to 5 nucleotides in length. In an embodiment, a loop shares homology with, or is derived from, a naturally occurring sequence. In an embodiment, the loop has at least 50% homology with a loop disclosed herein. In an embodiment, the loop comprises SEQ ID NO: 52. In an embodiment, the loop consists of SEQ ID NO: 52.

Some or all of the nucleotides of the domain can have a modification, e.g., modification described in Section XIII herein.

4) The Second Flagpole Extension

In an embodiment, a dgRNA can comprise additional sequence, 3' to the crRNA flagpole region or, when present, the first flagpole extension, referred to herein as the second flagpole extension. In an embodiment, the second flagpole extension is 2-10, 2-9, 2-8, 2-7, 2-6, 2-5, or 2-4 nucleotides in length. In an embodiment, the second flagpole extension is 2, 3, 4, 5, 6, 7, 8, 9, or 10 or more nucleotides in length. In an embodiment, the second flagpole extension comprises SEQ ID NO: 57. In an embodiment, the second flagpole extension consists of SEQ ID NO: 57.

5) The Tracr:

The tracr is a nucleic acid sequence that can provide for nuclease, e.g., Cas9, binding. Without being bound by theory, it is believed that each Cas9 species is associated with a particular tracr sequence. Tracr sequences are utilized in both sgRNA and in dgRNA systems. The exemplary gRNA targeting domain sequences provided in Table 1 and Table 2 may be utilized in both sgRNA and in dgRNA systems.

In an embodiment, the tracr comprises sequence from, or derived from, an S. pyogenes tracr. See Jinek et al. (2012). In some aspects, the tracr has a portion that hybridizes to the flagpole portion of the crRNA, e.g., it has sufficient complementarity to the crRNA flagpole region to form a duplexed region under at least some physiological conditions (sometimes referred to herein as the tracr flagpole region or a tracr domain complementary to the crRNA flagpole region). In embodiments, the domain of the tracr that hybridizes with the crRNA flagpole region comprises at least 5, 6, 7, 8, 9, 10, 11, 12, 13, 14, 15, 16, 17, 18, 19, or 20 nucleotides that hybridize with complementary nucleotides of the crRNA flagpole region. In some aspects, the tracr nucleotides that hybridize with complementary nucleotides of the crRNA flagpole region are contiguous. In some aspects, the tracr nucleotides that hybridize with complementary nucleotides of the crRNA flagpole region are discontinuous, e.g., comprises two or more regions of hybridization separated by nucleotides that do not base pair with nucleotides of the crRNA flagpole region. In some aspects, the portion of the tracr that hybridizes to the crRNA flagpole region comprises, from 5' to 3': UAGCAAGUUAAAA (SEQ ID NO: 61). In some aspects, the portion of the tracr that hybridizes to the crRNA flagpole region comprises, from 5' to 3': UAGCAAGUUUAAA (SEQ ID NO: 62). In embodiments, the sequence that hybridizes with the crRNA flagpole region is disposed on the tracr 5'- to the sequence of the tracr that additionally binds a nuclease, e.g., a Cas molecule, e.g., a Cas9 molecule.

The tracr further comprises a domain that additionally binds to a nuclease, e.g., a Cas molecule, e.g., a Cas9 molecule. Without being bound by theory, it is believed that Cas9 from different species bind to different tracr sequences. In some aspects, the tracr comprises sequence that binds to a S. pyogenes Cas9 molecule. See Jinek et al. (2012). In some aspects, the tracr comprises sequence that binds to a Cas9 molecule disclosed herein. In some aspects, the domain that additionally binds a Cas9 molecule comprises, from 5' to 3': UAAGGCUAGUCCGUUAUCAAC-UUGAAAAAGUGGCACCGAGUCGGUGC (SEQ ID NO: 63). In some aspects the domain that additionally binds a Cas9 molecule comprises, from 5' to 3': UAAGGCUA-GUCCGUUAUCAACUUGAAAAAGUGGCACCGAGU-CGGUGCUUUU (SEQ ID NO: 64).

In some embodiments, the tracr comprises SEQ ID NO: 53.
In some embodiments, the tracr comprises SEQ ID NO: 54.
In some embodiments, the tracr consists of SEQ ID NO: 53.
In some embodiments, the tracr consists of SEQ ID NO: 54.

Some or all of the nucleotides of the tracr can have a modification, e.g., modification found in Section XIII herein.

In embodiments, the gRNA or any of the gRNA components described above comprises an inverted abasic residue at the 5' end, the 3' end or both the 5' and 3' end (e.g., in the sgRNA or in the tracr and/or crRNA of a dgRNA). In embodiments, the gRNA or any of the gRNA components described above comprises one or more phosphorothioate bonds. For example, the one or more phosphorothioate bonds can be between residues at the 5' end of the polynucleotide, for example, a phosphrothioate bond between the first two 5' residues, between each of the first three 5' residues, between each of the first four 5' residues, or between each of the first five 5' residues (e.g., in the sgRNA or in the tracr and/or crRNA of a dgRNA). In embodiments, the gRNA or gRNA component may alternatively or additionally comprise one or more phosphorothioate bonds between residues at the 3' end of the polynucleotide, for example, a phosphrothioate bond between the first two 3' residues, between each of the first three 3' residues, between each of the first four 3' residues, or between each of the first five 3' residues. In an embodiment, the gRNA or gRNA components described above, comprises a phosphorothioate bond between each of the first four 5' residues (e.g., comprises or consists of, three phosphorothioate bonds at the 5' end(s)), and a phosphorothioate bond between each of the first four 3' residues (e.g., comprises or consists of, three phosphorothioate bonds at the 3' end(s)). In an embodiment, any of the phosphorothioate modifications described above can be combined with an inverted abasic residue at the 5' end, the 3' end, or both the 5' and 3' ends of the polynucleotide. In such embodiments, the inverted abasic nucleotide may be linked to the 5' and/or 3' nucleotide by a phosphate bond or a phosphorothioate bond.

In embodiments, the gRNA or gRNA components described above, comprises one or more nucleotides that include a 2' O-methyl modification. In embodiments, each of the first 1, 2, 3, or more of the 5' residues comprise a 2' O-methyl modification. In embodiments, each of the first 1, 2, 3, or more of the 3' residues comprise a 2' O-methyl modification. In embodiments, the 4th-to-terminal, $3^{rd}$-to-terminal, and $2^{nd}$-to-terminal 3' residues comprise a 2' O-methyl modification. In embodiments, each of the first 1, 2, 3 or more of the 5' residues comprise a 2' O-methyl modification, and each of the first 1, 2, 3 or more of the 3' residues comprise a 2' O-methyl modification. In an embodiment, each of the first 3 of the 5' residues comprise a 2' O-methyl modification, and each of the first 3 of the 3' residues comprise a 2' O-methyl modification. In embodiments, each of the first 3 of the 5' residues comprise a 2' O-methyl modification, and the 4th-to-terminal, $3^{rd}$-to-terminal, and $2^{nd}$-to-terminal 3' residues comprise a 2' O-methyl modification. In embodiments, any of the 2' O-methyl modifications described above may be combined with one or more phosphorothioate modifications, e.g., as described above, and/or one or more inverted abasic modifications, e.g., as described above.

In an embodiment, the gRNA or gRNA components described above, comprises or consists of, a phosphorothioate bond between each of the first four 5' residues (e.g., comprises or consists of three phosphorothioate bonds at the 5' end of the polynucleotide(s)), a phosphorothioate bond between each of the first four 3' residues (e.g., comprises or consists of three phosphorothioate bonds at the 5' end of the polynucleotide(s)), a 2' O-methyl modification at each of the first three 5' residues, and a 2' O-methyl modification at each of the first three 3' residues.

In an embodiment, the gRNA or gRNA components described above, comprises or consists of, a phosphorothioate bond between each of the first four 5' residues (e.g., comprises or consists of three phosphorothioate bonds at the 5' end of the polynucleotide(s)), a phosphorothioate bond between each of the first four 3' residues (e.g., comprises or consists of three phosphorothioate bonds at the 5' end of the polynucleotide(s)), a 2' O-methyl modification at each of the first three 5' residues, and a 2' O-methyl modification at each of the $4^{th}$-to-terminal, $3^{rd}$-to-terminal, and $2^{nd}$-to-terminal 3' residues.

In an embodiment, the gRNA or gRNA components described above, comprises or consists of, a phosphorothioate bond between each of the first four 5' residues (e.g., comprises or consists of three phosphorothioate bonds at the 5' end of the polynucleotide(s)), a phosphorothioate bond between each of the first four 3' residues (e.g., comprises or consists of three phosphorothioate bonds at the 5' end of the polynucleotide(s)), a 2' O-methyl modification at each of the first three 5' residues, a 2' O-methyl modification at each of the first three 3' residues, and an additional inverted abasic residue at each of the 5' and 3' ends.

In an embodiment, the gRNA or gRNA components described above, comprises or consists of, a phosphorothioate bond between each of the first four 5' residues (e.g., comprises or consists of three phosphorothioate bonds at the 5' end of the polynucleotide(s)), a phosphorothioate bond between each of the first four 3' residues (e.g., comprises or consists of three phosphorothioate bonds at the 5' end of the polynucleotide(s)), a 2' O-methyl modification at each of the first three 5' residues, and a 2' O-methyl modification at each of the 4th-to-terminal, $3^{rd}$-to-terminal, and $2^{nd}$-to-terminal 3' residues, and an additional inverted abasic residue at each of the 5' and 3' ends.

Specific embodiments of gRNA molecules are described in detail below. Although each is shown with 20 nucleic acid residues of the targeting domain (N's in each of the sequences below), it will be understood that the targeting domain may comprise or consist of 5-50 residues, e.g., 15-30 residues, e.g., 15-25 residues, e.g., 15, 16, 17, 18, 19, 20, 21, 22, 23, 24, or 25 residues. In embodiments, the gRNA is a dgRNA and comprises or consists of:
crRNA:
  mN*mN*mN*GUUUUAGAGCUAU*mG*mC*mU (SEQ ID NO: 66), where m indicates a base with 2'O-Methyl modification, * indicates a phosphorothioate bond, and N's indicate the residues of the targeting domain, e.g., as described herein (optionally with an inverted abasic residue at the 5' and/or 3' terminus); and tracr:
  AACAGCAUAGCAAGUUAAAAUAAGGCUAGU-CCGUUAUCAACUUGAAA AAGUGGCACCGAGUCG-GUGCUUUUUU (SEQ ID NO: 65) (optionally with an inverted abasic residue at the 5' and/or 3' terminus).

In embodiments, the gRNA is a dgRNA and comprises or consists of:
crRNA:
  mN*mN*mN*GUUUUAGAGCUAU*mG*mC*mU (SEQ ID NO: 66), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus); and tracr:
  mA*mA*mC*AGCAUAGCAAGUUAAAAUAAGGC UAGUCCGUUAUCAAC UUGAAAAAGUGGCACCGAGUCGGUGCUUUU*mU* mU*mU (SEQ ID NO: 67), where m indicates a base with 2'O-Methyl modification, * indicates a phosphorothioate bond, and N's indicate the residues of the targeting domain (optionally with an inverted abasic residue at the 5' and/or 3' terminus).

In embodiments, the gRNA is a dgRNA and comprises or consists of:
crRNA:
  mN*mN*mN*NNNNNNNNNNNNNNNNNNGUUUAG AGCUAUGCUGUU*m U*mU*mG (SEQ ID NO: 68), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus); and
tracr:
  AACAGCAUAGCAAGUUAAAAUAAGGCUAGU-CCGUUAUCAACUUGAAA AAGUGGCACCGAGUCG-GUGCUUUUUUU (SEQ ID NO: 65) (optionally with an inverted abasic residue at the 5' and/or 3' terminus).

In embodiments, the gRNA is a dgRNA and comprises or consists of:
crRNA:
  mN*mN*mN*NNNNNNNNNNNNNNNNNNGUUUUA GAGCUAUGCUGUU*m U*mU*mG (SEQ ID NO: 68), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus); and
tracr:
  mA*mA*mC*AGCAUAGCAAGUUAAAAUAAGGC UAGUCCGUUAUCAAC UUGAAAAAGUGGCACCGAGUCGGUGCUUUU*mU* mU*mU (SEQ ID NO: 67), where m indicates a base with 2'O-Methyl modification, and * indicates a phosphorothioate bond (optionally with an inverted abasic residue at the 5' and/or 3' terminus).

In embodiments, the gRNA is a sgRNA and comprises or consists of:
  mN*mN*mN*NNNNNNNNNNNNNNNNNNGUUUUA GAGCUAGAAAUAGCA AGUUAAAAUAAGGCUA-GUCCGUUAUCAACUUGAAAGUGGCACCGAGU-CGGU GCU*mU*mU*mU (SEQ ID NO: 69), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus).

In embodiments, the gRNA is a sgRNA and comprises or consists of:
  mN*mN*mN*GUUUUAGAGCUAGAAAUAGCA AGUUAAAAUAAGGCUAGUCCGUUAUCAAC-UUGAAAGUGGCACCGAGUCGGU GCmU*mU*mU*U (SEQ ID NO: 70, where m indicates a base with 2'O-Methyl modification, * indicates a phosphorothioate bond, and N's indicate the residues of the targeting domain, e.g., as described herein, (optionally with an inverted abasic residue at the 5' and/or 3' terminus).

6) First Tracr Extension

Where the gRNA comprises a first flagpole extension, the tracr may comprise a first tracr extension. The first tracr extension may comprise nucleotides that are complementary, e.g., 80%, 85%, 90%, 95% or 99%, e.g., fully complementary to nucleotides of the first flagpole extension. In some aspects, the first tracr extension nucleotides that hybridize with complementary nucleotides of the first flagpole extension are contiguous. In some aspects, the first tracr extension nucleotides that hybridize with complementary nucleotides of the first flagpole extension are discontinuous, e.g., comprises two or more regions of hybridization separated by nucleotides that do not base pair with nucleotides of the first flagpole extension. In some aspects, the first tracr extension comprises at least 2, 3, 4, 5, 6, 7, 8, 9, 10, 11, 12, 13, 14, 15, 16, 17, 18, 19, 20 or more nucleotides. In some aspects, the first tracr extension comprises SEQ ID NO: 56. In some aspects the first tracr extension comprises nucleic acid that is at least 80%, 85%, 90%, 95% or 99% homology to SEQ ID NO: 56.

Some or all of the nucleotides of the first tracr extension can have a modification, e.g., modification found in Section XIII herein.

In some embodiments, the sgRNA may comprise, from 5' to 3' and disposed 3' to the targeting domain:

a)
(SEQ ID NO: 71)
GUUUUAGAGCUAGAAAUAGCAAGUUAAAAUAAGGCUAGUCCGUUAUCAACU

UGAAAAAGUGGCACCGAGUCGGUGC;

b)
(SEQ ID NO: 72)
GUUUAAGAGCUAGAAAUAGCAAGUUUAAAUAAGGCUAGUCCGUUAUCAACU

UGAAAAAGUGGCACCGAGUCGGUGC;

c)
(SEQ ID NO: 73)
GUUUUAGAGCUAUGCUGGAAACAGCAUAGCAAGUUAAAAUAAGGCUAGUCC

GUUAUCAACUUGAAAAAGUGGCACCGAGUCGGUGC;

d)
(SEQ ID NO: 74)
GUUUAAGAGCUAUGCUGGAAACAGCAUAGCAAGUUUAAAUAAGGCUAGUCC

GUUAUCAACUUGAAAAAGUGGCACCGAGUCGGUGC;

e) any of a) to d), above, further comprising, at the 3' end, at least 1, 2, 3, 4, 5, 6 or 7 uracil (U) nucleotides, e.g., 1, 2, 3, 4, 5, 6, or 7 uracil (U) nucleotides;
f) any of a) to d), above, further comprising, at the 3' end, at least 1, 2, 3, 4, 5, 6 or 7 adenine (A) nucleotides, e.g., 1, 2, 3, 4, 5, 6, or 7 adenine (A) nucleotides; or
g) any of a) to f), above, further comprising, at the 5' end (e.g., at the 5' terminus, e.g., 5' to the targeting domain), at least 1, 2, 3, 4, 5, 6 or 7 adenine (A) nucleotides, e.g., 1, 2, 3, 4, 5, 6, or 7 adenine (A) nucleotides.

In an embodiment, a sgRNA of the disclosure comprises or consists of, from 5' to 3': [targeting domain]-GUUUUAGAGCUAGAAAUAGCAAGUUAAAAUAAGGCUAGUCCGUUAUCAACUUG AAAAAGUGGCACCGAGUCGGUGCUUUU (SEQ ID NO: 75).

In an embodiment, a sgRNA of the disclosure comprises or consists of, from 5' to 3': [targeting domain]-GUUUAAGAGCUAUGCUGGAAACAGCAUAGCAAGUUUAAAUAAGGCUAGUCCGU UAUCAACUUGAAAAAGUGGCACCGAGUCGGUGCUUUU (SEQ ID NO: 76).

In embodiments, any of a) to g) above is disposed directly 3' to the targeting domain.

In some embodiments, the dgRNA may comprise:

A crRNA comprising, from 5' to 3', preferably disposed directly 3' to the targeting domain:

a)
GUUUUAGAGCUA (SEQ ID NO: 50);

b)
GUUUAAGAGCUA (SEQ ID NO: 51);

c)
GUUUUAGAGCUAUGCUG (SEQ ID NO: 77);

d)
GUUUAAGAGCUAUGCUG (SEQ ID NO: 78);

e)
GUUUUAGAGCUAUGCUGUUUUG (SEQ ID NO: 79);

f)
GUUUAAGAGCUAUGCUGUUUUG (SEQ ID NO: 80);
or g)
GUUUUAGAGCUAUGCU (SEQ ID NO: 81):

and a tracr comprising, from 5' to 3':

a)
(SEQ ID NO: 53)
UAGCAAGUUAAAAUAAGGCUAGUCCGUUAUCAACUUGAAAAAGUGGCACCG

AGUCGGUGC;

b)
(SEQ ID NO: 54)
UAGCAAGUUUAAAUAAGGCUAGUCCGUUAUCAACUUGAAAAAGUGGCACCG

AGUCGGUGC;

c)
(SEQ ID NO: 82)
CAGCAUAGCAAGUUAAAAUAAGGCUAGUCCGUUAUCAACUUGAAAAAGUGG

CACCGAGUCGGUGC;

d)
(SEQ ID NO: 83)
CAGCAUAGCAAGUUUAAAUAAGGCUAGUCCGUUAUCAACUUGAAAAAGUGG

CACCGAGUCGGUGC;

e)
(SEQ ID NO: 65)
AACAGCAUAGCAAGUUAAAAUAAGGCUAGUCCGUUAUCAACUUGAAAAAGU

GGCACCGAGUCGGUGCUUUUUUU;

f)
(SEQ ID NO: 84)
AACAGCAUAGCAAGUUUAAAUAAGGCUAGUCCGUUAUCAACUUGAAAAAGU

GGCACCGAGUCGGUGCUUUUUUU;

g)
(SEQ ID NO: 76)
GUUUAAGAGCUAUGCUGGAAACAGCAUAGCAAGUUUAAAUAAGGCUAGUCC

GUUAUCAACUUGAAAAAGUGGCACCGAGUCGGUGCUUUU;

h)
(SEQ ID NO: 85)
AGCAUAGCAAGUUAAAAUAAGGCUAGUCCGUUAUCAACUUGAAAAAGUGGC

ACCGAGUCGGUGCUUU;

i)
(SEQ ID NO: 86)
GUUGGAACCAUUCAAAACAGCAUAGCAAGUUAAAAUAAGGCUAGUCCGUUA

UCAACUUGAAAAAGUGGCACCGAGUCGGUGCUUU;

-continued j)
(SEQ ID NO: 87)
AACAGCAUAGCAAGUUAAAAUAAGGCUAGUCCGUUAUCAACUUGAAAAAGU

GGCACCGAGUCGGUGC;

k) any of a) to j), above, further comprising, at the 3' end, at least 1, 2, 3, 4, 5, 6 or 7 uracil (U) nucleotides, e.g., 1, 2, 3, 4, 5, 6, or 7 uracil (U) nucleotides;
l) any of a) to j), above, further comprising, at the 3' end, at least 1, 2, 3, 4, 5, 6 or 7 adenine (A) nucleotides, e.g., 1, 2, 3, 4, 5, 6, or 7 adenine (A) nucleotides; or
m) any of a) to l), above, further comprising, at the 5' end (e.g., at the 5' terminus), at least 1, 2, 3, 4, 5, 6 or 7 adenine (A) nucleotides, e.g., 1, 2, 3, 4, 5, 6, or 7 adenine (A) nucleotides.

In an embodiment, the sequence of k), above comprises the 3' sequence UUUUUU, e.g., if a U6 promoter is used for transcription. In an embodiment, the sequence of k), above, comprises the 3' sequence UUUU, e.g., if an HI promoter is used for transcription. In an embodiment, sequence of k), above, comprises variable numbers of 3' U's depending, e.g., on the termination signal of the pol-III promoter used. In an embodiment, the sequence of k), above, comprises variable 3' sequence derived from the DNA template if a T7 promoter is used. In an embodiment, the sequence of k), above, comprises variable 3' sequence derived from the DNA template, e.g., if in vitro transcription is used to generate the RNA molecule. In an embodiment, the sequence of k), above, comprises variable 3' sequence derived from the DNA template, e.g., if a pol-II promoter is used to drive transcription.

In an embodiment, the crRNA comprises SEQ ID NO: 79 and the tracr comprises or consists of (SEQ ID NO: 65)
AACAGCAUAGCAAGUUAAAAUAAGGCUAGUCCGUUAUCAACUUGAAAAAGU

GGCACCGAGUCGGUGCUUUUUU.

In an embodiment, the crRNA comprises SEQ ID NO: 80 and the tracr comprises or consists of, (SEQ ID NO: 84)
AACAGCAUAGCAAGUUAAAAUAAGGCUAGUCCGUUAUCAACUUGAAAAAGU

GGCACCGAGUCGGUGCUUUUUU.

In an embodiment, the crRNA comprises or consists of, a targeting domain and, disposed 3' to the targeting domain (e.g., disposed directly 3' to the targeting domain), a sequence comprising, e.g., consisting of, GUUUUAGAGC-UAUGCU (SEQ ID NO: 81), and the tracr comprises or consists of, (SEQ ID NO: 76)
GUUUAAGAGCUAUGCUGGAAACAGCAUAGCAAGUUUAAAUAAGGCUAGUCC

GUUAUCAACUUGAAAAAGUGGCACCGAGUCGGUGCUUUU.

In an embodiment, the crRNA comprises or consists of, a targeting domain and, disposed 3' to the targeting domain (e.g., disposed directly 3' to the targeting domain), a sequence comprising, e.g., consisting of, GUUUUAGAGC-UAUGCU (SEQ ID NO: 81), and the tracr comprises or consists of, (SEQ ID NO: 85)
AGCAUAGCAAGUUAAAAUAAGGCUAGUCCGUUAUCAACUUGAAAAAGUGGC

ACCGAGUCGGUGCUUU.

In an embodiment, the crRNA comprises or consists of, a targeting domain and, disposed 3' to the targeting domain (e.g., disposed directly 3' to the targeting domain), a sequence comprising, e.g., consisting of, GUUUUAGAGC-UAUGCUGUUUG (SEQ ID NO: 79), and the tracr comprises or consists of, (SEQ ID NO: 86)
GUUGGAACCAUUCAAAACAGCAUAGCAAGUUAAAAUAAGGCUAGUCCGUUA

UCAACUUGAAAAAGUGGCACCGAGUCGGUGCUUU.

Targeting Domains Useful for gRNA molecules and other aspects of the disclosure.

Provided in the tables below are targeting domains for gRNA molecules for use in the CRISPR systems, cells, compositions and methods of the present disclosure, for example, in reducing or eliminating the expression and/or function of TET2 and/or insertion of heterologous nucleic acid sequence (e.g., nucleic acid sequence encoding a CAR, e.g., as described herein) at or near a target sequence of TET2, e.g., of a TET2 intron or intron-exon junction.

TABLE 1 gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_6 | + | chr4: 105147018-105147038 | UUCUCCCCUUCGCUUUUUCU | 1000 |
| 54790_1_8 | + | chr4: 105147019-105147039 | UCUCCCCUUCGCUUUUUCUC | 1001 |
| 54790_1_12 | + | chr4: 105147027-105147047 | UCGCUUUUUCUCGGGCUUCC | 1002 |
| 54790_1_13 | + | chr4: 105147028-105147048 | CGCUUUUUCUCGGGCUUCCA | 1003 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_16 | + | chr4: 105147033-105147053 | UUUCUCGGGCUUCCAGGGAC | 1004 |
| 54790_1_18 | + | chr4: 105147034-105147054 | UUCUCGGGCUUCCAGGGACU | 1005 |
| 54790_1_22 | + | chr4: 105147035-105147055 | UCUCGGGCUUCCAGGGACUG | 1006 |
| 54790_1_30 | + | chr4: 105147072-105147092 | UGUCACCCACAAAUACCAAG | 1007 |
| 54790_1_32 | + | chr4: 105147073-105147093 | GUCACCCACAAAUACCAAGA | 1008 |
| 54790_1_36 | + | chr4: 105147079-105147099 | CACAAAUACCAAGAGGGAAG | 1009 |
| 54790_1_38 | + | chr4: 105147080-105147100 | ACAAAUACCAAGAGGGAAGA | 1010 |
| 54790_1_40 | + | chr4: 105147099-105147119 | AGGGAAGCUUCACAAAUUAC | 1011 |
| 54790_1_43 | + | chr4: 105147115-105147135 | UUACUGGAGCCUCUUCAACA | 1012 |
| 54790_1_59 | + | chr4: 105147240-105147260 | CCUUUGUGCCUCCGACGAGC | 1013 |
| 54790_1_63 | + | chr4: 105147248-105147268 | CCUCCGACGAGCCGGUUUCC | 1014 |
| 54790_1_83 | + | chr4: 105147314-105147334 | UUUCUAAAAUAGUUCAGCUU | 1015 |
| 54790_1_84 | + | chr4: 105147315-105147335 | UUCUAAAAUAGUUCAGCUUU | 1016 |
| 54790_1_86 | + | chr4: 105147316-105147336 | UCUAAAAUAGUUCAGCUUUG | 1017 |
| 54790_1_88 | + | chr4: 105147317-105147337 | CUAAAAUAGUUCAGCUUUGG | 1018 |
| 54790_1_112 | + | chr4: 105147415-105147435 | ACCUCAGAGAGAACACUGAU | 1019 |
| 54790_1_113 | + | chr4: 105147416-105147436 | CCUCAGAGAGAACACUGAUA | 1020 |
| 54790_1_116 | + | chr4: 105147445-105147465 | UCGACCCUUUUAUCAGCUGU | 1021 |
| 54790_1_119 | + | chr4: 105147446-105147466 | CGACCCUUUUAUCAGCUGUA | 1022 |
| 54790_1_122 | + | chr4: 105147451-105147471 | CUUUUAUCAGCUGUAGGGUC | 1023 |
| 54790_1_123 | + | chr4: 105147452-105147472 | UUUUAUCAGCUGUAGGGUCU | 1024 |
| 54790_1_127 | + | chr4: 105147457-105147477 | UCAGCUGUAGGGUCUGGGUC | 1025 |
| 54790_1_129 | + | chr4: 105147458-105147478 | CAGCUGUAGGGUCUGGGUCU | 1026 |
| 54790_1_134 | + | chr4: 105147498-105147518 | CUACCUUCUUAUCCCCCUUU | 1027 |
| 54790_1_136 | + | chr4: 105147499-105147519 | UACCUUCUUAUCCCCCUUUA | 1028 |
| 54790_1_137 | + | chr4: 105147500-105147520 | ACCUUCUUAUCCCCCUUUAG | 1029 |
| 54790_1_138 | + | chr4: 105147501-105147521 | CCUUCUUAUCCCCCUUUAGG | 1030 |
| 54790_1_147 | + | chr4: 105147524-105147544 | CUGUACGAAGUGAAUGUCAC | 1031 |
| 54790_1_149 | + | chr4: 105147525-105147545 | UGUACGAAGUGAAUGUCACA | 1032 |
| 54790_1_152 | + | chr4: 105147530-105147550 | GAAGUGAAUGUCACAGGGAG | 1033 |
| 54790_1_155 | + | chr4: 105147536-105147556 | AAUGUCACAGGGAGUGGAAU | 1034 |
| 54790_1_158 | + | chr4: 105147550-105147570 | UGGAAUUGGAGUACACUGAG | 1035 |
| 54790_1_159 | + | chr4: 105147551-105147571 | GGAAUUGGAGUACACUGAGU | 1036 |
| 54790_1_170 | + | chr4: 105147588-105147608 | AAGUCCGCGCGUUUUGUUAG | 1037 |
| 54790_1_179 | + | chr4: 105147604-105147624 | UUAGCGGCGCUGAGUGAAAG | 1038 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_184 | + | chr4: 105147622-105147642 | AGAGGAAAGAAUAGUUUCUC | 1039 |
| 54790_1_189 | + | chr4: 105147658-105147678 | ACCAGAACUCACUUUUCUCA | 1040 |
| 54790_1_194 | + | chr4: 105147676-105147696 | CAAGGUACAUAAGUCAGCGC | 1041 |
| 54790_1_195 | + | chr4: 105147677-105147697 | AAGGUACAUAAGUCAGCGCU | 1042 |
| 54790_1_198 | + | chr4: 105147695-105147715 | CUGGGCUGAGCCUUCCAGCC | 1043 |
| 54790_1_201 | + | chr4: 105147696-105147716 | UGGGCUGAGCCUUCCAGCCU | 1044 |
| 54790_1_203 | + | chr4: 105147697-105147717 | GGGCUGAGCCUUCCAGCCUG | 1045 |
| 54790_1_209 | + | chr4: 105147720-105147740 | AAUGUAUGUAAGAGAAUUUA | 1046 |
| 54790_1_210 | + | chr4: 105147737-105147757 | UUAUGGACAAAUCUGUGUCC | 1047 |
| 54790_1_216 | + | chr4: 105147769-105147789 | UCUCCCGAAUCAGCUUCGUU | 1048 |
| 54790_1_218 | + | chr4: 105147777-105147797 | AUCAGCUUCGUUUGGUUCCU | 1049 |
| 54790_1_220 | + | chr4: 105147788-105147808 | UUGGUUCCUUGGUAAGUGAC | 1050 |
| 54790_1_225 | + | chr4: 105147800-105147820 | UAAGUGACAGGCAGACACAA | 1051 |
| 54790_1_226 | + | chr4: 105147804-105147824 | UGACAGGCAGACACAAAGGC | 1052 |
| 54790_1_227 | + | chr4: 105147810-105147830 | GCAGACACAAAGGCAGGCGC | 1053 |
| 54790_1_229 | + | chr4: 105147815-105147835 | CACAAAGGCAGGCGCAGGCC | 1054 |
| 54790_1_231 | + | chr4: 105147816-105147836 | ACAAAGGCAGGCGCAGGCCC | 1055 |
| 54790_1_233 | + | chr4: 105147817-105147837 | CAAAGGCAGGCGCAGGCCCG | 1056 |
| 54790_1_236 | + | chr4: 105147820-105147840 | AGGCAGGCGCAGGCCCGGGG | 1057 |
| 54790_1_239 | + | chr4: 105147821-105147841 | GGCAGGCGCAGGCCCGGGGA | 1058 |
| 54790_1_240 | + | chr4: 105147822-105147842 | GCAGGCGCAGGCCCGGGGAG | 1059 |
| 54790_1_241 | + | chr4: 105147823-105147843 | CAGGCGCAGGCCCGGGGAGG | 1060 |
| 54790_1_243 | + | chr4: 105147826-105147846 | GCGCAGGCCCGGGGAGGGGG | 1061 |
| 54790_1_246 | + | chr4: 105147827-105147847 | CGCAGGCCCGGGGAGGGGGC | 1062 |
| 54790_1_248 | + | chr4: 105147830-105147850 | AGGCCCGGGGAGGGGCGGG | 1063 |
| 54790_1_251 | + | chr4: 105147831-105147851 | GGCCCGGGGAGGGGCGGGA | 1064 |
| 54790_1_252 | + | chr4: 105147832-105147852 | GCCCGGGGAGGGGCGGGAG | 1065 |
| 54790_1_253 | + | chr4: 105147833-105147853 | CCCGGGGAGGGGCGGGAGG | 1066 |
| 54790_1_256 | + | chr4: 105147836-105147856 | GGGAGGGGCGGGAGGGGG | 1067 |
| 54790_1_257 | + | chr4: 105147837-105147857 | GGGAGGGGCGGGAGGGGGU | 1068 |
| 54790_1_260 | + | chr4: 105147838-105147858 | GGAGGGGCGGGAGGGGGUG | 1069 |
| 54790_1_263 | + | chr4: 105147851-105147871 | GGGGGUGGGGAGCGCAGCGU | 1070 |
| 54790_1_264 | + | chr4: 105147869-105147889 | GUUGGAGUUGCAAGACUGCA | 1071 |
| 54790_1_268 | + | chr4: 105147874-105147894 | AGUUGCAAGACUGCAAGGUC | 1072 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_269 | + | chr4: 105147875-105147895 | GUUGCAAGACUGCAAGGUCA | 1073 |
| 54790_1_270 | + | chr4: 105147876-105147896 | UUGCAAGACUGCAAGGUCAG | 1074 |
| 54790_1_280 | + | chr4: 105147955-105147975 | GUCCCAUCCAAAUUUCUCUU | 1075 |
| 54790_1_281 | + | chr4: 105147968-105147988 | UUCUCUUUGGCUUCUCUCUU | 1076 |
| 54790_1_298 | + | chr4: 105148092-105148112 | AUCUUGCUGAAUCUUUUCAC | 1077 |
| 54790_1_300 | + | chr4: 105148093-105148113 | UCUUGCUGAAUCUUUUCACU | 1078 |
| 54790_1_306 | + | chr4: 105148124-105148144 | UCUAGUUUUAUUAAGCUAAU | 1079 |
| 54790_1_308 | + | chr4: 105148125-105148145 | CUAGUUUUAUUAAGCUAAUA | 1080 |
| 54790_1_313 | + | chr4: 105148134-105148154 | UUAAGCUAAUAGGGUUUGUA | 1081 |
| 54790_1_323 | + | chr4: 105148167-105148187 | ACCUAUGACAUAAUGAAGUG | 1082 |
| 54790_1_325 | + | chr4: 105148172-105148192 | UGACAUAAUGAAGUGUGGCC | 1083 |
| 54790_1_328 | + | chr4: 105148184-105148204 | GUGUGGCCUGGAUAGACUCC | 1084 |
| 54790_1_329 | + | chr4: 105148189-105148209 | GCCUGGAUAGACUCCUGGAA | 1085 |
| 54790_1_332 | + | chr4: 105148220-105148240 | GAAAUAUAAGUGUUAUUUGC | 1086 |
| 54790_1_340 | + | chr4: 105148257-105148277 | AUAUACUUUUAAUUACAUUG | 1087 |
| 54790_1_343 | + | chr4: 105148258-105148278 | UAUACUUUUAAUUACAUUGA | 1088 |
| 54790_1_357 | + | chr4: 105148300-105148320 | AAUGUUUAAGAAUUGAGAAA | 1089 |
| 54790_1_360 | + | chr4: 105148315-105148335 | AGAAAAGGCUUAUUUUCCAG | 1090 |
| 54790_1_373 | + | chr4: 105148368-105148388 | AUUUAUAUAUUUACGUGUCU | 1091 |
| 54790_1_375 | + | chr4: 105148369-105148389 | UUUAUAUAUUUACGUGUCUA | 1092 |
| 54790_1_380 | + | chr4: 105148374-105148394 | AUAUUUACGUGUCUAGGGAG | 1093 |
| 54790_1_388 | + | chr4: 105148434-105148454 | GUGCUUUUUCCCCUUCAGUC | 1094 |
| 54790_1_390 | + | chr4: 105148435-105148455 | UGCUUUUUCCCCUUCAGUCA | 1095 |
| 54790_1_398 | + | chr4: 105148445-105148465 | CCUUCAGUCAGGGAUUAUAA | 1096 |
| 54790_1_399 | + | chr4: 105148446-105148466 | CUUCAGUCAGGGAUUAUAAU | 1097 |
| 54790_1_406 | + | chr4: 105148491-105148511 | AUCAACAAAUGAUCCAUCAU | 1098 |
| 54790_1_410 | + | chr4: 105148511-105148531 | AGGAAUAAGAUUGUAUCUUA | 1099 |
| 54790_1_411 | + | chr4: 105148512-105148532 | GGAAUAAGAUUGUAUCUUAA | 1100 |
| 54790_1_415 | + | chr4: 105148519-105148539 | GAUUGUAUCUUAAGGGAAGU | 1101 |
| 54790_1_416 | + | chr4: 105148520-105148540 | AUUGUAUCUUAAGGGAAGUU | 1102 |
| 54790_1_423 | + | chr4: 105148542-105148562 | GAUUCACAGAGAAAAGACAU | 1103 |
| 54790_1_424 | + | chr4: 105148547-105148567 | ACAGAGAAAAGACAUUGGUU | 1104 |
| 54790_1_426 | + | chr4: 105148552-105148572 | GAAAAGACAUUGGUUUGGUU | 1105 |
| 54790_1_429 | + | chr4: 105148565-105148585 | UUUGGUUUGGUGUGAUACUG | 1106 |
| 54790_1_430 | + | chr4: 105148566-105148586 | UUGGUUUGGUGUGAUACUGU | 1107 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_435 | + | chr4: 105148579-105148599 | AUACUGUGGGUAUUGUUGCC | 1108 |
| 54790_1_441 | + | chr4: 105148611-105148631 | UCAUUACAUUUGCAUUUUAA | 1109 |
| 54790_1_450 | + | chr4: 105148629-105148649 | AAUGGAAAGUUGAAAUACUA | 1110 |
| 54790_1_451 | + | chr4: 105148630-105148650 | AUGGAAAGUUGAAAUACUAA | 1111 |
| 54790_1_455 | + | chr4: 105148631-105148651 | UGGAAAGUUGAAAUACUAAG | 1112 |
| 54790_1_464 | + | chr4: 105148677-105148697 | UAUGUGUGCUUAAUAAUGUU | 1113 |
| 54790_1_482 | + | chr4: 105148741-105148761 | AAAUGUUAAUAAGCAGAGAA | 1114 |
| 54790_1_487 | + | chr4: 105148756-105148776 | GAGAACGGUUAAUGAAGUGU | 1115 |
| 54790_1_493 | + | chr4: 105148791-105148811 | AAGUUUAGAAGACAAUUUAU | 1116 |
| 54790_1_497 | + | chr4: 105148803-105148823 | CAAUUUAUAGGAUUAAAAAA | 1117 |
| 54790_1_503 | + | chr4: 105148811-105148831 | AGGAUUAAAAAAUGGAUAGA | 1118 |
| 54790_1_526 | + | chr4: 105148942-105148962 | UUGCUUUAAUCAUUGAUACG | 1119 |
| 54790_1_528 | + | chr4: 105148943-105148963 | UGCUUUAAUCAUUGAUACGU | 1120 |
| 54790_1_529 | + | chr4: 105148944-105148964 | GCUUUAAUCAUUGAUACGUG | 1121 |
| 54790_1_537 | + | chr4: 105148965-105148985 | GGUUCUUUCACAUGAUUACA | 1122 |
| 54790_1_539 | + | chr4: 105148966-105148986 | GUUCUUUCACAUGAUUACAA | 1123 |
| 54790_1_547 | + | chr4: 105148989-105149009 | AGAAGCAUUACUCAUCUCUG | 1124 |
| 54790_1_551 | + | chr4: 105149000-105149020 | UCAUCUCUGUGGAAUAGAAA | 1125 |
| 54790_1_552 | + | chr4: 105149008-105149028 | GUGGAAUAGAAACGGUUCAU | 1126 |
| 54790_1_561 | + | chr4: 105149047-105149067 | CUAAAAUUAAAACAAAAAUU | 1127 |
| 54790_1_564 | + | chr4: 105149072-105149092 | UUUACCAUUAAUGCUGUUCA | 1128 |
| 54790_1_573 | + | chr4: 105149094-105149114 | GUAAACUAUCGAGAAAACUA | 1129 |
| 54790_1_587 | + | chr4: 105149162-105149182 | ACAAACUAAUAUUUACUUUU | 1130 |
| 54790_1_589 | + | chr4: 105149163-105149183 | CAAACUAAUAUUUACUUUUU | 1131 |
| 54790_1_590 | + | chr4: 105149164-105149184 | AAACUAAUAUUUACUUUUUG | 1132 |
| 54790_1_597 | + | chr4: 105149185-105149205 | GGACAACUUUUCAAAUGUUG | 1133 |
| 54790_1_601 | + | chr4: 105149202-105149222 | UUGUGGUAUAUACUGUCUUC | 1134 |
| 54790_1_609 | + | chr4: 105149262-105149282 | AUAAAUAAGAAUAACUACAU | 1135 |
| 54790_1_614 | + | chr4: 105149290-105149310 | AAUUUGAAUACAACUAUGA | 1136 |
| 54790_1_638 | + | chr4: 105149401-105149421 | AAAGUAUUUCAGUGAUUAUA | 1137 |
| 54790_1_645 | + | chr4: 105149438-105149458 | UUAGUCACUUUAUCCUUUGU | 1138 |
| 54790_1_658 | + | chr4: 105149466-105149486 | AGAAAUUAUUUUAAUAAGUA | 1139 |
| 54790_1_659 | + | chr4: 105149467-105149487 | GAAAUUAUUUUAAUAAGUAU | 1140 |
| 54790_1_660 | + | chr4: 105149468-105149488 | AAAUUAUUUUAAUAAGUAUG | 1141 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_672 | + | chr4: 105149533-105149553 | UAUAUGUGAUCAUACUACCU | 1142 |
| 54790_1_674 | + | chr4: 105149553-105149573 | AGGUGCUCCAAAAAUUCCAU | 1143 |
| 54790_1_676 | + | chr4: 105149563-105149583 | AAAAUUCCAUAGGACUGUCU | 1144 |
| 54790_1_677 | + | chr4: 105149564-105149584 | AAAUUCCAUAGGACUGUCUU | 1145 |
| 54790_1_682 | + | chr4: 105149579-105149599 | GUCUUGGGUUAUUGAAUUUU | 1146 |
| 54790_1_686 | + | chr4: 105149592-105149612 | GAAUUUUAGGAACAUGAUAA | 1147 |
| 54790_1_721 | + | chr4: 105149739-105149759 | UAUUUGCCAAACUCUUCUUA | 1148 |
| 54790_1_724 | + | chr4: 105149750-105149770 | CUCUUCUUAAGGCUUUAAUU | 1149 |
| 54790_1_732 | + | chr4: 105149780-105149800 | UGCCAGUUUAUGCCAGAAGC | 1150 |
| 54790_1_735 | + | chr4: 105149783-105149803 | CAGUUUAUGCCAGAAGCCGG | 1151 |
| 54790_1_740 | + | chr4: 105149802-105149822 | GAGGAAUUGAUAUGAUUUUG | 1152 |
| 54790_1_741 | + | chr4: 105149808-105149828 | UUGAUAUGAUUUUGAGGCAG | 1153 |
| 54790_1_743 | + | chr4: 105149815-105149835 | GAUUUUGAGGCAGUGGCACA | 1154 |
| 54790_1_747 | + | chr4: 105149831-105149851 | CACAUGGUCCUACUAGACAU | 1155 |
| 54790_1_755 | + | chr4: 105149876-105149896 | CAAGUGAAGUGCACCUGCCA | 1156 |
| 54790_1_762 | + | chr4: 105149910-105149930 | AAGAAUUCCAAAGUCCUUAU | 1157 |
| 54790_1_763 | + | chr4: 105149911-105149931 | AGAAUUCCAAAGUCCUUAUU | 1158 |
| 54790_1_764 | + | chr4: 105149917-105149937 | CCAAAGUCCUUAUUGGGCAC | 1159 |
| 54790_1_767 | + | chr4: 105149929-105149949 | UUGGGCACUGGUCUUGUAUU | 1160 |
| 54790_1_771 | + | chr4: 105149942-105149962 | UUGUAUUAGGUAACAACAAC | 1161 |
| 54790_1_796 | + | chr4: 105150097-105150117 | AAGCCCUUCUUAUGAUUCAU | 1162 |
| 54790_1_806 | + | chr4: 105150146-105150166 | AUCCUGCCCAAAGUCUGAGU | 1163 |
| 54790_1_817 | + | chr4: 105150205-105150225 | UAAAAUAUCUUCAAAAGUUA | 1164 |
| 54790_1_856 | + | chr4: 105150368-105150388 | AUCUAGCAAUUUCAAAUCGC | 1165 |
| 54790_1_867 | + | chr4: 105150434-105150454 | AAUGUUAUUGUUUCCUACCU | 1166 |
| 54790_1_872 | + | chr4: 105150435-105150455 | AUGUUAUUGUUUCCUACCUU | 1167 |
| 54790_1_874 | + | chr4: 105150441-105150461 | UUGUUUCCUACCUUGGGAAC | 1168 |
| 54790_1_879 | + | chr4: 105150453-105150473 | UUGGGAACAGGCUAAAACUU | 1169 |
| 54790_1_893 | + | chr4: 105150529-105150549 | CCAUUGCACAGUAGUUCUUA | 1170 |
| 54790_1_895 | + | chr4: 105150539-105150559 | GUAGUUCUUAAGGAUAGUAA | 1171 |
| 54790_1_902 | + | chr4: 105150589-105150609 | UCCCAAGCCAACUUUACAAU | 1172 |
| 54790_1_904 | + | chr4: 105150603-105150623 | UACAAUUGGAGCCUUCACUG | 1173 |
| 54790_1_907 | + | chr4: 105150604-105150624 | ACAAUUGGAGCCUUCACUGU | 1174 |
| 54790_1_913 | + | chr4: 105150630-105150650 | GACCAGUUGCCAAGUAGAGC | 1175 |
| 54790_1_914 | + | chr4: 105150633-105150653 | CAGUUGCCAAGUAGAGCUGG | 1176 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_917 | + | chr4: 105150641-105150661 | AAGUAGAGCUGGUGGUUAUC | 1177 |
| 54790_1_919 | + | chr4: 105150642-105150662 | AGUAGAGCUGGUGGUUAUCU | 1178 |
| 54790_1_926 | + | chr4: 105150701-105150721 | CCAAAUAUACAGUAUUUACU | 1179 |
| 54790_1_939 | + | chr4: 105150768-105150788 | GAAUACUGUGACAUUAUUGA | 1180 |
| 54790_1_941 | + | chr4: 105150771-105150791 | UACUGUGACAUUAUUGAAGG | 1181 |
| 54790_1_944 | + | chr4: 105150791-105150811 | AGGUUAUGCAGUACAUCUGU | 1182 |
| 54790_1_945 | + | chr4: 105150796-105150816 | AUGCAGUACAUCUGUUGGUU | 1183 |
| 54790_1_948 | + | chr4: 105150807-105150827 | CUGUUGGUUUGGUAUAUAGU | 1184 |
| 54790_1_954 | + | chr4: 105150815-105150835 | UUGGUAUAUAGUAGGAGAGA | 1185 |
| 54790_1_955 | + | chr4: 105150816-105150836 | UGGUAUAUAGUAGGAGAGAA | 1186 |
| 54790_1_960 | + | chr4: 105150823-105150843 | UAGUAGGAGAGAAGGGUUCC | 1187 |
| 54790_1_963 | + | chr4: 105150826-105150846 | UAGGAGAGAAGGGUUCCAGG | 1188 |
| 54790_1_964 | + | chr4: 105150827-105150847 | AGGAGAGAAGGGUUCCAGGA | 1189 |
| 54790_1_968 | + | chr4: 105150832-105150852 | AGAAGGGUUCCAGGAGGGAA | 1190 |
| 54790_1_969 | + | chr4: 105150833-105150853 | GAAGGGUUCCAGGAGGGAAA | 1191 |
| 54790_1_971 | + | chr4: 105150834-105150854 | AAGGGUUCCAGGAGGGAAAG | 1192 |
| 54790_1_994 | + | chr4: 105150989-105151009 | UUCUCAAAAGAAUAGAUAUU | 1193 |
| 54790_1_1002 | + | chr4: 105151016-105151036 | CCAUUCCAAAUAACAAAUUU | 1194 |
| 54790_1_1004 | + | chr4: 105151020-105151040 | UCCAAAUAACAAAUUUUGGA | 1195 |
| 54790_1_1005 | + | chr4: 105151021-105151041 | CCAAAUAACAAAUUUUGGAU | 1196 |
| 54790_1_1007 | + | chr4: 105151026-105151046 | UAACAAAUUUUGGAUGGGCG | 1197 |
| 54790_1_1013 | + | chr4: 105151056-105151076 | UGCCUGUAAUCCUAGCACUU | 1198 |
| 54790_1_1014 | + | chr4: 105151057-105151077 | GCCUGUAAUCCUAGCACUUU | 1199 |
| 54790_1_1016 | + | chr4: 105151060-105151080 | UGUAAUCCUAGCACUUUGGG | 1200 |
| 54790_1_1017 | + | chr4: 105151066-105151086 | CCUAGCACUUUGGGAGGCCA | 1201 |
| 54790_1_1023 | + | chr4: 105151083-105151103 | CCAAGGUGAGAGAUCACUUG | 1202 |
| 54790_1_1025 | + | chr4: 105151088-105151108 | GUGAGAGAUCACUUGAGGCC | 1203 |
| 54790_1_1030 | + | chr4: 105151106-105151126 | CCAGGAGUUUGAAACCACCC | 1204 |
| 54790_1_1031 | + | chr4: 105151107-105151127 | CAGGAGUUUGAAACCACCCU | 1205 |
| 54790_1_1034 | + | chr4: 105151120-105151140 | CCACCCUGGGCAACACAGUC | 1206 |
| 54790_1_1037 | + | chr4: 105151155-105151175 | CAAAAAUUUAAAAAGUUAG | 1207 |
| 54790_1_1038 | + | chr4: 105151156-105151176 | AAAAAUUUAAAAAGUUAGU | 1208 |
| 54790_1_1039 | + | chr4: 105151157-105151177 | AAAAUUUAAAAAGUUAGUG | 1209 |
| 54790_1_1040 | + | chr4: 105151162-105151182 | UUUAAAAAGUUAGUGGGGCA | 1210 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_1041 | + | chr4: 105151165-105151185 | AAAAAGUUAGUGGGGCAUGG | 1211 |
| 54790_1_1046 | + | chr4: 105151193-105151213 | UCCUGUAGUCCCAGCUACUC | 1212 |
| 54790_1_1051 | + | chr4: 105151206-105151226 | GCUACUCAGGAGACUGAGAU | 1213 |
| 54790_1_1054 | + | chr4: 105151209-105151229 | ACUCAGGAGACUGAGAUAGG | 1214 |
| 54790_1_1056 | + | chr4: 105151213-105151233 | AGGAGACUGAGAUAGGAGGA | 1215 |
| 54790_1_1062 | + | chr4: 105151275-105151295 | ACACCACUGCGCUCCAGCCC | 1216 |
| 54790_1_1066 | + | chr4: 105151282-105151302 | UGCGCUCCAGCCCAGGCAAG | 1217 |
| 54790_1_1068 | + | chr4: 105151283-105151303 | GCGCUCCAGCCCAGGCAAGA | 1218 |
| 54790_1_1085 | + | chr4: 105151426-105151446 | AAAAGAAGAAACAGAUAGU | 1219 |
| 54790_1_1088 | + | chr4: 105151429-105151449 | AAGAAGAAACAGAUAGUAGG | 1220 |
| 54790_1_1100 | + | chr4: 105151548-105151568 | GUUUUAAGAAUUCAGAACUC | 1221 |
| 54790_1_1102 | + | chr4: 105151553-105151573 | AAGAAUUCAGAACUCAGGCC | 1222 |
| 54790_1_1105 | + | chr4: 105151558-105151578 | UUCAGAACUCAGGCCAGGUG | 1223 |
| 54790_1_1106 | + | chr4: 105151561-105151581 | AGAACUCAGGCCAGGUGUGG | 1224 |
| 54790_1_1110 | + | chr4: 105151571-105151591 | CCAGGUGUGGUGGCUCAUUC | 1225 |
| 54790_1_1112 | + | chr4: 105151572-105151592 | CAGGUGUGGUGGCUCAUUCU | 1226 |
| 54790_1_1114 | + | chr4: 105151575-105151595 | GUGUGGUGGCUCAUUCUGGG | 1227 |
| 54790_1_1116 | + | chr4: 105151576-105151596 | UGUGGUGGCUCAUUCUGGGA | 1228 |
| 54790_1_1119 | + | chr4: 105151577-105151597 | GUGGUGGCUCAUUCUGGGAG | 1229 |
| 54790_1_1120 | + | chr4: 105151581-105151601 | UGGCUCAUUCUGGGAGGGGA | 1230 |
| 54790_1_1123 | + | chr4: 105151585-105151605 | UCAUUCUGGGAGGGGAAGGC | 1231 |
| 54790_1_1125 | + | chr4: 105151588-105151608 | UUCUGGGAGGGGAAGGCAGG | 1232 |
| 54790_1_1128 | + | chr4: 105151599-105151619 | GAAGGCAGGAGGAUCACUUG | 1233 |
| 54790_1_1132 | + | chr4: 105151622-105151642 | CCAGAAGUUCUAGACCAGCC | 1234 |
| 54790_1_1133 | + | chr4: 105151623-105151643 | CAGAAGUUCUAGACCAGCCU | 1235 |
| 54790_1_1152 | + | chr4: 105151771-105151791 | GAGAAUUAAAGUAAGAGACG | 1236 |
| 54790_1_1153 | + | chr4: 105151775-105151795 | AUUAAAGUAAGAGACGAGGC | 1237 |
| 54790_1_1155 | + | chr4: 105151781-105151801 | GUAAGAGACGAGGCCGGUUG | 1238 |
| 54790_1_1156 | + | chr4: 105151784-105151804 | AGAGACGAGGCCGGUUGUGG | 1239 |
| 54790_1_1160 | + | chr4: 105151811-105151831 | UGCCUGUAAUCCCAGCACUU | 1240 |
| 54790_1_1161 | + | chr4: 105151812-105151832 | GCCUGUAAUCCCAGCACUUU | 1241 |
| 54790_1_1162 | + | chr4: 105151821-105151841 | CCCAGCACUUUGGGACGACA | 1242 |
| 54790_1_1163 | + | chr4: 105151825-105151845 | GCACUUUGGGACGACAAGGC | 1243 |
| 54790_1_1165 | + | chr4: 105151828-105151848 | CUUUGGGACGACAAGGCAGG | 1244 |
| 54790_1_1169 | + | chr4: 105151839-105151859 | CAAGGCAGGUGGAUGACCUG | 1245 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_1171 | + | chr4: 105151844-105151864 | CAGGUGGAUGACCUGAGGUC | 1246 |
| 54790_1_1174 | + | chr4: 105151862-105151882 | UCAGGAGUUUGAGACCAGCC | 1247 |
| 54790_1_1175 | + | chr4: 105151871-105151891 | UGAGACCAGCCUGGCCAACA | 1248 |
| 54790_1_1180 | + | chr4: 105151910-105151930 | CUAAAAAUACAAAAAUUAGC | 1249 |
| 54790_1_1181 | + | chr4: 105151911-105151931 | UAAAAAUACAAAAAUUAGCC | 1250 |
| 54790_1_1182 | + | chr4: 105151916-105151936 | AUACAAAAAUUAGCCGGGCA | 1251 |
| 54790_1_1183 | + | chr4: 105151919-105151939 | CAAAAAUUAGCCGGGCAUGG | 1252 |
| 54790_1_1187 | + | chr4: 105151947-105151967 | ACCAGUAAUCCCAGCUACUC | 1253 |
| 54790_1_1188 | + | chr4: 105151950-105151970 | AGUAAUCCCAGCUACUCAGG | 1254 |
| 54790_1_1190 | + | chr4: 105151956-105151976 | CCCAGCUACUCAGGAGGCUG | 1255 |
| 54790_1_1196 | + | chr4: 105151978-105151998 | GCCCGAGAAUCACUUGAGCC | 1256 |
| 54790_1_1197 | + | chr4: 105151979-105151999 | CCCGAGAAUCACUUGAGCCU | 1257 |
| 54790_1_1198 | + | chr4: 105151984-105152004 | GAAUCACUUGAGCCUGGGCA | 1258 |
| 54790_1_1199 | + | chr4: 105151987-105152007 | UCACUUGAGCCUGGGCAUGG | 1259 |
| 54790_1_1203 | + | chr4: 105152014-105152034 | UACCUAUAAUCCCAGCACUU | 1260 |
| 54790_1_1204 | + | chr4: 105152015-105152035 | ACCUAUAAUCCCAGCACUUU | 1261 |
| 54790_1_1206 | + | chr4: 105152018-105152038 | UAUAAUCCCAGCACUUUGGG | 1262 |
| 54790_1_1208 | + | chr4: 105152024-105152044 | CCCAGCACUUUGGGAGGCCG | 1263 |
| 54790_1_1209 | + | chr4: 105152028-105152048 | GCACUUUGGGAGGCCGAGGC | 1264 |
| 54790_1_1211 | + | chr4: 105152031-105152051 | CUUUGGGAGGCCGAGGCAGG | 1265 |
| 54790_1_1215 | + | chr4: 105152047-105152067 | CAGGUGGAUCACCUGACGUC | 1266 |
| 54790_1_1218 | + | chr4: 105152065-105152085 | UCAGGAAUUCGAGACCAGUC | 1267 |
| 54790_1_1219 | + | chr4: 105152074-105152094 | CGAGACCAGUCUGGCCAACA | 1268 |
| 54790_1_1223 | + | chr4: 105152112-105152132 | ACUAAACAUACAAAAUUAGC | 1269 |
| 54790_1_1224 | + | chr4: 105152113-105152133 | CUAAACAUACAAAAUUAGCU | 1270 |
| 54790_1_1225 | + | chr4: 105152118-105152138 | CAUACAAAAUUAGCUGGGUG | 1271 |
| 54790_1_1226 | + | chr4: 105152121-105152141 | ACAAAAUUAGCUGGGUGUGG | 1272 |
| 54790_1_1229 | + | chr4: 105152149-105152169 | GCCUGUAGUCUCAGCUAUUC | 1273 |
| 54790_1_1231 | + | chr4: 105152152-105152172 | UGUAGUCUCAGCUAUUCUGG | 1274 |
| 54790_1_1234 | + | chr4: 105152162-105152182 | GCUAUUCUGGAGGCUGAUAC | 1275 |
| 54790_1_1241 | + | chr4: 105152184-105152204 | GAGAAUUGCUUGAACCCUCC | 1276 |
| 54790_1_1243 | + | chr4: 105152185-105152205 | AGAAUUGCUUGAACCCUCCC | 1277 |
| 54790_1_1244 | + | chr4: 105152188-105152208 | AUUGCUUGAACCCUCCCGGG | 1278 |
| 54790_1_1247 | + | chr4: 105152194-105152214 | UGAACCCUCCCGGGAGGCAG | 1279 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_1249 | + | chr4: 105152200-105152220 | CUCCCGGGAGGCAGAGGCUG | 1280 |
| 54790_1_1252 | + | chr4: 105152213-105152233 | GAGGCUGCGGUGAGCCGAGA | 1281 |
| 54790_1_1254 | + | chr4: 105152234-105152254 | GGCUCUGCUGCACUCCAGCC | 1282 |
| 54790_1_1255 | + | chr4: 105152235-105152255 | GCUCUGCUGCACUCCAGCCU | 1283 |
| 54790_1_1257 | + | chr4: 105152240-105152260 | GCUGCACUCCAGCCUGGGCG | 1284 |
| 54790_1_1263 | + | chr4: 105152287-105152307 | GAAAAAUAAUAAUAAUAAAU | 1285 |
| 54790_1_1267 | + | chr4: 105152302-105152322 | UAAAUAGGAGAUGAAUAAAU | 1286 |
| 54790_1_1269 | + | chr4: 105152303-105152323 | AAAUAGGAGAUGAAUAAAUU | 1287 |
| 54790_1_1272 | + | chr4: 105152321-105152341 | UUGGGAUAAAGUGUUUUUGA | 1288 |
| 54790_1_1275 | + | chr4: 105152331-105152351 | GUGUUUUUGAAGGACAGUCU | 1289 |
| 54790_1_1281 | + | chr4: 105152347-105152367 | GUCUAGGAUAUAAAAUGAAC | 1290 |
| 54790_1_1290 | + | chr4: 105152408-105152428 | UACAUUUCUUUUUUGUCUAU | 1291 |
| 54790_1_1293 | + | chr4: 105152412-105152432 | UUUCUUUUUUGUCUAUUGGA | 1292 |
| 54790_1_1296 | + | chr4: 105152416-105152436 | UUUUUUGUCUAUUGGAAGGU | 1293 |
| 54790_1_1310 | + | chr4: 105152484-105152504 | ACCUCUCAGUCAAUAUUUAA | 1294 |
| 54790_1_1339 | + | chr4: 105152599-105152619 | UUUUUUUUUUUUUUUUGAGA | 1295 |
| 54790_1_1356 | + | chr4: 105152620-105152640 | GGUAUCUUGCUCUGUCACCU | 1296 |
| 54790_1_1359 | + | chr4: 105152624-105152644 | UCUUGCUCUGUCACCUAGGC | 1297 |
| 54790_1_1361 | + | chr4: 105152634-105152654 | UCACCUAGGCUGGAGUGCAG | 1298 |
| 54790_1_1362 | + | chr4: 105152645-105152665 | GGAGUGCAGUGGUGUGAUCU | 1299 |
| 54790_1_1363 | + | chr4: 105152670-105152690 | CACUGCAACCUCUGCCUUCC | 1300 |
| 54790_1_1369 | + | chr4: 105152708-105152728 | UUCUCAGCCCCCAGAGUAGC | 1301 |
| 54790_1_1371 | + | chr4: 105152709-105152729 | UCUCAGCCCCCAGAGUAGCU | 1302 |
| 54790_1_1375 | + | chr4: 105152715-105152735 | CCCCCAGAGUAGCUGGGACU | 1303 |
| 54790_1_1377 | + | chr4: 105152736-105152756 | GGAGCGUGCCCCACCACACC | 1304 |
| 54790_1_1380 | + | chr4: 105152765-105152785 | UUUCUAUUUUUAUUAGAGAC | 1305 |
| 54790_1_1381 | + | chr4: 105152766-105152786 | UUCUAUUUUUAUUAGAGACA | 1306 |
| 54790_1_1390 | + | chr4: 105152780-105152800 | GAGACAGGGUUUCACCAUGU | 1307 |
| 54790_1_1392 | + | chr4: 105152785-105152805 | AGGGUUUCACCAUGUUGGCC | 1308 |
| 54790_1_1396 | + | chr4: 105152803-105152823 | CCAGGCUGAUCUCGUACUCC | 1309 |
| 54790_1_1397 | + | chr4: 105152810-105152830 | GAUCUCGUACUCCUGGUCUC | 1310 |
| 54790_1_1399 | + | chr4: 105152826-105152846 | UCUCAGGUGAUCUGCCUGCC | 1311 |
| 54790_1_1400 | + | chr4: 105152827-105152847 | CUCAGGUGAUCUGCCUGCCC | 1312 |
| 54790_1_1402 | + | chr4: 105152843-105152863 | GCCCGGGUCUCCCAAAGUGC | 1313 |
| 54790_1_1404 | + | chr4: 105152844-105152864 | CCCGGGUCUCCCAAAGUGCU | 1314 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_1405 | + | chr4: 105152852-105152872 | UCCCAAAGUGCUGGGAUUAC | 1315 |
| 54790_1_1407 | + | chr4: 105152871-105152891 | CAGGCAUGAGCCACUGCACC | 1316 |
| 54790_1_1415 | + | chr4: 105152920-105152940 | AAAAAUAGUGUUAAGUGUCU | 1317 |
| 54790_1_1416 | + | chr4: 105152926-105152946 | AGUGUUAAGUGUCUUGGUGA | 1318 |
| 54790_1_1418 | + | chr4: 105152935-105152955 | UGUCUUGGUGAUGGUGAUGA | 1319 |
| 54790_1_1421 | + | chr4: 105152939-105152959 | UUGGUGAUGGUGAUGAUGGU | 1320 |
| 54790_1_1423 | + | chr4: 105152947-105152967 | GGUGAUGAUGGUAGGAGUAA | 1321 |
| 54790_1_1424 | + | chr4: 105152977-105152997 | UCCUUACAUUUAAUUUCUAC | 1322 |
| 54790_1_1428 | + | chr4: 105152983-105153003 | CAUUUAAUUUCUACAGGCUA | 1323 |
| 54790_1_1436 | + | chr4: 105153029-105153049 | AUUUUAAGCACAAAAGUGAA | 1324 |
| 54790_1_1442 | + | chr4: 105153049-105153069 | UGGUUUUUAGUAAACUUAUA | 1325 |
| 54790_1_1443 | + | chr4: 105153050-105153070 | GGUUUUUAGUAAACUUAUAU | 1326 |
| 54790_1_1469 | + | chr4: 105153160-105153180 | ACUUGCUCAAUUUCCCCCAG | 1327 |
| 54790_1_1475 | + | chr4: 105153247-105153267 | CCAUGAUACUGACAUUGAUG | 1328 |
| 54790_1_1526 | + | chr4: 105153484-105153504 | AAGUCCUUUUUUUGAUAGAA | 1329 |
| 54790_1_1546 | + | chr4: 105153567-105153587 | CUCAUCACAACCCUAGAGAU | 1330 |
| 54790_1_1553 | + | chr4: 105153597-105153617 | CUUAUCCCUAUUUAUGAGUG | 1331 |
| 54790_1_1560 | + | chr4: 105153616-105153636 | GAGGAAACUGAAGCCCAGUG | 1332 |
| 54790_1_1563 | + | chr4: 105153654-105153674 | AAGUUCAUACAGCCUAUACA | 1333 |
| 54790_1_1565 | + | chr4: 105153660-105153680 | AUACAGCCUAUACAUGGCUU | 1334 |
| 54790_1_1581 | + | chr4: 105153766-105153786 | AGCUGUAAAAGUGUAUAAUG | 1335 |
| 54790_1_1587 | + | chr4: 105153791-105153811 | UAUGUAGAGAAAGUCAUAAA | 1336 |
| 54790_1_1594 | + | chr4: 105153864-105153884 | CAUUACAGCAUUAUUAAUAA | 1337 |
| 54790_1_1599 | + | chr4: 105153874-105153894 | UUAUUAAUAAUGGUAAAAAA | 1338 |
| 54790_1_1604 | + | chr4: 105153922-105153942 | AUGAGUGAAUAAACAAAUUG | 1339 |
| 54790_1_1609 | + | chr4: 105153961-105153981 | AAUAUUAUUAAGUAGUAUAA | 1340 |
| 54790_1_1611 | + | chr4: 105153966-105153986 | UAUUAAGUAGUAUAAAGGAA | 1341 |
| 54790_1_1614 | + | chr4: 105153992-105154012 | AUUGAUAAAUGCUGUCACAU | 1342 |
| 54790_1_1620 | + | chr4: 105154005-105154025 | GUCACAUAGGUGAAUCUGAG | 1343 |
| 54790_1_1623 | + | chr4: 105154016-105154036 | GAAUCUGAGAGGCACAAGAA | 1344 |
| 54790_1_1628 | + | chr4: 105154060-105154080 | UUUUAAGUAACGUCCAGAAU | 1345 |
| 54790_1_1633 | + | chr4: 105154071-105154091 | GUCCAGAAUAGGCAAAUCUA | 1346 |
| 54790_1_1637 | + | chr4: 105154085-105154105 | AAUCUAAGGAGACAGAAAGU | 1347 |
| 54790_1_1639 | + | chr4: 105154100-105154120 | AAAGUUGGCUAGUUAUUACU | 1348 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_1641 | + | chr4: 105154101-105154121 | AAGUUGGCUAGUUAUUACUA | 1349 |
| 54790_1_1642 | + | chr4: 105154102-105154122 | AGUUGGCUAGUUAUUACUAG | 1350 |
| 54790_1_1646 | + | chr4: 105154107-105154127 | GCUAGUUAUUACUAGGGGCU | 1351 |
| 54790_1_1647 | + | chr4: 105154108-105154128 | CUAGUUAUUACUAGGGGCUA | 1352 |
| 54790_1_1650 | + | chr4: 105154112-105154132 | UUAUUACUAGGGGCUAGGGA | 1353 |
| 54790_1_1651 | + | chr4: 105154113-105154133 | UAUUACUAGGGGCUAGGGAU | 1354 |
| 54790_1_1655 | + | chr4: 105154116-105154136 | UACUAGGGGCUAGGGAUGGG | 1355 |
| 54790_1_1657 | + | chr4: 105154117-105154137 | ACUAGGGGCUAGGGAUGGGA | 1356 |
| 54790_1_1660 | + | chr4: 105154120-105154140 | AGGGGCUAGGGAUGGGAGGG | 1357 |
| 54790_1_1662 | + | chr4: 105154151-105154171 | AAUAAGUAUGAGAUUUCUUU | 1358 |
| 54790_1_1678 | + | chr4: 105154240-105154260 | ACUGAAUUAUAUGCUUUAAA | 1359 |
| 54790_1_1694 | + | chr4: 105154312-105154332 | AUGAAUGUAGUUGAGUUAUU | 1360 |
| 54790_1_1711 | + | chr4: 105154362-105154382 | AUCUCAUGCAAAAGAAAUGC | 1361 |
| 54790_1_1713 | + | chr4: 105154372-105154392 | AAAGAAAUGCAGGAACUAUU | 1362 |
| 54790_1_1716 | + | chr4: 105154383-105154403 | GGAACUAUUUGGAUUGAAUG | 1363 |
| 54790_1_1721 | + | chr4: 105154402-105154422 | GAGGCUAAGCAUAUCUUUCU | 1364 |
| 54790_1_1723 | + | chr4: 105154409-105154429 | AGCAUAUCUUUCUAGGAAGA | 1365 |
| 54790_1_1726 | + | chr4: 105154417-105154437 | UUUCUAGGAAGAUGGCAUCA | 1366 |
| 54790_1_1729 | + | chr4: 105154442-105154462 | UUUUAUUAUGCCUGUAAUCC | 1367 |
| 54790_1_1734 | + | chr4: 105154450-105154470 | UGCCUGUAAUCCUGGCACUU | 1368 |
| 54790_1_1738 | + | chr4: 105154451-105154471 | GCCUGUAAUCCUGGCACUUU | 1369 |
| 54790_1_1739 | + | chr4: 105154454-105154474 | UGUAAUCCUGGCACUUUGGG | 1370 |
| 54790_1_1740 | + | chr4: 105154460-105154480 | CCUGGCACUUUGGGAGGCCA | 1371 |
| 54790_1_1743 | + | chr4: 105154463-105154483 | GGCACUUUGGGAGGCCAAGG | 1372 |
| 54790_1_1744 | + | chr4: 105154464-105154484 | GCACUUUGGGAGGCCAAGGC | 1373 |
| 54790_1_1751 | + | chr4: 105154490-105154510 | CCAGAAGUUUGAGAUUAGUC | 1374 |
| 54790_1_1752 | + | chr4: 105154491-105154511 | CAGAAGUUUGAGAUUAGUCU | 1375 |
| 54790_1_1759 | + | chr4: 105154516-105154536 | ACAUCCUCUUAUAGAUGAGA | 1376 |
| 54790_1_1761 | + | chr4: 105154539-105154559 | AUACUUAAUCACUCAAAAGU | 1377 |
| 54790_1_1770 | + | chr4: 105154581-105154601 | AAUAGCCUUUAGAGCUCAUA | 1378 |
| 54790_1_1773 | + | chr4: 105154582-105154602 | AUAGCCUUUAGAGCUCAUAU | 1379 |
| 54790_1_1776 | + | chr4: 105154605-105154625 | AAGAUUCAAUAGAUAGUGAU | 1380 |
| 54790_1_1778 | + | chr4: 105154618-105154638 | UAGUGAUAGGUUAUAUGACU | 1381 |
| 54790_1_1781 | + | chr4: 105154626-105154646 | GGUUAUAUGACUUGGUAAAG | 1382 |
| 54790_1_1782 | + | chr4: 105154627-105154647 | GUUAUAUGACUUGGUAAAGA | 1383 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_1785 | + | chr4: 105154640-105154660 | GUAAAGAGGGCUUAAUGUAU | 1384 |
| 54790_1_1793 | + | chr4: 105154690-105154710 | GUUACCUAGCCAUUCAGUUC | 1385 |
| 54790_1_1801 | + | chr4: 105154714-105154734 | GAUGUAACCCAAGUGUUAAA | 1386 |
| 54790_1_1803 | + | chr4: 105154725-105154745 | AGUGUUAAAGGAAUGUGAC | 1387 |
| 54790_1_1804 | + | chr4: 105154726-105154746 | GUGUUAAAGGAAUGUGACU | 1388 |
| 54790_1_1805 | + | chr4: 105154731-105154751 | AAAGGAAUGUGACUGGGUG | 1389 |
| 54790_1_1807 | + | chr4: 105154734-105154754 | AGGAAUGUGACUGGGUGCGG | 1390 |
| 54790_1_1809 | + | chr4: 105154765-105154785 | UGUAAUCCCAGCACUUUGCG | 1391 |
| 54790_1_1811 | + | chr4: 105154768-105154788 | AAUCCCAGCACUUUGCGAGG | 1392 |
| 54790_1_1814 | + | chr4: 105154774-105154794 | AGCACUUUGCGAGGCGGAAG | 1393 |
| 54790_1_1815 | + | chr4: 105154775-105154795 | GCACUUUGCGAGGCGGAAGU | 1394 |
| 54790_1_1817 | + | chr4: 105154778-105154798 | CUUUGCGAGGCGGAAGUGGG | 1395 |
| 54790_1_1818 | + | chr4: 105154779-105154799 | UUUGCGAGGCGGAAGUGGGU | 1396 |
| 54790_1_1824 | + | chr4: 105154794-105154814 | UGGGUGGGUCUCUUGAGCUC | 1397 |
| 54790_1_1827 | + | chr4: 105154800-105154820 | GGUCUCUUGAGCUCAGGAGU | 1398 |
| 54790_1_1830 | + | chr4: 105154812-105154832 | UCAGGAGUUGGAGACAAGCC | 1399 |
| 54790_1_1831 | + | chr4: 105154813-105154833 | CAGGAGUUGGAGACAAGCCU | 1400 |
| 54790_1_1832 | + | chr4: 105154821-105154841 | GGAGACAAGCCUGGGCAACA | 1401 |
| 54790_1_1835 | + | chr4: 105154860-105154880 | CAAAAAUGCACAAAUUAGC | 1402 |
| 54790_1_1836 | + | chr4: 105154861-105154881 | AAAAAUGCACAAAUUAGCU | 1403 |
| 54790_1_1837 | + | chr4: 105154866-105154886 | AUGCACAAAUUAGCUGGGUG | 1404 |
| 54790_1_1838 | + | chr4: 105154869-105154889 | CACAAAUUAGCUGGGUGUGG | 1405 |
| 54790_1_1840 | + | chr4: 105154889-105154909 | UGGCACAUCCCUGUAGUUCC | 1406 |
| 54790_1_1842 | + | chr4: 105154898-105154918 | CCUGUAGUUCCAGGUACUUG | 1407 |
| 54790_1_1844 | + | chr4: 105154899-105154919 | CUGUAGUUCCAGGUACUUGU | 1408 |
| 54790_1_1845 | + | chr4: 105154900-105154920 | UGUAGUUCCAGGUACUUGUG | 1409 |
| 54790_1_1847 | + | chr4: 105154906-105154926 | UCCAGGUACUUGUGGGGCUG | 1410 |
| 54790_1_1850 | + | chr4: 105154909-105154929 | AGGUACUUGUGGGGCUGAGG | 1411 |
| 54790_1_1853 | + | chr4: 105154910-105154930 | GGUACUUGUGGGGCUGAGGC | 1412 |
| 54790_1_1855 | + | chr4: 105154913-105154933 | ACUUGUGGGGCUGAGGCGGG | 1413 |
| 54790_1_1856 | + | chr4: 105154917-105154937 | GUGGGGCUGAGGCGGGAGGA | 1414 |
| 54790_1_1861 | + | chr4: 105154928-105154948 | GCGGGAGGAUGGCUCGAGCC | 1415 |
| 54790_1_1862 | + | chr4: 105154929-105154949 | CGGGAGGAUGGCUCGAGCCU | 1416 |
| 54790_1_1865 | + | chr4: 105154938-105154958 | GGCUCGAGCCUGGGAAGUUG | 1417 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_1867 | + | chr4: 105154957-105154977 | GAGGCUGCAGUGAGCCAUGU | 1418 |
| 54790_1_1870 | + | chr4: 105154978-105154998 | GGUGCCCCCACACUUCAGCC | 1419 |
| 54790_1_1871 | + | chr4: 105154979-105154999 | GUGCCCCCACACUUCAGCCU | 1420 |
| 54790_1_1887 | + | chr4: 105155091-105155111 | UAAUAACAAAUUACUAGAUU | 1421 |
| 54790_1_1889 | + | chr4: 105155092-105155112 | AAUAACAAAUUACUAGAUUU | 1422 |
| 54790_1_1890 | + | chr4: 105155093-105155113 | AUAACAAAUUACUAGAUUUG | 1423 |
| 54790_1_1892 | + | chr4: 105155094-105155114 | UAACAAAUUACUAGAUUUGG | 1424 |
| 54790_1_1893 | + | chr4: 105155095-105155115 | AACAAAUUACUAGAUUUGGG | 1425 |
| 54790_1_1902 | + | chr4: 105155128-105155148 | CUUAUCUAUGUGAAAACAGA | 1426 |
| 54790_1_1903 | + | chr4: 105155129-105155149 | UUAUCUAUGUGAAAACAGAA | 1427 |
| 54790_1_1906 | + | chr4: 105155138-105155158 | UGAAAACAGAAGGGCAAUGC | 1428 |
| 54790_1_1907 | + | chr4: 105155139-105155159 | GAAAACAGAAGGGCAAUGCA | 1429 |
| 54790_1_1927 | + | chr4: 105155237-105155257 | AAAAUGACAAAGUAUCUCAU | 1430 |
| 54790_1_1928 | + | chr4: 105155238-105155258 | AAAUGACAAAGUAUCUCAUA | 1431 |
| 54790_1_1932 | + | chr4: 105155278-105155298 | UUUCCUGUUAACUGAUACUG | 1432 |
| 54790_1_1938 | + | chr4: 105155301-105155321 | CAUGUUGAAGAUGUAAAAUA | 1433 |
| 54790_1_1943 | + | chr4: 105155310-105155330 | GAUGUAAAAUAAGGUUGAAA | 1434 |
| 54790_1_1948 | + | chr4: 105155343-105155363 | GCAGCAGUCUUCAUAAUGCC | 1435 |
| 54790_1_1955 | + | chr4: 105155360-105155380 | GCCAGGACAAAGUGAGAAAC | 1436 |
| 54790_1_1956 | + | chr4: 105155361-105155381 | CCAGGACAAAGUGAGAAACA | 1437 |
| 54790_1_1959 | + | chr4: 105155376-105155396 | AAACAGGGUCAGAAUGAUGA | 1438 |
| 54790_1_1960 | + | chr4: 105155399-105155419 | CUCUCCAUCUUUGCUACACA | 1439 |
| 54790_1_1966 | + | chr4: 105155448-105155468 | AACUUCUACAAACCACUUAC | 1440 |
| 54790_1_1972 | + | chr4: 105155485-105155505 | AUUUUUAACACUAGUCCCUA | 1441 |
| 54790_1_1978 | + | chr4: 105155506-105155526 | GGAACUAUGACUUGUAGUUU | 1442 |
| 54790_1_1980 | + | chr4: 105155515-105155535 | ACUUGUAGUUUUGGACACAC | 1443 |
| 54790_1_1981 | + | chr4: 105155516-105155536 | CUUGUAGUUUUGGACACACA | 1444 |
| 54790_1_1989 | + | chr4: 105155528-105155548 | GACACACAGGGUGAAUUACU | 1445 |
| 54790_1_1990 | + | chr4: 105155529-105155549 | ACACACAGGGUGAAUUACUU | 1446 |
| 54790_1_1991 | + | chr4: 105155530-105155550 | CACACAGGGUGAAUUACUUG | 1447 |
| 54790_1_2011 | + | chr4: 105155628-105155648 | UUUUAUUCUCAUGAGAAUGC | 1448 |
| 54790_1_2012 | + | chr4: 105155629-105155649 | UUUAUUCUCAUGAGAAUGCU | 1449 |
| 54790_1_2018 | + | chr4: 105155639-105155659 | UGAGAAUGCUGGGUUGCAGC | 1450 |
| 54790_1_2020 | + | chr4: 105155643-105155663 | AAUGCUGGGUUGCAGCCGGU | 1451 |
| 54790_1_2024 | + | chr4: 105155657-105155677 | GCCGGUUGGAUCCCAUACCU | 1452 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_2025 | + | chr4: 105155658-105155678 | CCGGUUGGAUCCCAUACCUU | 1453 |
| 54790_1_2028 | + | chr4: 105155676-105155696 | UUGGGACCAUGACUGAUAAC | 1454 |
| 54790_1_2033 | + | chr4: 105155681-105155701 | ACCAUGACUGAUAACUGGAG | 1455 |
| 54790_1_2038 | + | chr4: 105155700-105155720 | GUGGAGAAAAUUCACUGAUC | 1456 |
| 54790_1_2039 | + | chr4: 105155705-105155725 | GAAAAUUCACUGAUCUGGAA | 1457 |
| 54790_1_2043 | + | chr4: 105155717-105155737 | AUCUGGAAAGGUUGAGCUUU | 1458 |
| 54790_1_2044 | + | chr4: 105155718-105155738 | UCUGGAAAGGUUGAGCUUUA | 1459 |
| 54790_1_2047 | + | chr4: 105155737-105155757 | AGGGUUCAGAGACUUAUUUA | 1460 |
| 54790_1_2055 | + | chr4: 105155763-105155783 | ACAUGUGAUUGUACCCAAUA | 1461 |
| 54790_1_2058 | + | chr4: 105155774-105155794 | UACCCAAUAAGGAAGUAUAU | 1462 |
| 54790_1_2077 | + | chr4: 105155861-105155881 | UGAUCAUAGCAUCUACUUGU | 1463 |
| 54790_1_2086 | + | chr4: 105155923-105155943 | UGUUAGACCCAUUAAGAAGU | 1464 |
| 54790_1_2088 | + | chr4: 105155934-105155954 | UUAAGAAGUUGGUGUAGUGA | 1465 |
| 54790_1_2092 | + | chr4: 105155940-105155960 | AGUUGGUGUAGUGAUGGUUA | 1466 |
| 54790_1_2097 | + | chr4: 105155963-105155983 | AAAGCAGUAAGAUAGAAUUU | 1467 |
| 54790_1_2100 | + | chr4: 105155981-105156001 | UUAGGUUCUGUUCUCCUUAC | 1468 |
| 54790_1_2138 | + | chr4: 105156175-105156195 | UAAAUCUGUUCUCGCAUAUU | 1469 |
| 54790_1_2158 | + | chr4: 105156235-105156255 | UUAUAAGUAAUUUAUACAGA | 1470 |
| 54790_1_2168 | + | chr4: 105156263-105156283 | CAUAUUCAAAAGAAGAAAAA | 1471 |
| 54790_1_2169 | + | chr4: 105156264-105156284 | AUAUUCAAAAGAAGAAAAAU | 1472 |
| 54790_1_2178 | + | chr4: 105156301-105156321 | UGAUGUACUACUCUCUUCAA | 1473 |
| 54790_1_2180 | + | chr4: 105156302-105156322 | GAUGUACUACUCUCUUCAAA | 1474 |
| 54790_1_2181 | + | chr4: 105156319-105156339 | AAAGGGAAUUGCCUAUGUUC | 1475 |
| 54790_1_2186 | + | chr4: 105156333-105156353 | AUGUUCAGGCAUAGAAAUGC | 1476 |
| 54790_1_2188 | + | chr4: 105156349-105156369 | AUGCAGGCAGUCUGACAUUU | 1477 |
| 54790_1_2207 | + | chr4: 105156424-105156444 | AUUUGUCACAGUUUGUUCUG | 1478 |
| 54790_1_2208 | + | chr4: 105156425-105156445 | UUUGUCACAGUUUGUUCUGU | 1479 |
| 54790_1_2210 | + | chr4: 105156428-105156448 | GUCACAGUUUGUUCUGUGGG | 1480 |
| 54790_1_2213 | + | chr4: 105156429-105156449 | UCACAGUUUGUUCUGUGGGU | 1481 |
| 54790_1_2216 | + | chr4: 105156441-105156461 | CUGUGGGUGGGUAAAAGUAA | 1482 |
| 54790_1_2231 | + | chr4: 105156546-105156566 | UAAAUCUAGCUUCUAUGUCC | 1483 |
| 54790_1_2239 | + | chr4: 105156585-105156605 | ACAUUCACCCAUCUCUCAAA | 1484 |
| 54790_1_2240 | + | chr4: 105156586-105156606 | CAUUCACCCAUCUCUCAAAU | 1485 |
| 54790_1_2249 | + | chr4: 105156649-105156669 | AAAAGUAAAAAGCUUCAAU | 1486 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_2251 | + | chr4: 105156650-105156670 | AAAGUAAAAAGCUUCAAUA | 1487 |
| 54790_1_2254 | + | chr4: 105156678-105156698 | GAAAGCCAGAUAACAUAGCA | 1488 |
| 54790_1_2262 | + | chr4: 105156726-105156746 | CUUACCUGUCUGCACUAAGA | 1489 |
| 54790_1_2265 | + | chr4: 105156727-105156747 | UUACCUGUCUGCACUAAGAA | 1490 |
| 54790_1_2278 | + | chr4: 105156840-105156860 | CUAUCCAUAACAUACUGUCC | 1491 |
| 54790_1_2310 | + | chr4: 105156941-105156961 | AGAAUUUUUAUAUUUGCCAU | 1492 |
| 54790_1_2323 | + | chr4: 105156995-105157015 | UUCAUUAUAUUUGCAUUAAA | 1493 |
| 54790_1_2373 | + | chr4: 105157234-105157254 | GAAAAGAAGAAUACCAUAAA | 1494 |
| 54790_1_2374 | + | chr4: 105157235-105157255 | AAAAGAAGAAUACCAUAAAU | 1495 |
| 54790_1_2378 | + | chr4: 105157254-105157274 | UGGGUACCUUUCAAAAAUGA | 1496 |
| 54790_1_2394 | + | chr4: 105157346-105157366 | ACAAACAGAUACAUUUUAGC | 1497 |
| 54790_1_2411 | + | chr4: 105157411-105157431 | UUCCAAUCUAGCCACUGAAA | 1498 |
| 54790_1_2422 | + | chr4: 105157463-105157483 | CAUAAGUUGAAUUUAAAACA | 1499 |
| 54790_1_2435 | + | chr4: 105157506-105157526 | UGUCUGCCACAUUACGCUUG | 1500 |
| 54790_1_2437 | + | chr4: 105157517-105157537 | UUACGCUUGUGGAAAAACAC | 1501 |
| 54790_1_2442 | + | chr4: 105157551-105157571 | GCUAAUAGACAUUUUGCUGU | 1502 |
| 54790_1_2446 | + | chr4: 105157567-105157587 | CUGUUGGCUCACCUUAUUAA | 1503 |
| 54790_1_2457 | + | chr4: 105157621-105157641 | GCAAACUUGAAAAGACGUU | 1504 |
| 54790_1_2461 | + | chr4: 105157634-105157654 | AGACGUUUGGUUACUAACUG | 1505 |
| 54790_1_2463 | + | chr4: 105157635-105157655 | GACGUUUGGUUACUAACUGU | 1506 |
| 54790_1_2471 | + | chr4: 105157675-105157695 | UAUUUUUAUUUUUAUUUUU | 1507 |
| 54790_1_2489 | + | chr4: 105157699-105157719 | AGAGUCUCACUCUCUUGCCC | 1508 |
| 54790_1_2492 | + | chr4: 105157703-105157723 | UCUCACUCUCUUGCCCAGGC | 1509 |
| 54790_1_2493 | + | chr4: 105157713-105157733 | UUGCCCAGGCUGGAGUGCAG | 1510 |
| 54790_1_2495 | + | chr4: 105157724-105157744 | GGAGUGCAGUGGCAUGAUCU | 1511 |
| 54790_1_2498 | + | chr4: 105157748-105157768 | UCACUGCAGCCUCCUCCUUC | 1512 |
| 54790_1_2499 | + | chr4: 105157749-105157769 | CACUGCAGCCUCCUCCUUCU | 1513 |
| 54790_1_2505 | + | chr4: 105157788-105157808 | GUCUCAGCCUCCCGAGUAGC | 1514 |
| 54790_1_2507 | + | chr4: 105157789-105157809 | UCUCAGCCUCCCGAGUAGCU | 1515 |
| 54790_1_2508 | + | chr4: 105157797-105157817 | UCCCGAGUAGCUGGGAUUAU | 1516 |
| 54790_1_2510 | + | chr4: 105157816-105157836 | UAGGCACCAGCCACCAUGCC | 1517 |
| 54790_1_2521 | + | chr4: 105157860-105157880 | GAAACAGCGUUUCGCCAUGU | 1518 |
| 54790_1_2522 | + | chr4: 105157865-105157885 | AGCGUUUCGCCAUGUAGGCU | 1519 |
| 54790_1_2523 | + | chr4: 105157869-105157889 | UUUCGCCAUGUAGGCUAGGC | 1520 |
| 54790_1_2529 | + | chr4: 105157923-105157943 | CCUUCUGCUUCCUAAAGUGC | 1521 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_2530 | + | chr4: 105157924-105157944 | CUUCUGCUUCCUAAAGUGCU | 1522 |
| 54790_1_2532 | + | chr4: 105157932-105157952 | UCCUAAAGUGCUGGGAUUAC | 1523 |
| 54790_1_2535 | + | chr4: 105157945-105157965 | GGAUUACAGGCAUGAGCCAU | 1524 |
| 54790_1_2536 | + | chr4: 105157950-105157970 | ACAGGCAUGAGCCAUCGGCC | 1525 |
| 54790_1_2547 | + | chr4: 105158014-105158034 | UUAUUUACUGUUAAAAAAUG | 1526 |
| 54790_1_2553 | + | chr4: 105158040-105158060 | UUAUUUCAAUAAGAUUUUA | 1527 |
| 54790_1_2574 | + | chr4: 105158110-105158130 | ACCAACAUUUUUCAAGAGCA | 1528 |
| 54790_1_2578 | + | chr4: 105158111-105158131 | CCAACAUUUUUCAAGAGCAU | 1529 |
| 54790_1_2582 | + | chr4: 105158120-105158140 | UUCAAGAGCAUGGGAAAUCU | 1530 |
| 54790_1_2584 | + | chr4: 105158121-105158141 | UCAAGAGCAUGGGAAAUCUA | 1531 |
| 54790_1_2587 | + | chr4: 105158126-105158146 | AGCAUGGGAAAUCUAGGGUA | 1532 |
| 54790_1_2592 | + | chr4: 105158158-105158178 | GUGACUUUAAAGACACUUCU | 1533 |
| 54790_1_2593 | + | chr4: 105158159-105158179 | UGACUUUAAAGACACUUCUU | 1534 |
| 54790_1_2630 | + | chr4: 105158269-105158289 | AUUAGUCAUGCCUUAAUCCU | 1535 |
| 54790_1_2631 | + | chr4: 105158270-105158290 | UUAGUCAUGCCUUAAUCCUC | 1536 |
| 54790_1_2632 | + | chr4: 105158271-105158291 | UAGUCAUGCCUUAAUCCUCG | 1537 |
| 54790_1_2635 | + | chr4: 105158278-105158298 | GCCUUAAUCCUCGGGGUUUU | 1538 |
| 54790_1_2638 | + | chr4: 105158279-105158299 | CCUUAAUCCUCGGGGUUUUU | 1539 |
| 54790_1_2642 | + | chr4: 105158293-105158313 | GUUUUUGGGAAACUAUAUUU | 1540 |
| 54790_1_2643 | + | chr4: 105158294-105158314 | UUUUUGGGAAACUAUAUUUA | 1541 |
| 54790_1_2644 | + | chr4: 105158295-105158315 | UUUUGGGAAACUAUAUUUAG | 1542 |
| 54790_1_2655 | + | chr4: 105158338-105158358 | AUUGUAAUUUUCUCAGUAU | 1543 |
| 54790_1_2662 | + | chr4: 105158350-105158370 | CUCAGUAUUGGUAAGAAUUC | 1544 |
| 54790_1_2665 | + | chr4: 105158359-105158379 | GGUAAGAAUUCAGGUGUUUA | 1545 |
| 54790_1_2669 | + | chr4: 105158364-105158384 | GAAUUCAGGUGUUUAAGGAA | 1546 |
| 54790_1_2684 | + | chr4: 105158424-105158444 | GAUAUAAUGAAUGUAGAUGA | 1547 |
| 54790_1_2688 | + | chr4: 105158440-105158460 | AUGAAGGUGAAAUCCGAGAU | 1548 |
| 54790_1_2692 | + | chr4: 105158448-105158468 | GAAAUCCGAGAUAGGAAGAG | 1549 |
| 54790_1_2695 | + | chr4: 105158480-105158500 | ACUUUUUUUCCUUCACCCA | 1550 |
| 54790_1_2707 | + | chr4: 105158502-105158522 | GAAAGCCAUUGAAUACUGAA | 1551 |
| 54790_1_2708 | + | chr4: 105158503-105158523 | AAAGCCAUUGAAUACUGAAU | 1552 |
| 54790_1_2711 | + | chr4: 105158523-105158543 | GGGUCAUGUUGUAAUUUAAU | 1553 |
| 54790_1_2712 | + | chr4: 105158524-105158544 | GGUCAUGUUGUAAUUUAAUU | 1554 |
| 54790_1_2721 | + | chr4: 105158574-105158594 | GCCUACUUAGUGUAUAUCUC | 1555 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_2734 | + | chr4: 105158635-105158655 | ACUGAAGUAAAUAAGCAAGC | 1556 |
| 54790_1_2738 | + | chr4: 105158656-105158676 | GGAAUAAGUCCUGCAAAUAG | 1557 |
| 54790_1_2748 | + | chr4: 105158719-105158739 | AACUGAUCCUAAAUUGAAUU | 1558 |
| 54790_1_2756 | + | chr4: 105158756-105158776 | UAGAUUACAAGAAAUGCAAC | 1559 |
| 54790_1_2762 | + | chr4: 105158788-105158808 | UUACAGUUCUUCCUCUUUUU | 1560 |
| 54790_1_2780 | + | chr4: 105158868-105158888 | ACAUCUGUAUGCUCAUUUUU | 1561 |
| 54790_1_2782 | + | chr4: 105158869-105158889 | CAUCUGUAUGCUCAUUUUUA | 1562 |
| 54790_1_2783 | + | chr4: 105158884-105158904 | UUUUAGGGCCAAAAAAUAGU | 1563 |
| 54790_1_2789 | + | chr4: 105158895-105158915 | AAAAAUAGUAGGCUUCUCUU | 1564 |
| 54790_1_2795 | + | chr4: 105158933-105158953 | UCUCUCCUUCCAGUUACACG | 1565 |
| 54790_1_2801 | + | chr4: 105158956-105158976 | UCACAUCAACAUUUGACACG | 1566 |
| 54790_1_2802 | + | chr4: 105158957-105158977 | CACAUCAACAUUUGACACGU | 1567 |
| 54790_1_2804 | + | chr4: 105158971-105158991 | ACACGUGGGUACCGUGCACG | 1568 |
| 54790_1_2807 | + | chr4: 105158999-105159019 | GUAUUUACAAACACCAUCCU | 1569 |
| 54790_1_2814 | + | chr4: 105159026-105159046 | CAGAGACUCUUAUGUAACAG | 1570 |
| 54790_1_2820 | + | chr4: 105159052-105159072 | GAGUAAGCUUUGAGUGUCUG | 1571 |
| 54790_1_2821 | + | chr4: 105159053-105159073 | AGUAAGCUUUGAGUGUCUGU | 1572 |
| 54790_1_2824 | + | chr4: 105159056-105159076 | AAGCUUUGAGUGUCUGUGGG | 1573 |
| 54790_1_2827 | + | chr4: 105159059-105159079 | CUUUGAGUGUCUGUGGGCGG | 1574 |
| 54790_1_2832 | + | chr4: 105159087-105159107 | ACACAGUUUAAUUCAUUGUC | 1575 |
| 54790_1_2834 | + | chr4: 105159088-105159108 | CACAGUUUAAUUCAUUGUCC | 1576 |
| 54790_1_2837 | + | chr4: 105159101-105159121 | AUUGUCCGGGAGCCCUUGUC | 1577 |
| 54790_1_2841 | + | chr4: 105159111-105159131 | AGCCCUUGUCUGGCUCUGAU | 1578 |
| 54790_1_2842 | + | chr4: 105159112-105159132 | GCCCUUGUCUGGCUCUGAUA | 1579 |
| 54790_1_2845 | + | chr4: 105159132-105159152 | GGGUCAUGAACCAAAGAUCA | 1580 |
| 54790_1_2846 | + | chr4: 105159140-105159160 | AACCAAAGAUCAAGGUGUUU | 1581 |
| 54790_1_2848 | + | chr4: 105159145-105159165 | AAGAUCAAGGUGUUUAGGUC | 1582 |
| 54790_1_2851 | + | chr4: 105159163-105159183 | UCAGGAUAUUCCCUAACGCA | 1583 |
| 54790_1_2870 | + | chr4: 105159253-105159273 | UUUUUUUUUUUUUUUUGAGA | 1584 |
| 54790_1_2888 | + | chr4: 105159275-105159295 | GAGUUUCGCUCUUGCUGCCA | 1585 |
| 54790_1_2891 | + | chr4: 105159279-105159299 | UUCGCUCUUGCUGCCAAGGU | 1586 |
| 54790_1_2895 | + | chr4: 105159289-105159309 | CUGCCAAGGUUGGAGUGCAG | 1587 |
| 54790_1_2897 | + | chr4: 105159303-105159323 | GUGCAGUGGCGCCGCGAUCU | 1588 |
| 54790_1_2898 | + | chr4: 105159328-105159348 | CACUGCAACCUCCGCCUCAC | 1589 |
| 54790_1_2903 | + | chr4: 105159367-105159387 | GCCUCAGACACCCAAGUAGC | 1590 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_2904 | + | chr4: 105159368-105159388 | CCUCAGACACCCAAGUAGCU | 1591 |
| 54790_1_2905 | + | chr4: 105159376-105159396 | ACCCAAGUAGCUGGGAUUAU | 1592 |
| 54790_1_2907 | + | chr4: 105159395-105159415 | UAGGCAUGCGCCACCACGCC | 1593 |
| 54790_1_2910 | + | chr4: 105159422-105159442 | UUUUGUAUUUUUAGUACAGA | 1594 |
| 54790_1_2911 | + | chr4: 105159423-105159443 | UUUGUAUUUUUAGUACAGAC | 1595 |
| 54790_1_2912 | + | chr4: 105159424-105159444 | UUGUAUUUUUAGUACAGACG | 1596 |
| 54790_1_2920 | + | chr4: 105159438-105159458 | CAGACGGGGUUUCUCCAUGU | 1597 |
| 54790_1_2921 | + | chr4: 105159447-105159467 | UUUCUCCAUGUUGGUCAGCC | 1598 |
| 54790_1_2926 | + | chr4: 105159468-105159488 | GGUGUUGAACUCCCGACUUA | 1599 |
| 54790_1_2928 | + | chr4: 105159485-105159505 | UUAAGGUGAUCCGCUUGCUU | 1600 |
| 54790_1_2932 | + | chr4: 105159501-105159521 | GCUUCGGCCCCCAAAGUGC | 1601 |
| 54790_1_2934 | + | chr4: 105159502-105159522 | CUUCGGCCCCCAAAGUGCU | 1602 |
| 54790_1_2936 | + | chr4: 105159510-105159530 | CCCCAAAGUGCUGGGAUUAC | 1603 |
| 54790_1_2946 | + | chr4: 105159595-105159615 | GCCAAACCAUUUUUGUGAUU | 1604 |
| 54790_1_2949 | + | chr4: 105159596-105159616 | CCAAACCAUUUUUGUGAUUU | 1605 |
| 54790_1_2950 | + | chr4: 105159597-105159617 | CAAACCAUUUUUGUGAUUUG | 1606 |
| 54790_1_2960 | + | chr4: 105159621-105159641 | AACAUGAGCAGAUGAUGCUU | 1607 |
| 54790_1_2971 | + | chr4: 105159716-105159736 | GCCUUUAAAAAAUUACAUCU | 1608 |
| 54790_1_2973 | + | chr4: 105159721-105159741 | UAAAAAAUUACAUCUUGGCC | 1609 |
| 54790_1_2976 | + | chr4: 105159725-105159745 | AAAUUACAUCUUGGCCAGGA | 1610 |
| 54790_1_2979 | + | chr4: 105159744-105159764 | AUGGCUCACGCCUGUAAUCC | 1611 |
| 54790_1_2982 | + | chr4: 105159752-105159772 | CGCCUGUAAUCCCGGCAUUU | 1612 |
| 54790_1_2983 | + | chr4: 105159753-105159773 | GCCUGUAAUCCCGGCAUUUU | 1613 |
| 54790_1_2985 | + | chr4: 105159756-105159776 | UGUAAUCCCGGCAUUUUGGG | 1614 |
| 54790_1_2986 | + | chr4: 105159762-105159782 | CCCGGCAUUUUGGGAGGCCA | 1615 |
| 54790_1_2988 | + | chr4: 105159765-105159785 | GGCAUUUUGGGAGGCCAAGG | 1616 |
| 54790_1_2989 | + | chr4: 105159766-105159786 | GCAUUUUGGGAGGCCAAGGC | 1617 |
| 54790_1_2990 | + | chr4: 105159769-105159789 | UUUUGGGAGGCCAAGGCGGG | 1618 |
| 54790_1_2996 | + | chr4: 105159791-105159811 | GCAAGAGAUCGAGAUCAUCC | 1619 |
| 54790_1_2997 | + | chr4: 105159800-105159820 | CGAGAUCAUCCUGGCCAACA | 1620 |
| 54790_1_3000 | + | chr4: 105159839-105159859 | CUAAAAUACAAAAAUUAGC | 1621 |
| 54790_1_3001 | + | chr4: 105159840-105159860 | UAAAAAUACAAAAAUUAGCU | 1622 |
| 54790_1_3002 | + | chr4: 105159845-105159865 | AUACAAAAAUUAGCUGGGCG | 1623 |
| 54790_1_3003 | + | chr4: 105159848-105159868 | CAAAAAUUAGCUGGGCGUGG | 1624 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_3005 | + | chr4: 105159851-105159871 | AAAUUAGCUGGGCGUGGUGG | 1625 |
| 54790_1_3006 | + | chr4: 105159852-105159872 | AAUUAGCUGGGCGUGGUGGC | 1626 |
| 54790_1_3010 | + | chr4: 105159875-105159895 | CGCCUGUAAUCCCAGCUACU | 1627 |
| 54790_1_3011 | + | chr4: 105159876-105159896 | GCCUGUAAUCCCAGCUACUU | 1628 |
| 54790_1_3013 | + | chr4: 105159885-105159905 | CCCAGCUACUUGGGAGACUG | 1629 |
| 54790_1_3016 | + | chr4: 105159889-105159909 | GCUACUUGGGAGACUGUGGC | 1630 |
| 54790_1_3021 | + | chr4: 105159907-105159927 | GCAGGAGAAUCGCUUGACCC | 1631 |
| 54790_1_3023 | + | chr4: 105159908-105159928 | CAGGAGAAUCGCUUGACCCC | 1632 |
| 54790_1_3025 | + | chr4: 105159911-105159931 | GAGAAUCGCUUGACCCCGGG | 1633 |
| 54790_1_3027 | + | chr4: 105159914-105159934 | AAUCGCUUGACCCCGGGAGG | 1634 |
| 54790_1_3029 | + | chr4: 105159917-105159937 | CGCUUGACCCCGGGAGGCGG | 1635 |
| 54790_1_3034 | + | chr4: 105159957-105159977 | CGCGCCACUGCACUCCAGCC | 1636 |
| 54790_1_3047 | + | chr4: 105160057-105160077 | GAUUGACUUCCCAAACUAAA | 1637 |
| 54790_1_3054 | + | chr4: 105160089-105160109 | AAAACACUCAAGAAAACUCU | 1638 |
| 54790_1_3071 | + | chr4: 105160237-105160257 | AGCUUUAAGUCUCUAUAUUU | 1639 |
| 54790_1_3074 | + | chr4: 105160238-105160258 | GCUUUAAGUCUCUAUAUUUA | 1640 |
| 54790_1_3095 | + | chr4: 105160321-105160341 | GCAAGUUGAAAUAAAAAAAA | 1641 |
| 54790_1_3099 | + | chr4: 105160357-105160377 | AAUGUCUAACCACGUAUAUU | 1642 |
| 54790_1_3100 | + | chr4: 105160371-105160391 | UAUAUUUGGUAUAUGUAUAC | 1643 |
| 54790_1_3103 | + | chr4: 105160399-105160419 | UGUAUUAGCUGUAAGCAGAC | 1644 |
| 54790_1_3117 | + | chr4: 105160454-105160474 | UUCUUUUGUAUUGCAUCUA | 1645 |
| 54790_1_3125 | + | chr4: 105160468-105160488 | CAUCUAAGGAUCAUUUGAGA | 1646 |
| 54790_1_3155 | + | chr4: 105160628-105160648 | UACACUACCUUUCUAAAGAU | 1647 |
| 54790_1_3163 | + | chr4: 105160689-105160709 | AUAUGUAUUUUUUAAAAUAA | 1648 |
| 54790_1_3175 | + | chr4: 105160733-105160753 | CAAGCACCAAAUCUGUUUUU | 1649 |
| 54790_1_3177 | + | chr4: 105160734-105160754 | AAGCACCAAAUCUGUUUUUU | 1650 |
| 54790_1_3178 | + | chr4: 105160735-105160755 | AGCACCAAAUCUGUUUUUUG | 1651 |
| 54790_1_3179 | + | chr4: 105160736-105160756 | GCACCAAAUCUGUUUUUUGG | 1652 |
| 54790_1_3180 | + | chr4: 105160744-105160764 | UCUGUUUUUUGGGGGUUUUU | 1653 |
| 54790_1_3182 | + | chr4: 105160752-105160772 | UUGGGGGUUUUUUGGUUUGU | 1654 |
| 54790_1_3208 | + | chr4: 105160799-105160819 | AGAGUCUCCCUCUGUCGCCC | 1655 |
| 54790_1_3211 | + | chr4: 105160803-105160823 | UCUCCCUCUGUCGCCCAGGC | 1656 |
| 54790_1_3215 | + | chr4: 105160813-105160833 | UCGCCCAGGCUGGAGUGAAG | 1657 |
| 54790_1_3217 | + | chr4: 105160823-105160843 | UGGAGUGAAGCGGAGCGAUC | 1658 |
| 54790_1_3218 | + | chr4: 105160824-105160844 | GGAGUGAAGCGGAGCGAUCU | 1659 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_3220 | + | chr4: 105160848-105160868 | UCACCGCAACCUCCGCCUCC | 1660 |
| 54790_1_3221 | + | chr4: 105160849-105160869 | CACCGCAACCUCCGCCUCCU | 1661 |
| 54790_1_3222 | + | chr4: 105160872-105160892 | UUCCAGCAAUUCUCUGCCUC | 1662 |
| 54790_1_3225 | + | chr4: 105160878-105160898 | CAAUUCUCUGCCUCAGGCUU | 1663 |
| 54790_1_3230 | + | chr4: 105160887-105160907 | GCCUCAGGCUUCGGAGUAGC | 1664 |
| 54790_1_3231 | + | chr4: 105160888-105160908 | CCUCAGGCUUCGGAGUAGCU | 1665 |
| 54790_1_3232 | + | chr4: 105160896-105160916 | UUCGGAGUAGCUGGGAUUAC | 1666 |
| 54790_1_3235 | + | chr4: 105160915-105160935 | CAGGCACUCGCCACCACGCC | 1667 |
| 54790_1_3237 | + | chr4: 105160940-105160960 | AAUUUUGUAUUUUUAGUAG | 1668 |
| 54790_1_3239 | + | chr4: 105160943-105160963 | UUUUGUAUUUUUAGUAGAGG | 1669 |
| 54790_1_3241 | + | chr4: 105160944-105160964 | UUUGUAUUUUUAGUAGAGGC | 1670 |
| 54790_1_3243 | + | chr4: 105160945-105160965 | UUGUAUUUUUAGUAGAGGCG | 1671 |
| 54790_1_3251 | + | chr4: 105160959-105160979 | GAGGCGGGGUUUUACCAUCU | 1672 |
| 54790_1_3252 | + | chr4: 105160964-105160984 | GGGGUUUUACCAUCUUGGUC | 1673 |
| 54790_1_3253 | + | chr4: 105160968-105160988 | UUUUACCAUCUUGGUCAGGC | 1674 |
| 54790_1_3259 | + | chr4: 105160987-105161007 | CUGGUUUUGAACUCCUGACC | 1675 |
| 54790_1_3264 | + | chr4: 105161020-105161040 | GCCUCAGCCUCCCAAAGUGC | 1676 |
| 54790_1_3266 | + | chr4: 105161021-105161041 | CCUCAGCCUCCCAAAGUGCU | 1677 |
| 54790_1_3267 | + | chr4: 105161029-105161049 | UCCCAAAGUGCUGGGAUUAC | 1678 |
| 54790_1_3269 | + | chr4: 105161053-105161073 | GUUUUUCUUUAAGUAAUACU | 1679 |
| 54790_1_3281 | + | chr4: 105161075-105161095 | GUAUAAGAGAACUUUAUAUC | 1680 |
| 54790_1_3290 | + | chr4: 105161128-105161148 | UUAUUCACAUAUAGAAACUC | 1681 |
| 54790_1_3301 | + | chr4: 105161168-105161188 | CUAAAGCUGUUCUCAUUUAG | 1682 |
| 54790_1_3309 | + | chr4: 105161214-105161234 | UUAACUAACAAUAAAAUCUA | 1683 |
| 54790_1_3320 | + | chr4: 105161259-105161279 | GCAGAGCAAAAGCAGCCUUC | 1684 |
| 54790_1_3340 | + | chr4: 105161348-105161368 | AAUUAAGAUGCGAUGAGAGU | 1685 |
| 54790_1_3354 | + | chr4: 105161407-105161427 | UCUACUUGCUUUUUUAGUGU | 1686 |
| 54790_1_3361 | + | chr4: 105161442-105161462 | GUAUUUCUCUCAAUUAUCCU | 1687 |
| 54790_1_3366 | + | chr4: 105161462-105161482 | CGGCCUAAAUAGUAAAAGCU | 1688 |
| 54790_1_3367 | + | chr4: 105161463-105161483 | GGCCUAAAUAGUAAAAGCUU | 1689 |
| 54790_1_3388 | + | chr4: 105161583-105161603 | UUAAUAUUUCCCUCUUUCU | 1690 |
| 54790_1_3396 | + | chr4: 105161612-105161632 | GUUUCACAGUAAAUCAUAUA | 1691 |
| 54790_1_3403 | + | chr4: 105161646-105161666 | AAGUGCUCAGAAUUUGAUUA | 1692 |
| 54790_1_3408 | + | chr4: 105161673-105161693 | AAGUUAAUUUCUACUAAAAA | 1693 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_3410 | + | chr4: 105161674-105161694 | AGUUAAUUCUACUAAAAAA | 1694 |
| 54790_1_3415 | + | chr4: 105161697-105161717 | AUUCAAAUAGAACUUUCAUU | 1695 |
| 54790_1_3424 | + | chr4: 105161721-105161741 | UGUACUGUAGUUUCACUUGA | 1696 |
| 54790_1_3425 | + | chr4: 105161722-105161742 | GUACUGUAGUUUCACUUGAA | 1697 |
| 54790_1_3426 | + | chr4: 105161723-105161743 | UACUGUAGUUUCACUUGAAG | 1698 |
| 54790_1_3430 | + | chr4: 105161761-105161781 | CAUUGACUUAUUCAAUGCAU | 1699 |
| 54790_1_3440 | + | chr4: 105161822-105161842 | UGUAUUAUAAAAUAUCAGAA | 1700 |
| 54790_1_3444 | + | chr4: 105161848-105161868 | AUUGAAUCUGAUGCAUACCA | 1701 |
| 54790_1_3449 | + | chr4: 105161858-105161878 | AUGCAUACCAAGGAGCAAUG | 1702 |
| 54790_1_3450 | + | chr4: 105161868-105161888 | AGGAGCAAUGUGGAAAUUUU | 1703 |
| 54790_1_3460 | + | chr4: 105161910-105161930 | UACUACUAAGUGUGUGUAUG | 1704 |
| 54790_1_3470 | + | chr4: 105161957-105161977 | UAUUUAAGCUGAAUCCUCUU | 1705 |
| 54790_1_3475 | + | chr4: 105161966-105161986 | UGAAUCCUCUUUGGUAGAAA | 1706 |
| 54790_1_3491 | + | chr4: 105162068-105162088 | UUGAAAGUGCACAGAAUCCU | 1707 |
| 54790_1_3492 | + | chr4: 105162069-105162089 | UGAAAGUGCACAGAAUCCUU | 1708 |
| 54790_1_3493 | + | chr4: 105162070-105162090 | GAAAGUGCACAGAAUCCUUG | 1709 |
| 54790_1_3496 | + | chr4: 105162097-105162117 | UUGUAUAAACUGUUUUUAUA | 1710 |
| 54790_1_3506 | + | chr4: 105162119-105162139 | GUUCCUGUAGAAGACAGCUG | 1711 |
| 54790_1_3508 | + | chr4: 105162155-105162175 | CACAAAACAAACAGCUUGCU | 1712 |
| 54790_1_3512 | + | chr4: 105162177-105162197 | GUGAUGAUAACAUUCGUGCA | 1713 |
| 54790_1_3515 | + | chr4: 105162178-105162198 | UGAUGAUAACAUUCGUGCAA | 1714 |
| 54790_1_3518 | + | chr4: 105162196-105162216 | AAGGGAGUUCUCUCUUGCAU | 1715 |
| 54790_1_3520 | + | chr4: 105162205-105162225 | CUCUCUUGCAUAGGAGUCCC | 1716 |
| 54790_1_3523 | + | chr4: 105162229-105162249 | UACCCUAAUGCCUUCCCACA | 1717 |
| 54790_1_3527 | + | chr4: 105162241-105162261 | UUCCCACAUGGUCAAACACA | 1718 |
| 54790_1_3539 | + | chr4: 105162299-105162319 | AGCCUGCAGUUGUUUAUCAG | 1719 |
| 54790_1_3540 | + | chr4: 105162300-105162320 | GCCUGCAGUUGUUUAUCAGU | 1720 |
| 54790_1_3542 | + | chr4: 105162307-105162327 | GUUGUUUAUCAGUGGGAUAC | 1721 |
| 54790_1_3545 | + | chr4: 105162308-105162328 | UUGUUUAUCAGUGGGAUACA | 1722 |
| 54790_1_3552 | + | chr4: 105162319-105162339 | UGGGAUACAGGGAGAAAGAG | 1723 |
| 54790_1_3554 | + | chr4: 105162350-105162370 | UUACUAACUGUUUAAUGACC | 1724 |
| 54790_1_3563 | + | chr4: 105162385-105162405 | GAUACAGAAUAAGAAAGCAC | 1725 |
| 54790_1_3566 | + | chr4: 105162397-105162417 | GAAAGCACUGGCCUGACUGC | 1726 |
| 54790_1_3568 | + | chr4: 105162398-105162418 | AAAGCACUGGCCUGACUGCA | 1727 |
| 54790_1_3569 | + | chr4: 105162399-105162419 | AAGCACUGGCCUGACUGCAG | 1728 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_3571 | + | chr4: 105162407-105162427 | GCCUGACUGCAGGGGAAACA | 1729 |
| 54790_1_3574 | + | chr4: 105162421-105162441 | GAAACAUGGUAGAUGCCUAA | 1730 |
| 54790_1_3575 | + | chr4: 105162424-105162444 | ACAUGGUAGAUGCCUAAAGG | 1731 |
| 54790_1_3587 | + | chr4: 105162476-105162496 | AACUAUCAUUAUCACCUGAA | 1732 |
| 54790_1_3596 | + | chr4: 105162530-105162550 | UUUAACCCUGACAAGCAAGU | 1733 |
| 54790_1_3602 | + | chr4: 105162555-105162575 | CUUUAGUAUUCAAGAACUGA | 1734 |
| 54790_1_3608 | + | chr4: 105162570-105162590 | ACUGAAGGUGACAAGCCCUG | 1735 |
| 54790_1_3622 | + | chr4: 105162678-105162698 | CAUGCCUUCAUAGAAACAGU | 1736 |
| 54790_1_3659 | + | chr4: 105162812-105162832 | GAACUAUUUUGCUUAACAUU | 1737 |
| 54790_1_3670 | + | chr4: 105162847-105162867 | AGCCUAUAUCUGCAAUAAUA | 1738 |
| 54790_1_3672 | + | chr4: 105162848-105162868 | GCCUAUAUCUGCAAUAAUAC | 1739 |
| 54790_1_3674 | + | chr4: 105162849-105162869 | CCUAUAUCUGCAAUAAUACG | 1740 |
| 54790_1_3686 | + | chr4: 105162898-105162918 | UAAUGAUAAAGAGAAAGAAA | 1741 |
| 54790_1_3691 | + | chr4: 105162914-105162934 | GAAAAGGUGAGAAGUAAUUU | 1742 |
| 54790_1_3694 | + | chr4: 105162915-105162935 | AAAAGGUGAGAAGUAAUUUU | 1743 |
| 54790_1_3698 | + | chr4: 105162939-105162959 | AAUAUGCAAUGAUAAACUAG | 1744 |
| 54790_1_3704 | + | chr4: 105162979-105162999 | ACCAGCAGCUGUGCUUAGCA | 1745 |
| 54790_1_3706 | + | chr4: 105162995-105163015 | AGCAUGGAUAAUUGCCUAAA | 1746 |
| 54790_1_3713 | + | chr4: 105163020-105163040 | GAGAAAAAAAGUAAAAAUC | 1747 |
| 54790_1_3777 | + | chr4: 105163278-105163298 | GCUUAUAAGACAUUGCCACC | 1748 |
| 54790_1_3789 | + | chr4: 105163356-105163376 | UAUUUUCAAACAUAGAAUCA | 1749 |
| 54790_1_3797 | + | chr4: 105163375-105163395 | AUGGAUUGCUACAAGCUGAA | 1750 |
| 54790_1_3807 | + | chr4: 105163426-105163446 | UGCAUUUACAGAUGAGAAAA | 1751 |
| 54790_1_3810 | + | chr4: 105163429-105163449 | AUUUACAGAUGAGAAAAUGG | 1752 |
| 54790_1_3814 | + | chr4: 105163434-105163454 | CAGAUGAGAAAAUGGAGGCA | 1753 |
| 54790_1_3816 | + | chr4: 105163435-105163455 | AGAUGAGAAAAUGGAGGCAU | 1754 |
| 54790_1_3822 | + | chr4: 105163519-105163539 | UAUUGAUUAAGUUCUUAUGU | 1755 |
| 54790_1_3823 | + | chr4: 105163520-105163540 | AUUGAUUAAGUUCUUAUGUU | 1756 |
| 54790_1_3834 | + | chr4: 105163585-105163605 | UAUGUCAUCUAUAUUUUUGU | 1757 |
| 54790_1_3843 | + | chr4: 105163613-105163633 | UUACUCUCCUCACUUUACUA | 1758 |
| 54790_1_3850 | + | chr4: 105163630-105163650 | CUAAGGAAGAAACCAAGACA | 1759 |
| 54790_1_3852 | + | chr4: 105163631-105163651 | UAAGGAAGAAACCAAGACAU | 1760 |
| 54790_1_3853 | + | chr4: 105163632-105163652 | AAGGAAGAAACCAAGACAUG | 1761 |
| 54790_1_3857 | + | chr4: 105163669-105163689 | UAUAAAUUUUGAAUUAUCUU | 1762 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_3871 | + | chr4: 105163743-105163763 | UAAAUCAACUCUUAAACAGU | 1763 |
| 54790_1_3873 | + | chr4: 105163762-105163782 | UUGGAUGCCAACAAGCAGUC | 1764 |
| 54790_1_3876 | + | chr4: 105163769-105163789 | CCAACAAGCAGUCUGGUGUU | 1765 |
| 54790_1_3908 | + | chr4: 105163881-105163901 | UGUGUGUUCCAGCUUUGUUG | 1766 |
| 54790_1_3921 | + | chr4: 105163977-105163997 | GUGAAGUGAUUAUUACUAUC | 1767 |
| 54790_1_3926 | + | chr4: 105164023-105164043 | UCAGUCAUUUUUUGUGUUUA | 1768 |
| 54790_1_3939 | + | chr4: 105164059-105164079 | GAGCUACUCAAAUGUAGUCA | 1769 |
| 54790_1_3943 | + | chr4: 105164131-105164151 | GAAUGUAUUAAAUAUUCAUC | 1770 |
| 54790_1_3949 | + | chr4: 105164189-105164209 | UUCCCCUACUACCCAGCCCA | 1771 |
| 54790_1_3963 | + | chr4: 105164265-105164285 | UAUAAGUGAGAUCAUGCAAU | 1772 |
| 54790_1_3973 | + | chr4: 105164323-105164343 | UAGCUGUGUAUGUCAUAUUC | 1773 |
| 54790_1_3985 | + | chr4: 105164393-105164413 | AACUAAUAAUUCUUAUCUCA | 1774 |
| 54790_1_3989 | + | chr4: 105164405-105164425 | UUAUCUCAUGGAUUACUGAG | 1775 |
| 54790_1_3994 | + | chr4: 105164449-105164469 | AAAACAUCCAGCAUGUUACU | 1776 |
| 54790_1_4007 | + | chr4: 105164517-105164537 | GUGUUGAGCAUCUAUGUAUC | 1777 |
| 54790_1_4013 | + | chr4: 105164549-105164569 | AGCCAUCAUCUUUACCCUUC | 1778 |
| 54790_1_4015 | + | chr4: 105164559-105164579 | UUUACCCUUCUGGAAUAUAC | 1779 |
| 54790_1_4019 | + | chr4: 105164567-105164587 | UCUGGAAUAUACAGGCUCAU | 1780 |
| 54790_1_4033 | + | chr4: 105164621-105164641 | CAUAAUGAGAUGAAAAUUAU | 1781 |
| 54790_1_4034 | + | chr4: 105164634-105164654 | AAAUUAUAGGACUCAUAGAC | 1782 |
| 54790_1_4038 | + | chr4: 105164644-105164664 | ACUCAUAGACUGGUCAGUUG | 1783 |
| 54790_1_4041 | + | chr4: 105164655-105164675 | GGUCAGUUGAGGAAUUUCCC | 1784 |
| 54790_1_4045 | + | chr4: 105164680-105164700 | GCUUCCAGCCUCUGCUCAAA | 1785 |
| 54790_1_4049 | + | chr4: 105164706-105164726 | GAAUCCCAGUUGCCUGAAU | 1786 |
| 54790_1_4052 | + | chr4: 105164718-105164738 | GCCUGAAUAGGCGCCAGAGU | 1787 |
| 54790_1_4056 | + | chr4: 105164738-105164758 | UGGCAUAGCUUUCUCAGUAU | 1788 |
| 54790_1_4057 | + | chr4: 105164739-105164759 | GGCAUAGCUUUCUCAGUAUU | 1789 |
| 54790_1_4060 | + | chr4: 105164749-105164769 | UCUCAGUAUUGGGACCUGAC | 1790 |
| 54790_1_4062 | + | chr4: 105164750-105164770 | CUCAGUAUUGGGACCUGACA | 1791 |
| 54790_1_4069 | + | chr4: 105164789-105164809 | ACAGCACAGCCUCUGAAGAU | 1792 |
| 54790_1_4072 | + | chr4: 105164796-105164816 | AGCCUCUGAAGAUUGGCUCA | 1793 |
| 54790_1_4073 | + | chr4: 105164797-105164817 | GCCUCUGAAGAUUGGCUCAA | 1794 |
| 54790_1_4076 | + | chr4: 105164798-105164818 | CCUCUGAAGAUUGGCUCAAG | 1795 |
| 54790_1_4078 | + | chr4: 105164799-105164819 | CUCUGAAGAUUGGCUCAAGG | 1796 |
| 54790_1_4082 | + | chr4: 105164811-105164831 | GCUCAAGGGGAAGAGAUGA | 1797 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_4107 | + | chr4: 105164955-105164975 | UAGAAAUAUUAAAUGAUAGC | 1798 |
| 54790_1_4110 | + | chr4: 105164977-105164997 | GCAUGAUUUAAAAAGUACUA | 1799 |
| 54790_1_4120 | + | chr4: 105165024-105165044 | CUAUUUUGUAUCAUAUUUUC | 1800 |
| 54790_1_4129 | + | chr4: 105165044-105165064 | AGGAAGAAGAGACAACAUUU | 1801 |
| 54790_1_4134 | + | chr4: 105165075-105165095 | GCUUAAAGAUAGAUGAUAGC | 1802 |
| 54790_1_4135 | + | chr4: 105165076-105165096 | CUUAAAGAUAGAUGAUAGCC | 1803 |
| 54790_1_4138 | + | chr4: 105165081-105165101 | AGAUAGAUGAUAGCCGGGUG | 1804 |
| 54790_1_4139 | + | chr4: 105165084-105165104 | UAGAUGAUAGCCGGGUGUGG | 1805 |
| 54790_1_4142 | + | chr4: 105165111-105165131 | GACCUGUAAUUCCAGCACUU | 1806 |
| 54790_1_4144 | + | chr4: 105165112-105165132 | ACCUGUAAUUCCAGCACUUU | 1807 |
| 54790_1_4145 | + | chr4: 105165115-105165135 | UGUAAUUCCAGCACUUUGGG | 1808 |
| 54790_1_4147 | + | chr4: 105165121-105165141 | UCCAGCACUUUGGGAGGCCG | 1809 |
| 54790_1_4150 | + | chr4: 105165124-105165144 | AGCACUUUGGGAGGCCGAGG | 1810 |
| 54790_1_4151 | + | chr4: 105165125-105165145 | GCACUUUGGGAGGCCGAGGC | 1811 |
| 54790_1_4155 | + | chr4: 105165139-105165159 | CGAGGCGGGCAGAUCACCUG | 1812 |
| 54790_1_4157 | + | chr4: 105165144-105165164 | CGGGCAGAUCACCUGAGGUC | 1813 |
| 54790_1_4160 | + | chr4: 105165162-105165182 | UCAGGAGUUUGAAACCAACC | 1814 |
| 54790_1_4166 | + | chr4: 105165212-105165232 | AAAAAUACAAAAAUUAGCC | 1815 |
| 54790_1_4167 | + | chr4: 105165217-105165237 | AUACAAAAAUUAGCCAGGCG | 1816 |
| 54790_1_4168 | + | chr4: 105165220-105165240 | CAAAAAUUAGCCAGGCGUGG | 1817 |
| 54790_1_4170 | + | chr4: 105165223-105165243 | AAAUUAGCCAGGCGUGGUGG | 1818 |
| 54790_1_4171 | + | chr4: 105165224-105165244 | AAUUAGCCAGGCGUGGUGGU | 1819 |
| 54790_1_4174 | + | chr4: 105165248-105165268 | GCCUGUAAUUCCAGCCACUC | 1820 |
| 54790_1_4177 | + | chr4: 105165257-105165277 | UCCAGCCACUCAGGAGACUG | 1821 |
| 54790_1_4185 | + | chr4: 105165280-105165300 | CACGAGAAUCACUUGAACCC | 1822 |
| 54790_1_4186 | + | chr4: 105165283-105165303 | GAGAAUCACUUGAACCCAGG | 1823 |
| 54790_1_4188 | + | chr4: 105165289-105165309 | CACUUGAACCCAGGAGGCAG | 1824 |
| 54790_1_4194 | + | chr4: 105165329-105165349 | CGUGCCAUUGCACUCCAGCC | 1825 |
| 54790_1_4195 | + | chr4: 105165330-105165350 | GUGCCAUUGCACUCCAGCCU | 1826 |
| 54790_1_4199 | + | chr4: 105165339-105165359 | CACUCCAGCCUGGGUGACAG | 1827 |
| 54790_1_4201 | + | chr4: 105165340-105165360 | ACUCCAGCCUGGGUGACAGA | 1828 |
| 54790_1_4204 | + | chr4: 105165385-105165405 | AAAAUAAAAAAUAAUUGUCU | 1829 |
| 54790_1_4206 | + | chr4: 105165398-105165418 | AUUGUCUUGGUGUGCUAAUC | 1830 |
| 54790_1_4213 | + | chr4: 105165416-105165436 | UCAGGAGCUUCCUGUGAGAG | 1831 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_4216 | + | chr4: 105165431-105165451 | GAGAGUGGAAAUUCCUUACA | 1832 |
| 54790_1_4220 | + | chr4: 105165451-105165471 | UGGCAGUGUCAUGAAAUUUU | 1833 |
| 54790_1_4229 | + | chr4: 105165494-105165514 | GAGUGUCUCAAAAUAGUUAA | 1834 |
| 54790_1_4247 | + | chr4: 105165562-105165582 | UUGAAGUUUCUUUGAGAACU | 1835 |
| 54790_1_4261 | + | chr4: 105165670-105165690 | GAUUAUUGCCAUGUAUAAGU | 1836 |
| 54790_1_4263 | + | chr4: 105165671-105165691 | AUUAUUGCCAUGUAUAAGUU | 1837 |
| 54790_1_4271 | + | chr4: 105165706-105165726 | ACCUUUCUAAGUCUGCAUUU | 1838 |
| 54790_1_4272 | + | chr4: 105165707-105165727 | CCUUUCUAAGUCUGCAUUUA | 1839 |
| 54790_1_4280 | + | chr4: 105165740-105165760 | CACAAAAUGAAAUGUUUGAU | 1840 |
| 54790_1_4289 | + | chr4: 105165778-105165798 | AGUGACUUUCAAAAUGUAU | 1841 |
| 54790_1_4291 | + | chr4: 105165785-105165805 | UUUCAAAAUGUAUAGGAGCA | 1842 |
| 54790_1_4330 | + | chr4: 105166026-105166046 | AAUUUAUAAUAUUUAUAUUC | 1843 |
| 54790_1_4350 | + | chr4: 105166147-105166167 | CACUGUAACACCUAGCAGUA | 1844 |
| 54790_1_4357 | + | chr4: 105166165-105166185 | UAUGGUUGAACAUGUAGAAA | 1845 |
| 54790_1_4360 | + | chr4: 105166207-105166227 | CUAAAAUUUAGCUUGUUCUA | 1846 |
| 54790_1_4366 | + | chr4: 105166227-105166247 | AGGAUGCUACUUUAAGCAUU | 1847 |
| 54790_1_4367 | + | chr4: 105166228-105166248 | GGAUGCUACUUUAAGCAUUA | 1848 |
| 54790_1_4369 | + | chr4: 105166236-105166256 | CUUUAAGCAUUAGGGUAAAA | 1849 |
| 54790_1_4383 | + | chr4: 105166303-105166323 | AUUUUUGUUUCUUUCACAUU | 1850 |
| 54790_1_4452 | + | chr4: 105166507-105166527 | GUUUCUUCUCAUUUUUCUCC | 1851 |
| 54790_1_4490 | + | chr4: 105166610-105166630 | AAAAAAAAGAAAAAAAAAC | 1852 |
| 54790_1_4491 | + | chr4: 105166611-105166631 | AAAAAAAGAAAAAAAAACA | 1853 |
| 54790_1_4492 | + | chr4: 105166612-105166632 | AAAAAAGAAAAAAAAACAG | 1854 |
| 54790_1_4515 | + | chr4: 105166735-105166755 | AGUAAUUUCUCUCAGAGCU | 1855 |
| 54790_1_4517 | + | chr4: 105166736-105166756 | GUAAUUUCUCUCAGAGCUU | 1856 |
| 54790_1_4521 | + | chr4: 105166745-105166765 | UCUCAGAGCUUGGGAAACAU | 1857 |
| 54790_1_4526 | + | chr4: 105166768-105166788 | UACGUUGUUACCCUUCAUCU | 1858 |
| 54790_1_4543 | + | chr4: 105166851-105166871 | UCCCUAUUCAUAUGUUUAUU | 1859 |
| 54790_1_4556 | + | chr4: 105166890-105166910 | UUCUGAAAUUCCUCCAGAUA | 1860 |
| 54790_1_4564 | + | chr4: 105166940-105166960 | CUUGAUGAUUCUGUACAAUC | 1861 |
| 54790_1_4567 | + | chr4: 105166967-105166987 | AACUGCCUUUAUUUAGCUUA | 1862 |
| 54790_1_4592 | + | chr4: 105167044-105167064 | CUUUAUGAAACUCAUGUUAA | 1863 |
| 54790_1_4639 | + | chr4: 105167212-105167232 | CUCUGAUUGAUUCUUUUUAA | 1864 |
| 54790_1_4643 | + | chr4: 105167227-105167247 | UUUAAUGGUAGCCUAUUUCG | 1865 |
| 54790_1_4652 | + | chr4: 105167260-105167280 | AUAAAAUGUAUUAAAUUUUG | 1866 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_4654 | + | chr4: 105167261-105167281 | UAAAAUGUAUUAAAUUUUGU | 1867 |
| 54790_1_4655 | + | chr4: 105167270-105167290 | UUAAAUUUUGUGGGAAAAUU | 1868 |
| 54790_1_4684 | + | chr4: 105167581-105167601 | ACUGACUAAUUUUCAGAACU | 1869 |
| 54790_1_4685 | + | chr4: 105167590-105167610 | UUUUCAGAACUUGGUGUGUA | 1870 |
| 54790_1_4694 | + | chr4: 105167639-105167659 | GCUUUAGUAUUACAGUGCCC | 1871 |
| 54790_1_4698 | + | chr4: 105167700-105167720 | GUUCAUCCUGUACAGAUCUA | 1872 |
| 54790_1_4701 | + | chr4: 105167721-105167741 | GGUGUAACUAUUUUCAUUUC | 1873 |
| 54790_1_4702 | + | chr4: 105167722-105167742 | GUGUAACUAUUUUCAUUUCU | 1874 |
| 54790_1_4704 | + | chr4: 105167729-105167749 | UAUUUUCAUUUCUGGGCCCU | 1875 |
| 54790_1_4710 | + | chr4: 105167740-105167760 | CUGGGCCCUUGGAGAUUCUU | 1876 |
| 54790_1_4721 | + | chr4: 105167782-105167802 | CUAUCUUGCUGUUCAAUAAC | 1877 |
| 54790_1_4726 | + | chr4: 105167794-105167814 | UCAAUAACAGGUAAUAGAAA | 1878 |
| 54790_1_4737 | + | chr4: 105167864-105167884 | AAAUAAAUGUGAAACCCGUA | 1879 |
| 54790_1_4740 | + | chr4: 105167888-105167908 | CGUAAUCUUGCCUAGCUUUA | 1880 |
| 54790_1_4744 | + | chr4: 105167896-105167916 | UGCCUAGCUUUAAGGAAUGA | 1881 |
| 54790_1_4755 | + | chr4: 105167924-105167944 | CUAGAAACAACAGAGAGAAA | 1882 |
| 54790_1_4760 | + | chr4: 105167978-105167998 | UCUACCUGUAAAGUAUAUUC | 1883 |
| 54790_1_4774 | + | chr4: 105168069-105168089 | AAAGUGCAGUUUCCCUGUCA | 1884 |
| 54790_1_4775 | + | chr4: 105168070-105168090 | AAGUGCAGUUUCCCUGUCAU | 1885 |
| 54790_1_4785 | + | chr4: 105168114-105168134 | UCCCCCUUCUUACCUCACCG | 1886 |
| 54790_1_4786 | + | chr4: 105168115-105168135 | CCCCCUUCUUACCUCACCGU | 1887 |
| 54790_1_4794 | + | chr4: 105168163-105168183 | GAUCAUUUAAAAAUUAAGUC | 1888 |
| 54790_1_4799 | + | chr4: 105168196-105168216 | CCUCUGCUUAAAACCAUUAA | 1889 |
| 54790_1_4800 | + | chr4: 105168197-105168217 | CUCUGCUUAAAACCAUUAAU | 1890 |
| 54790_1_4811 | + | chr4: 105168263-105168283 | CCACCAGUCCUCAAGUGAAU | 1891 |
| 54790_1_4822 | + | chr4: 105168330-105168350 | UCAUUCUAUUCUAAUUUCCU | 1892 |
| 54790_1_4826 | + | chr4: 105168347-105168367 | CCUUGGUUUUCUUGCUGUCC | 1893 |
| 54790_1_4835 | + | chr4: 105168377-105168397 | AAGAGCAUCCUUUUUCCUCC | 1894 |
| 54790_1_4844 | + | chr4: 105168406-105168426 | CACUUGCUGUUCCCUCUUCC | 1895 |
| 54790_1_4850 | + | chr4: 105168433-105168453 | CCCUUCCUUCAGAGAGCCAC | 1896 |
| 54790_1_4885 | + | chr4: 105168584-105168604 | UUUUAUUUUUUAUUCCCAU | 1897 |
| 54790_1_4891 | + | chr4: 105168591-105168611 | UUUUUAUUCCCAUAGGUUAU | 1898 |
| 54790_1_4893 | + | chr4: 105168592-105168612 | UUUUAUUCCCAUAGGUUAUU | 1899 |
| 54790_1_4895 | + | chr4: 105168593-105168613 | UUUAUUCCCAUAGGUUAUUG | 1900 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_4902 | + | chr4: 105168599-105168619 | CCCAUAGGUUAUUGGGGAAC | 1901 |
| 54790_1_4904 | + | chr4: 105168602-105168622 | AUAGGUUAUUGGGGAACAGG | 1902 |
| 54790_1_4905 | + | chr4: 105168609-105168629 | AUUGGGGAACAGGUGGUAUU | 1903 |
| 54790_1_4909 | + | chr4: 105168617-105168637 | ACAGGUGGUAUUUGGUUACA | 1904 |
| 54790_1_4910 | + | chr4: 105168618-105168638 | CAGGUGGUAUUUGGUUACAU | 1905 |
| 54790_1_4913 | + | chr4: 105168633-105168653 | UACAUGGGUAAGUUCUUUAG | 1906 |
| 54790_1_4917 | + | chr4: 105168651-105168671 | AGUGGUGAUUUGUGAGAUCU | 1907 |
| 54790_1_4945 | + | chr4: 105168819-105168839 | GAGUGAGAACAUAUGAUGUU | 1908 |
| 54790_1_4957 | + | chr4: 105168873-105168893 | AAUAGUCUCCAGUCUUAUCC | 1909 |
| 54790_1_4959 | + | chr4: 105168909-105168929 | CAUUAAUUCAUUCCUUUUUA | 1910 |
| 54790_1_4976 | + | chr4: 105168978-105168998 | CUCACCGAUUGACGAGCAUU | 1911 |
| 54790_1_4977 | + | chr4: 105168979-105168999 | UCACCGAUUGACGAGCAUUU | 1912 |
| 54790_1_4978 | + | chr4: 105168983-105169003 | CGAUUGACGAGCAUUUGGGU | 1913 |
| 54790_1_4995 | + | chr4: 105169066-105169086 | AUAUAAUGACUUUUUUCCUC | 1914 |
| 54790_1_4996 | + | chr4: 105169067-105169087 | UAUAAUGACUUUUUUCCUCU | 1915 |
| 54790_1_5004 | + | chr4: 105169084-105169104 | UCUGGGUAGAUACCCAGUAG | 1916 |
| 54790_1_5005 | + | chr4: 105169085-105169105 | CUGGGUAGAUACCCAGUAGU | 1917 |
| 54790_1_5007 | + | chr4: 105169093-105169113 | AUACCCAGUAGUGGGAUUGC | 1918 |
| 54790_1_5008 | + | chr4: 105169102-105169122 | AGUGGGAUUGCUGGAUCAAA | 1919 |
| 54790_1_5012 | + | chr4: 105169127-105169147 | GUUGUACUUUUAGUUAUUUA | 1920 |
| 54790_1_5020 | + | chr4: 105169153-105169173 | CUCCACACUGUUUUCCAUAG | 1921 |
| 54790_1_5036 | + | chr4: 105169257-105169277 | UUUUUUAUUGCCGUUCUUGC | 1922 |
| 54790_1_5046 | + | chr4: 105169277-105169297 | AGGAGUAAAGUAUUGCAUUG | 1923 |
| 54790_1_5059 | + | chr4: 105169337-105169357 | ACAUUUCUCAUAUGUUUGU | 1924 |
| 54790_1_5076 | + | chr4: 105169398-105169418 | UCCUUAGCCCACUUUUUGAU | 1925 |
| 54790_1_5086 | + | chr4: 105169430-105169450 | UUUUUUCCUUGCUAAUUUGU | 1926 |
| 54790_1_5101 | + | chr4: 105169467-105169487 | UCUAGAUAUUAGUCCUUUGC | 1927 |
| 54790_1_5109 | + | chr4: 105169503-105169523 | GAAGAUUUCUCCCACUCUG | 1928 |
| 54790_1_5110 | + | chr4: 105169504-105169524 | AAGAUUUCUCCCACUCUGU | 1929 |
| 54790_1_5118 | + | chr4: 105169547-105169567 | CUGUUCCUAUUGCUGUGCAG | 1930 |
| 54790_1_5130 | + | chr4: 105169606-105169626 | GUUUUGUUGCAUUUGCUUU | 1931 |
| 54790_1_5133 | + | chr4: 105169607-105169627 | UUUUUGUUGCAUUUGCUUUU | 1932 |
| 54790_1_5138 | + | chr4: 105169614-105169634 | UGCAUUUGCUUUUGGGUUCU | 1933 |
| 54790_1_5150 | + | chr4: 105169649-105169669 | UACCUAAGCCAAUGUCUAGA | 1934 |
| 54790_1_5152 | + | chr4: 105169650-105169670 | ACCUAAGCCAAUGUCUAGAA | 1935 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_5175 | + | chr4: 105169738-105169758 | CUUGAGUUGAUUUUUAUAUA | 1936 |
| 54790_1_5182 | + | chr4: 105169750-105169770 | UUUAUAUAAGGUGAGAGAUG | 1937 |
| 54790_1_5187 | + | chr4: 105169776-105169796 | UAGUUUCAUUCUUCUAUAUG | 1938 |
| 54790_1_5195 | + | chr4: 105169811-105169831 | CCCAGCACCAUUUGUUGAAU | 1939 |
| 54790_1_5196 | + | chr4: 105169812-105169832 | CCAGCACCAUUUGUUGAAUA | 1940 |
| 54790_1_5204 | + | chr4: 105169857-105169877 | GUUUUGUUUGCUUUGUCAA | 1941 |
| 54790_1_5209 | + | chr4: 105169865-105169885 | UUGCUUUGUCAAAGGUCAGU | 1942 |
| 54790_1_5215 | + | chr4: 105169879-105169899 | GUCAGUUGGCUGUAAGUAUG | 1943 |
| 54790_1_5216 | + | chr4: 105169880-105169900 | UCAGUUGGCUGUAAGUAUGU | 1944 |
| 54790_1_5218 | + | chr4: 105169892-105169912 | AAGUAUGUGGGUUUCUUUCU | 1945 |
| 54790_1_5223 | + | chr4: 105169911-105169931 | UUGGUUCUCUAUCCCCCCAU | 1946 |
| 54790_1_5230 | + | chr4: 105169951-105169971 | AUACCAGUACCAUGCUGUUU | 1947 |
| 54790_1_5232 | + | chr4: 105169960-105169980 | CCAUGCUGUUUUGGUGUCUA | 1948 |
| 54790_1_5236 | + | chr4: 105169980-105170000 | UGGCCUUCUAGUAUAAAGUC | 1949 |
| 54790_1_5241 | + | chr4: 105170027-105170047 | CUUUGUGCUUAGUUUUGCUU | 1950 |
| 54790_1_5246 | + | chr4: 105170035-105170055 | UUAGUUUUGCUUUGGCUCUG | 1951 |
| 54790_1_5247 | + | chr4: 105170036-105170056 | UAGUUUUGCUUUGGCUCUGU | 1952 |
| 54790_1_5273 | + | chr4: 105170097-105170117 | CCUAAUUCUGUGAAGAAUGA | 1953 |
| 54790_1_5276 | + | chr4: 105170100-105170120 | AAUUCUGUGAAGAAUGAUGG | 1954 |
| 54790_1_5280 | + | chr4: 105170111-105170131 | GAAUGAUGGUGGUAUUUUGA | 1955 |
| 54790_1_5282 | + | chr4: 105170112-105170132 | AAUGAUGGUGGUAUUUUGAU | 1956 |
| 54790_1_5286 | + | chr4: 105170137-105170157 | UUGCAUAGUUUAUCAACCCU | 1957 |
| 54790_1_5309 | + | chr4: 105170212-105170232 | GAUGUGAGUUCUAUGAGAUG | 1958 |
| 54790_1_5312 | + | chr4: 105170224-105170244 | AUGAGAUGAGGAACAUUGUU | 1959 |
| 54790_1_5313 | + | chr4: 105170225-105170245 | UGAGAUGAGGAACAUUGUUU | 1960 |
| 54790_1_5317 | + | chr4: 105170260-105170280 | AUUGUCAGCAUACCAAACAG | 1961 |
| 54790_1_5319 | + | chr4: 105170271-105170291 | ACCAAACAGUGGCUAGCACA | 1962 |
| 54790_1_5321 | + | chr4: 105170293-105170313 | GUGAGCACUCAAUAAAUAUU | 1963 |
| 54790_1_5327 | + | chr4: 105170318-105170338 | AAAGUUGCAGUGAAUGAAAA | 1964 |
| 54790_1_5329 | + | chr4: 105170330-105170350 | AAUGAAAAUGGUUUCUAAAA | 1965 |
| 54790_1_5333 | + | chr4: 105170360-105170380 | UAUAGUCCCAGCUACUCUGA | 1966 |
| 54790_1_5335 | + | chr4: 105170366-105170386 | CCCAGCUACUCUGAAGGCUG | 1967 |
| 54790_1_5338 | + | chr4: 105170370-105170390 | GCUACUCUGAAGGCUGAGGC | 1968 |
| 54790_1_5342 | + | chr4: 105170397-105170417 | UUGCCUGAGUCUCAAAAGUU | 1969 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_5343 | + | chr4: 105170398-105170418 | UGCCUGAGUCUCAAAAGUUU | 1970 |
| 54790_1_5344 | + | chr4: 105170399-105170419 | GCCUGAGUCUCAAAAGUUUG | 1971 |
| 54790_1_5351 | + | chr4: 105170450-105170470 | AUAGCUGCUGCAUUGUAGCC | 1972 |
| 54790_1_5355 | + | chr4: 105170486-105170506 | AACCCAUCUCUUUAAAAAAA | 1973 |
| 54790_1_5360 | + | chr4: 105170526-105170546 | UUUUACUGCUUUUCUCUUUA | 1974 |
| 54790_1_5375 | + | chr4: 105170567-105170587 | CUCUGCUGAUUUAUCCUCAU | 1975 |
| 54790_1_5382 | + | chr4: 105170607-105170627 | AAUAUCCAUUGAUUAUUUAU | 1976 |
| 54790_1_5384 | + | chr4: 105170617-105170637 | GAUUAUUUAUAGGUGAAAUU | 1977 |
| 54790_1_5388 | + | chr4: 105170624-105170644 | UAUAGGUGAAAUUAGGCUUU | 1978 |
| 54790_1_5393 | + | chr4: 105170634-105170654 | AUUAGGCUUUUGGAUCCAUG | 1979 |
| 54790_1_5402 | + | chr4: 105170657-105170677 | AAUAGCUGAGACAAUCUUCC | 1980 |
| 54790_1_5404 | + | chr4: 105170666-105170686 | GACAAUCUUCCAGGAGCUUC | 1981 |
| 54790_1_5409 | + | chr4: 105170674-105170694 | UCCAGGAGCUUCUGGAGCCG | 1982 |
| 54790_1_5411 | + | chr4: 105170683-105170703 | UUCUGGAGCCGAGGAAACAU | 1983 |
| 54790_1_5414 | + | chr4: 105170707-105170727 | CACUAAAAUACCAUUUAUAU | 1984 |
| 54790_1_5423 | + | chr4: 105170761-105170781 | AAUUACAUUGUGCAUUUAAA | 1985 |
| 54790_1_5425 | + | chr4: 105170770-105170790 | GUGCAUUUAAAAGGCUGUUG | 1986 |
| 54790_1_5437 | + | chr4: 105170844-105170864 | ACUGAUUUAUAAAUAGACUU | 1987 |
| 54790_1_5438 | + | chr4: 105170845-105170865 | CUGAUUUAUAAAUAGACUUA | 1988 |
| 54790_1_5453 | + | chr4: 105170945-105170965 | CUUCCUCCUCCUUCUACACU | 1989 |
| 54790_1_5467 | + | chr4: 105171009-105171029 | UGAUGAGAAAAUAUCUUUUC | 1990 |
| 54790_1_5474 | + | chr4: 105171046-105171066 | CUUCAUUCUUUUUUUUUAAA | 1991 |
| 54790_1_5478 | + | chr4: 105171049-105171069 | CAUUCUUUUUUUUAAAUGG | 1992 |
| 54790_1_5494 | + | chr4: 105171101-105171121 | UUUCUUCCUGCUGUUAUUGC | 1993 |
| 54790_1_5501 | + | chr4: 105171114-105171134 | UUAUUGCUGGCUCAAAAUCC | 1994 |
| 54790_1_5509 | + | chr4: 105171148-105171168 | GUUAUUUCUGAGCUCCAUGA | 1995 |
| 54790_1_5510 | + | chr4: 105171149-105171169 | UUAUUUCUGAGCUCCAUGAU | 1996 |
| 54790_1_5523 | + | chr4: 105171205-105171225 | CCAGUGUCUAGCACAGUGCC | 1997 |
| 54790_1_5526 | + | chr4: 105171237-105171257 | AGCCUAUAAUGUUUAUCUAG | 1998 |
| 54790_1_5532 | + | chr4: 105171284-105171304 | UUAUCAUUGCAAAGAUUUAG | 1999 |
| 54790_1_5539 | + | chr4: 105171327-105171347 | UAAUGCUCUACUCCAUGCUA | 2000 |
| 54790_1_5565 | + | chr4: 105171468-105171488 | AUAACCAAAUAAGAUAACAC | 2001 |
| 54790_1_5568 | + | chr4: 105171497-105171517 | UUUGUUCUUUAAAAAAUGAC | 2002 |
| 54790_1_5581 | + | chr4: 105171526-105171546 | AGAAUAAGAGAAAAAAUUAG | 2003 |
| 54790_1_5597 | + | chr4: 105171646-105171666 | CUACAACUGCCUCUUGAUAA | 2004 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_5598 | + | chr4: 105171653-105171673 | UGCCUCUUGAUAAAGGAUGC | 2005 |
| 54790_1_5602 | + | chr4: 105171691-105171711 | UAAUGUUUGCUCAUUUACAG | 2006 |
| 54790_1_5608 | + | chr4: 105171712-105171732 | GGAAUGUACAAUAUAGUACC | 2007 |
| 54790_1_5610 | + | chr4: 105171713-105171733 | GAAUGUACAAUAUAGUACCU | 2008 |
| 54790_1_5611 | + | chr4: 105171717-105171737 | GUACAAUAUAGUACCUGGGA | 2009 |
| 54790_1_5614 | + | chr4: 105171726-105171746 | AGUACCUGGGAUGGUGAAGA | 2010 |
| 54790_1_5617 | + | chr4: 105171754-105171774 | CAACAAAUUUAAAAUAGCUG | 2011 |
| 54790_1_5618 | + | chr4: 105171755-105171775 | AACAAAUUUAAAAUAGCUGU | 2012 |
| 54790_1_5635 | + | chr4: 105171834-105171854 | AUGCCUGCCUUUAUCUGCUU | 2013 |
| 54790_1_5646 | + | chr4: 105171905-105171925 | AUAGCAUGCAUUUCUCAGAC | 2014 |
| 54790_1_5651 | + | chr4: 105171919-105171939 | UCAGACAGGUAAGAUAGAAU | 2015 |
| 54790_1_5652 | + | chr4: 105171930-105171950 | AGAUAGAAUUGGUAUAUAUU | 2016 |
| 54790_1_5654 | + | chr4: 105171948-105171968 | UUUGGUAUAGCAAAAAGUCA | 2017 |
| 54790_1_5657 | + | chr4: 105171971-105171991 | UUGUCUUUAGAUUAUAUCCU | 2018 |
| 54790_1_5661 | + | chr4: 105171983-105172003 | UAUAUCCUUGGUUUUUCAUG | 2019 |
| 54790_1_5665 | + | chr4: 105171989-105172009 | CUUGGUUUUUCAUGUGGUAC | 2020 |
| 54790_1_5666 | + | chr4: 105171990-105172010 | UUGGUUUUUCAUGUGGUACU | 2021 |
| 54790_1_5668 | + | chr4: 105171991-105172011 | UGGUUUUUCAUGUGGUACUG | 2022 |
| 54790_1_5679 | + | chr4: 105172027-105172047 | UUUCUUCAUCUAUAAAAUGA | 2023 |
| 54790_1_5683 | + | chr4: 105172033-105172053 | CAUCUAUAAAAUGAAGGACC | 2024 |
| 54790_1_5685 | + | chr4: 105172034-105172054 | AUCUAUAAAAUGAAGGACCU | 2025 |
| 54790_1_5693 | + | chr4: 105172085-105172105 | AACUUUGAGCUCAGCAAAGU | 2026 |
| 54790_1_5695 | + | chr4: 105172086-105172106 | ACUUUGAGCUCAGCAAAGUA | 2027 |
| 54790_1_5704 | + | chr4: 105172159-105172179 | CAGUUGACCCUUGAAUAACA | 2028 |
| 54790_1_5705 | + | chr4: 105172162-105172182 | UUGACCCUUGAAUAACAUGG | 2029 |
| 54790_1_5716 | + | chr4: 105172253-105172273 | ACUAAUAGCCUGCUGUUGUC | 2030 |
| 54790_1_5718 | + | chr4: 105172256-105172276 | AAUAGCCUGCUGUUGUCUGG | 2031 |
| 54790_1_5734 | + | chr4: 105172374-105172394 | CUGUUAUUAAGAAAAUCGUA | 2032 |
| 54790_1_5741 | + | chr4: 105172406-105172426 | UAUAUUUACUAUUUAUUAAA | 2033 |
| 54790_1_5757 | + | chr4: 105172470-105172490 | CCUUGAGUAUGCUGAAGAAG | 2034 |
| 54790_1_5760 | + | chr4: 105172473-105172493 | UGAGUAUGCUGAAGAAGAGG | 2035 |
| 54790_1_5764 | + | chr4: 105172479-105172499 | UGCUGAAGAAGAGGAGGAAA | 2036 |
| 54790_1_5766 | + | chr4: 105172483-105172503 | GAAGAAGAGGAGGAAAAGGA | 2037 |
| 54790_1_5767 | + | chr4: 105172484-105172504 | AAGAAGAGGAGGAAAAGGAU | 2038 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_5768 | + | chr4: 105172488-105172508 | AGAGGAGGAAAAGGAUGGGU | 2039 |
| 54790_1_5771 | + | chr4: 105172503-105172523 | UGGGUUGGUCUUGCUGUUCC | 2040 |
| 54790_1_5772 | + | chr4: 105172504-105172524 | GGGUUGGUCUUGCUGUUCCA | 2041 |
| 54790_1_5773 | + | chr4: 105172505-105172525 | GGUUGGUCUUGCUGUUCCAG | 2042 |
| 54790_1_5774 | + | chr4: 105172508-105172528 | UGGUCUUGCUGUUCCAGGGG | 2043 |
| 54790_1_5779 | + | chr4: 105172517-105172537 | UGUUCCAGGGGUGGCAGAAG | 2044 |
| 54790_1_5785 | + | chr4: 105172568-105172588 | CAGUUCAAACCUGUAUUUUA | 2045 |
| 54790_1_5787 | + | chr4: 105172575-105172595 | AACCUGUAUUUUAAGGUCAA | 2046 |
| 54790_1_5819 | + | chr4: 105172699-105172719 | AACUAUGAAAGUUGAAUUCA | 2047 |
| 54790_1_5835 | + | chr4: 105172760-105172780 | UCAUAUAAUGAGAAUACUAA | 2048 |
| 54790_1_5847 | + | chr4: 105172829-105172849 | AAAAGAAAAUCUUUCAGUG | 2049 |
| 54790_1_5855 | + | chr4: 105172874-105172894 | UCUAGUAGAUGACAUAUUUU | 2050 |
| 54790_1_5859 | + | chr4: 105172891-105172911 | UUUUGGUAAUGAAAUUGAUA | 2051 |
| 54790_1_5860 | + | chr4: 105172892-105172912 | UUUGGUAAUGAAAUUGAUAU | 2052 |
| 54790_1_5866 | + | chr4: 105172917-105172937 | AUUAACAGCUUUUUCCAAGU | 2053 |
| 54790_1_5906 | + | chr4: 105173084-105173104 | AUAUAAAUUUCUUCUUAAG | 2054 |
| 54790_1_5915 | + | chr4: 105173113-105173133 | AUUCUUGCAUGCCAACACAA | 2055 |
| 54790_1_5923 | + | chr4: 105173147-105173167 | ACCUAUCCUUAGUUUCUAAG | 2056 |
| 54790_1_5931 | + | chr4: 105173216-105173236 | GAUAAGUUCCAACUCAAUCU | 2057 |
| 54790_1_5933 | + | chr4: 105173220-105173240 | AGUUCCAACUCAAUCUUGGU | 2058 |
| 54790_1_5934 | + | chr4: 105173221-105173241 | GUUCCAACUCAAUCUUGGUU | 2059 |
| 54790_1_5936 | + | chr4: 105173226-105173246 | AACUCAAUCUUGGUUGGGUG | 2060 |
| 54790_1_5937 | + | chr4: 105173229-105173249 | UCAAUCUUGGUUGGGUGUGG | 2061 |
| 54790_1_5940 | + | chr4: 105173248-105173268 | GUGGCUCACGCCUGUGAUCC | 2062 |
| 54790_1_5942 | + | chr4: 105173256-105173276 | CGCCUGUGAUCCCGGCACUU | 2063 |
| 54790_1_5945 | + | chr4: 105173257-105173277 | GCCUGUGAUCCCGGCACUUU | 2064 |
| 54790_1_5946 | + | chr4: 105173260-105173280 | UGUGAUCCCGGCACUUUGGG | 2065 |
| 54790_1_5948 | + | chr4: 105173266-105173286 | CCCGGCACUUUGGGAGGCCG | 2066 |
| 54790_1_5950 | + | chr4: 105173269-105173289 | GGCACUUUGGGAGGCCGAGG | 2067 |
| 54790_1_5951 | + | chr4: 105173270-105173290 | GCACUUUGGGAGGCCGAGGU | 2068 |
| 54790_1_5957 | + | chr4: 105173287-105173307 | GGUGGGCAGAUCACGAGCUC | 2069 |
| 54790_1_5959 | + | chr4: 105173305-105173325 | UCAGGAGUUUGAGACCAGCC | 2070 |
| 54790_1_5960 | + | chr4: 105173314-105173334 | UGAGACCAGCCUGGCCAAUA | 2071 |
| 54790_1_5964 | + | chr4: 105173369-105173389 | AAAAAAAACAAAACUAGCC | 2072 |
| 54790_1_5965 | + | chr4: 105173374-105173394 | AAAACAAAACUAGCCCGGCA | 2073 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_5966 | + | chr4: 105173377-105173397 | ACAAAACUAGCCCGGCAUGG | 2074 |
| 54790_1_5969 | + | chr4: 105173404-105173424 | CUCCCGUAGUCCCAGCUACU | 2075 |
| 54790_1_5971 | + | chr4: 105173405-105173425 | UCCCGUAGUCCCAGCUACUU | 2076 |
| 54790_1_5972 | + | chr4: 105173408-105173428 | CGUAGUCCCAGCUACUUGGG | 2077 |
| 54790_1_5974 | + | chr4: 105173414-105173434 | CCCAGCUACUUGGGAGGCUG | 2078 |
| 54790_1_5977 | + | chr4: 105173418-105173438 | GCUACUUGGGAGGCUGAGGC | 2079 |
| 54790_1_5984 | + | chr4: 105173437-105173457 | CAGGAGAAUCGAUUGAACCC | 2080 |
| 54790_1_5985 | + | chr4: 105173440-105173460 | GAGAAUCGAUUGAACCCAGG | 2081 |
| 54790_1_5987 | + | chr4: 105173443-105173463 | AAUCGAUUGAACCCAGGAGG | 2082 |
| 54790_1_5989 | + | chr4: 105173446-105173466 | CGAUUGAACCCAGGAGGUGG | 2083 |
| 54790_1_5994 | + | chr4: 105173486-105173506 | UGCACCACUGCACUCCAGCC | 2084 |
| 54790_1_5995 | + | chr4: 105173487-105173507 | GCACCACUGCACUCCAGCCU | 2085 |
| 54790_1_6000 | + | chr4: 105173496-105173516 | CACUCCAGCCUGGGCAAAAG | 2086 |
| 54790_1_6002 | + | chr4: 105173497-105173517 | ACUCCAGCCUGGGCAAAAGA | 2087 |
| 54790_1_6010 | + | chr4: 105173579-105173599 | UGAGUCAUUUUAGUCAAUAA | 2088 |
| 54790_1_6024 | + | chr4: 105173634-105173654 | AAUUUGCUACAAGAAUGCAA | 2089 |
| 54790_1_6029 | + | chr4: 105173647-105173667 | AAUGCAAAGGUGAUGACAUG | 2090 |
| 54790_1_6032 | + | chr4: 105173655-105173675 | GGUGAUGACAUGAGGAAAAA | 2091 |
| 54790_1_6034 | + | chr4: 105173656-105173676 | GUGAUGACAUGAGGAAAAAA | 2092 |
| 54790_1_6035 | + | chr4: 105173657-105173677 | UGAUGACAUGAGGAAAAAAG | 2093 |
| 54790_1_6041 | + | chr4: 105173696-105173716 | CUCUACUACUCAGCAAAUGC | 2094 |
| 54790_1_6046 | + | chr4: 105173701-105173721 | CUACUCAGCAAAUGCAGGCC | 2095 |
| 54790_1_6047 | + | chr4: 105173731-105173751 | UUAUUCAAAUAUUUAUUACA | 2096 |
| 54790_1_6054 | + | chr4: 105173757-105173777 | AUUAAAACAUUUAUAAAAUU | 2097 |
| 54790_1_6066 | + | chr4: 105173817-105173837 | UAAACAAGAUUAUAAUCUAA | 2098 |
| 54790_1_6069 | + | chr4: 105173830-105173850 | AAUCUAAUGGAGAUUAAUAU | 2099 |
| 54790_1_6082 | + | chr4: 105173887-105173907 | GUUUAAUAAAAUAUUGACUU | 2100 |
| 54790_1_6088 | + | chr4: 105173902-105173922 | GACUUAGGUAGAUAUAUGUG | 2101 |
| 54790_1_6095 | + | chr4: 105173960-105173980 | UAUGUAUUUCUUAAAAGAGU | 2102 |
| 54790_1_6100 | + | chr4: 105173978-105173998 | GUAGGUAGCAAUGACUUCAA | 2103 |
| 54790_1_6116 | + | chr4: 105174112-105174132 | UCAUAUAAGUAAAAUUUU | 2104 |
| 54790_1_6117 | + | chr4: 105174113-105174133 | CAUAUAUAAGUAAAAUUUUA | 2105 |
| 54790_1_6119 | + | chr4: 105174114-105174134 | AUAUAUAAGUAAAAUUUUAG | 2106 |
| 54790_1_6159 | + | chr4: 105174312-105174332 | AGUAUUUCCUAAGAUUUAUU | 2107 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_6169 | + | chr4: 105174336-105174356 | AUAGAAGAUCGAUAUUUUUC | 2108 |
| 54790_1_6170 | + | chr4: 105174337-105174357 | UAGAAGAUCGAUAUUUUUCU | 2109 |
| 54790_1_6171 | + | chr4: 105174348-105174368 | UAUUUUUCUGGGAUGACAUA | 2110 |
| 54790_1_6183 | + | chr4: 105174420-105174440 | AAGUAAAAGCUGAAUGAAU | 2111 |
| 54790_1_6193 | + | chr4: 105174467-105174487 | UGUCAGAAAAUGAGAUUAU | 2112 |
| 54790_1_6194 | + | chr4: 105174468-105174488 | GUCAGAAAAUGAGAUUAUA | 2113 |
| 54790_1_6198 | + | chr4: 105174504-105174524 | CAAAUAUUAGAGAAGCAGAC | 2114 |
| 54790_1_6205 | + | chr4: 105174531-105174551 | UAGAAAGAAUCACAACUUAG | 2115 |
| 54790_1_6207 | + | chr4: 105174532-105174552 | AGAAAGAAUCACAACUUAGU | 2116 |
| 54790_1_6208 | + | chr4: 105174533-105174553 | GAAAGAAUCACAACUUAGUG | 2117 |
| 54790_1_6211 | + | chr4: 105174548-105174568 | UAGUGGGCAAAAACCUACA | 2118 |
| 54790_1_6215 | + | chr4: 105174561-105174581 | ACCUACAAGGAAAAUUUUUG | 2119 |
| 54790_1_6217 | + | chr4: 105174562-105174582 | CCUACAAGGAAAAUUUUUGU | 2120 |
| 54790_1_6218 | + | chr4: 105174568-105174588 | AGGAAAAUUUUUGUGGGAAC | 2121 |
| 54790_1_6219 | + | chr4: 105174575-105174595 | UUUUUGUGGGAACCGGUGCC | 2122 |
| 54790_1_6223 | + | chr4: 105174579-105174599 | UGUGGGAACCGGUGCCAGGU | 2123 |
| 54790_1_6230 | + | chr4: 105174616-105174636 | AAUUGAAAAAUUGUUCAGUG | 2124 |
| 54790_1_6231 | + | chr4: 105174617-105174637 | AUUGAAAAAUUGUUCAGUGU | 2125 |
| 54790_1_6232 | + | chr4: 105174620-105174640 | GAAAAAUUGUUCAGUGUGGG | 2126 |
| 54790_1_6236 | + | chr4: 105174633-105174653 | GUGUGGGCGGUUGUUCAGUG | 2127 |
| 54790_1_6239 | + | chr4: 105174644-105174664 | UGUUCAGUGUGGCAAGCUG | 2128 |
| 54790_1_6240 | + | chr4: 105174645-105174665 | GUUCAGUGUGGCAAGUCGA | 2129 |
| 54790_1_6245 | + | chr4: 105174659-105174679 | GUCUGAGGGUUAAAAACUCC | 2130 |
| 54790_1_6247 | + | chr4: 105174662-105174682 | UGAGGGUUAAAAACUCCAGG | 2131 |
| 54790_1_6251 | + | chr4: 105174674-105174694 | ACUCCAGGAGGACUCACUUA | 2132 |
| 54790_1_6253 | + | chr4: 105174678-105174698 | CAGGAGGACUCACUUACGGA | 2133 |
| 54790_1_6254 | + | chr4: 105174679-105174699 | AGGAGGACUCACUUACGGAA | 2134 |
| 54790_1_6258 | + | chr4: 105174708-105174728 | CUUUUGUGAGUUUAACCUCC | 2135 |
| 54790_1_6267 | + | chr4: 105174729-105174749 | GGAGUGUUCACAGUGACUAC | 2136 |
| 54790_1_6273 | + | chr4: 105174745-105174765 | CUACUGGAGAAAAUUCCCUA | 2137 |
| 54790_1_6274 | + | chr4: 105174746-105174766 | UACUGGAGAAAAUUCCCUAA | 2138 |
| 54790_1_6277 | + | chr4: 105174747-105174767 | ACUGGAGAAAAUUCCCUAAG | 2139 |
| 54790_1_6282 | + | chr4: 105174758-105174778 | UUCCCUAAGGGGAGAAGAAA | 2140 |
| 54790_1_6289 | + | chr4: 105174792-105174812 | AAUAUGUCAGAGCAUUUGU | 2141 |
| 54790_1_6297 | + | chr4: 105174843-105174863 | UUUACCAGAGCCUAAACUUU | 2142 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_6299 | + | chr4: 105174844-105174864 | UUACCAGAGCCUAAACUUUU | 2143 |
| 54790_1_6310 | + | chr4: 105174872-105174892 | AUAAGAGUGUAACCUCCCAA | 2144 |
| 54790_1_6313 | + | chr4: 105174873-105174893 | UAAGAGUGUAACCUCCCAAA | 2145 |
| 54790_1_6316 | + | chr4: 105174877-105174897 | AGUGUAACCUCCCAAAGGGA | 2146 |
| 54790_1_6319 | + | chr4: 105174878-105174898 | GUGUAACCUCCCAAAGGGAA | 2147 |
| 54790_1_6322 | + | chr4: 105174918-105174938 | CCCCUUUUAGCUUUCCACAU | 2148 |
| 54790_1_6325 | + | chr4: 105174919-105174939 | CCCUUUUAGCUUUCCACAUA | 2149 |
| 54790_1_6328 | + | chr4: 105174924-105174944 | UUAGCUUUCCACAUAGGGAA | 2150 |
| 54790_1_6335 | + | chr4: 105174941-105174961 | GAAAGGAAAAUAUAUAACUC | 2151 |
| 54790_1_6337 | + | chr4: 105174970-105174990 | CAAACCAUCCUGUCCACGUU | 2152 |
| 54790_1_6340 | + | chr4: 105174971-105174991 | AAACCAUCCUGUCCACGUUA | 2153 |
| 54790_1_6341 | + | chr4: 105174972-105174992 | AACCAUCCUGUCCACGUUAG | 2154 |
| 54790_1_6342 | + | chr4: 105174973-105174993 | ACCAUCCUGUCCACGUUAGG | 2155 |
| 54790_1_6345 | + | chr4: 105174979-105174999 | CUGUCCACGUUAGGGGGCCU | 2156 |
| 54790_1_6347 | + | chr4: 105174980-105175000 | UGUCCACGUUAGGGGCCUA | 2157 |
| 54790_1_6349 | + | chr4: 105174981-105175001 | GUCCACGUUAGGGGGCCUAG | 2158 |
| 54790_1_6354 | + | chr4: 105174996-105175016 | CCUAGGGAACUGAGAAAAC | 2159 |
| 54790_1_6357 | + | chr4: 105175015-105175035 | CUGGUGAAGUUCAUAGUCCA | 2160 |
| 54790_1_6358 | + | chr4: 105175016-105175036 | UGGUGAAGUUCAUAGUCCAU | 2161 |
| 54790_1_6362 | + | chr4: 105175035-105175055 | UGGGUACAGUUUCACCAAAG | 2162 |
| 54790_1_6365 | + | chr4: 105175036-105175056 | GGGUACAGUUUCACCAAAGA | 2163 |
| 54790_1_6368 | + | chr4: 105175052-105175072 | AAGAGGGAGACCAAAUUAUA | 2164 |
| 54790_1_6387 | + | chr4: 105175167-105175187 | CAUUCAACCAAAAAAUUAUA | 2165 |
| 54790_1_6389 | + | chr4: 105175179-105175199 | AAAUUAUAAGGCAUGCUAAA | 2166 |
| 54790_1_6391 | + | chr4: 105175183-105175203 | UAUAAGGCAUGCUAAAAGGC | 2167 |
| 54790_1_6400 | + | chr4: 105175234-105175254 | AUCAGAAGCAGAGUCAAAUA | 2168 |
| 54790_1_6403 | + | chr4: 105175246-105175266 | GUCAAAUAUGGCAGUGACAU | 2169 |
| 54790_1_6408 | + | chr4: 105175281-105175301 | AGAAACUUUAUAAAAAACUA | 2170 |
| 54790_1_6409 | + | chr4: 105175290-105175310 | AUAAAAAACUAUGGUUAAUA | 2171 |
| 54790_1_6415 | + | chr4: 105175295-105175315 | AAACUAUGGUUAAUAUGGUG | 2172 |
| 54790_1_6416 | + | chr4: 105175296-105175316 | AACUAUGGUUAAUAUGGUGA | 2173 |
| 54790_1_6421 | + | chr4: 105175326-105175346 | AAAUGACAUACAAGAACAGA | 2174 |
| 54790_1_6424 | + | chr4: 105175347-105175367 | GGAUAAUGUAAAUAUAGAGA | 2175 |
| 54790_1_6428 | + | chr4: 105175357-105175377 | AAUAUAGAGACGGAAAUUUU | 2176 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_6438 | + | chr4: 105175425-105175445 | AUGAUUAAAAUGUCUUUGAU | 2177 |
| 54790_1_6446 | + | chr4: 105175453-105175473 | AAGUAGAUUGAACAUAGCCG | 2178 |
| 54790_1_6450 | + | chr4: 105175474-105175494 | GGAAAAAAUCUUUGAAGUUA | 2179 |
| 54790_1_6453 | + | chr4: 105175487-105175507 | GAAGUUAAGGAUAUGAUAAU | 2180 |
| 54790_1_6466 | + | chr4: 105175559-105175579 | AGAGAUUAUUCAAGAACUGC | 2181 |
| 54790_1_6471 | + | chr4: 105175573-105175593 | AACUGCAGGAGAACUACAAA | 2182 |
| 54790_1_6473 | + | chr4: 105175592-105175612 | AAGGUAUAAUGUACGUGCAA | 2183 |
| 54790_1_6474 | + | chr4: 105175593-105175613 | AGGUAUAAUGUACGUGCAAU | 2184 |
| 54790_1_6482 | + | chr4: 105175616-105175636 | CAUACUAGAAAAAGAAAGAA | 2185 |
| 54790_1_6496 | + | chr4: 105175716-105175736 | GAGCUCAAAGAACACCAAGC | 2186 |
| 54790_1_6498 | + | chr4: 105175741-105175761 | AAAUGUCCCAAAACUACUCA | 2187 |
| 54790_1_6499 | + | chr4: 105175742-105175762 | AAUGUCCCAAAACUACUCAU | 2188 |
| 54790_1_6512 | + | chr4: 105175803-105175823 | AAAUAUCGAAAGAAUCCAGA | 2189 |
| 54790_1_6516 | + | chr4: 105175821-105175841 | GAAGGAAAAAACACCUAUAG | 2190 |
| 54790_1_6528 | + | chr4: 105175915-105175935 | AAGAUGUUGAAAGAAAAAUC | 2191 |
| 54790_1_6532 | + | chr4: 105175931-105175951 | AAUCCGGCAGUGUACGAUUC | 2192 |
| 54790_1_6545 | + | chr4: 105175997-105176017 | CUUAAAGAAACAAAAAUUUC | 2193 |
| 54790_1_6548 | + | chr4: 105176013-105176033 | UUUCAGGAAUUUGUUGCCAG | 2194 |
| 54790_1_6558 | + | chr4: 105176054-105176074 | GUUUAAAGUUCUUUAGAGAG | 2195 |
| 54790_1_6562 | + | chr4: 105176068-105176088 | AGAGAGAGGUAAAAUGAUAC | 2196 |
| 54790_1_6568 | + | chr4: 105176092-105176112 | UAGAAACUCAGAUCCACAUA | 2197 |
| 54790_1_6573 | + | chr4: 105176106-105176126 | CACAUAAGGAAAAUAAAAUU | 2198 |
| 54790_1_6574 | + | chr4: 105176107-105176127 | ACAUAAGGAAAAUAAAAUUA | 2199 |
| 54790_1_6592 | + | chr4: 105176223-105176243 | UAAGAUCAAGAACAAGACAA | 2200 |
| 54790_1_6595 | + | chr4: 105176254-105176274 | CUUACCACUUUGUUUCCUAC | 2201 |
| 54790_1_6602 | + | chr4: 105176283-105176303 | UACCUAAUGCAAUAAGACAA | 2202 |
| 54790_1_6609 | + | chr4: 105176312-105176332 | AAUGAAAGCAUACAGAUUC | 2203 |
| 54790_1_6612 | + | chr4: 105176315-105176335 | GAAAGCAUACAGAUUCCGG | 2204 |
| 54790_1_6617 | + | chr4: 105176342-105176362 | AAUCAAACUGUCUUUGUUCA | 2205 |
| 54790_1_6623 | + | chr4: 105176361-105176381 | ACGGAUGACAGUUGUUUAUA | 2206 |
| 54790_1_6625 | + | chr4: 105176373-105176393 | UGUUUAUAUGGAAUAUCCAA | 2207 |
| 54790_1_6635 | + | chr4: 105176393-105176413 | AGGAUCAGAAAAAAGAAAAC | 2208 |
| 54790_1_6636 | + | chr4: 105176417-105176437 | ACUAAUAAAUGAUUAUUGUA | 2209 |
| 54790_1_6679 | + | chr4: 105176727-105176747 | AAACACAGCACGAUAUUUUA | 2210 |
| 54790_1_6681 | + | chr4: 105176741-105176761 | AUUUUAUGGAUAUCAACAAA | 2211 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_6686 | + | chr4: 105176759-105176779 | AAAGGAUUCUAAAGUUUAUA | 2212 |
| 54790_1_6689 | + | chr4: 105176764-105176784 | AUUCUAAAGUUUAUAUGGAG | 2213 |
| 54790_1_6699 | + | chr4: 105176798-105176818 | AAUAGCCAACUCAGUAUUUG | 2214 |
| 54790_1_6704 | + | chr4: 105176817-105176837 | GAGGAGAACAACAAAGUCAG | 2215 |
| 54790_1_6706 | + | chr4: 105176832-105176852 | GUCAGAGGACUGACACUACC | 2216 |
| 54790_1_6711 | + | chr4: 105176873-105176893 | AGCUCAGAUAAUCAAUGUAG | 2217 |
| 54790_1_6712 | + | chr4: 105176874-105176894 | GCUCAGAUAAUCAAUGUAGU | 2218 |
| 54790_1_6713 | + | chr4: 105176880-105176900 | AUAAUCAAUGUAGUGGGUAC | 2219 |
| 54790_1_6718 | + | chr4: 105176907-105176927 | AGAAUAUUCAAAUAGACCAA | 2220 |
| 54790_1_6726 | + | chr4: 105176966-105176986 | UAAUCAAAUGAUCUUUGACA | 2221 |
| 54790_1_6727 | + | chr4: 105176967-105176987 | AAUCAAAUGAUCUUUGACAA | 2222 |
| 54790_1_6729 | + | chr4: 105176975-105176995 | GAUCUUUGACAAGGGAGCAA | 2223 |
| 54790_1_6733 | + | chr4: 105176986-105177006 | AGGGAGCAAAGGCAAUACAA | 2224 |
| 54790_1_6735 | + | chr4: 105176997-105177017 | GCAAUACAAUGGAGCAAAGA | 2225 |
| 54790_1_6737 | + | chr4: 105177019-105177039 | GUCUUUUCAACAAAUAAUGC | 2226 |
| 54790_1_6759 | + | chr4: 105177168-105177188 | AAACUCCCAGAAGAUAACAC | 2227 |
| 54790_1_6761 | + | chr4: 105177189-105177209 | GGAAAAAUCCUAGAUGACUU | 2228 |
| 54790_1_6762 | + | chr4: 105177194-105177214 | AAUCCUAGAUGACUUUGGUA | 2229 |
| 54790_1_6763 | + | chr4: 105177200-105177220 | AGAUGACUUUGGUAUGGCAG | 2230 |
| 54790_1_6766 | + | chr4: 105177225-105177245 | UUUUUUAGAUACAGCUCCAA | 2231 |
| 54790_1_6775 | + | chr4: 105177240-105177260 | UCCAAAGGCACGAUACAUGA | 2232 |
| 54790_1_6777 | + | chr4: 105177258-105177278 | GAAGGAAAUGAUUGACAAGC | 2233 |
| 54790_1_6791 | + | chr4: 105177331-105177351 | AUGAGAAGACAAGCCACAGA | 2234 |
| 54790_1_6796 | + | chr4: 105177365-105177385 | GCAAAGAUACUUCUCAUAA | 2235 |
| 54790_1_6814 | + | chr4: 105177499-105177519 | CACAAGUGUCAAGAAAGCAU | 2236 |
| 54790_1_6816 | + | chr4: 105177528-105177548 | UGUUAAACAUCAUAGUCAUU | 2237 |
| 54790_1_6817 | + | chr4: 105177529-105177549 | GUUAAACAUCAUAGUCAUUA | 2238 |
| 54790_1_6826 | + | chr4: 105177580-105177600 | CCGCUACAUACCUGUUAGAA | 2239 |
| 54790_1_6831 | + | chr4: 105177614-105177634 | ACACUGAUGAAACCAAGUGC | 2240 |
| 54790_1_6837 | + | chr4: 105177625-105177645 | ACCAAGUGCUGGUGAGAAUG | 2241 |
| 54790_1_6840 | + | chr4: 105177634-105177654 | UGGUGAGAAUGUGGAGCAAC | 2242 |
| 54790_1_6841 | + | chr4: 105177653-105177673 | CAGGAACCUUCAUUCAUUGC | 2243 |
| 54790_1_6846 | + | chr4: 105177669-105177689 | UUGCUGGUAAGAAUUCAAAA | 2244 |
| 54790_1_6850 | + | chr4: 105177683-105177703 | UCAAAAUGGCAUAGUCACUU | 2245 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_6852 | + | chr4: 105177695-105177715 | AGUCACUUUGGAAGACAGUU | 2246 |
| 54790_1_6861 | + | chr4: 105177753-105177773 | GAUUCAGCAAUAGCGCUCCU | 2247 |
| 54790_1_6864 | + | chr4: 105177758-105177778 | AGCAAUAGCGCUCCUUGGUA | 2248 |
| 54790_1_6867 | + | chr4: 105177779-105177799 | GGACUUGAAAACUUAUGUCC | 2249 |
| 54790_1_6869 | + | chr4: 105177783-105177803 | UUGAAAACUUAUGUCCUGGC | 2250 |
| 54790_1_6870 | + | chr4: 105177784-105177804 | UGAAAACUUAUGUCCUGGCC | 2251 |
| 54790_1_6874 | + | chr4: 105177819-105177839 | CGCCUGUAAUUGCAGCACUU | 2252 |
| 54790_1_6876 | + | chr4: 105177820-105177840 | GCCUGUAAUUGCAGCACUUU | 2253 |
| 54790_1_6878 | + | chr4: 105177823-105177843 | UGUAAUUGCAGCACUUUGGG | 2254 |
| 54790_1_6879 | + | chr4: 105177829-105177849 | UGCAGCACUUUGGGAGGCCC | 2255 |
| 54790_1_6881 | + | chr4: 105177833-105177853 | GCACUUUGGGAGGCCCAGGC | 2256 |
| 54790_1_6883 | + | chr4: 105177836-105177856 | CUUUGGGAGGCCCAGGCAGG | 2257 |
| 54790_1_6887 | + | chr4: 105177847-105177867 | CCAGGCAGGUGGAUCAUUUG | 2258 |
| 54790_1_6889 | + | chr4: 105177852-105177872 | CAGGUGGAUCAUUUGAGGUC | 2259 |
| 54790_1_6893 | + | chr4: 105177870-105177890 | UCAGGAGUUCAAGACCAGCC | 2260 |
| 54790_1_6896 | + | chr4: 105177883-105177903 | ACCAGCCUGGUGAAAUCCCA | 2261 |
| 54790_1_6899 | + | chr4: 105177923-105177943 | UAAAGAUACAAAAAAGUAGC | 2262 |
| 54790_1_6900 | + | chr4: 105177924-105177944 | AAAGAUACAAAAAAGUAGCU | 2263 |
| 54790_1_6901 | + | chr4: 105177929-105177949 | UACAAAAAAGUAGCUGGGUG | 2264 |
| 54790_1_6904 | + | chr4: 105177959-105177979 | CGCCUGUAAUCUCAGCUACU | 2265 |
| 54790_1_6906 | + | chr4: 105177960-105177980 | GCCUGUAAUCUCAGCUACUA | 2266 |
| 54790_1_6907 | + | chr4: 105177963-105177983 | UGUAAUCUCAGCUACUAGGG | 2267 |
| 54790_1_6909 | + | chr4: 105177969-105177989 | CUCAGCUACUAGGGAGGCUG | 2268 |
| 54790_1_6912 | + | chr4: 105177973-105177993 | GCUACUAGGGAGGCUGAGGC | 2269 |
| 54790_1_6917 | + | chr4: 105177992-105178012 | CAGGAGAAUCACUUGAGCCC | 2270 |
| 54790_1_6919 | + | chr4: 105177995-105178015 | GAGAAUCACUUGAGCCCAGG | 2271 |
| 54790_1_6921 | + | chr4: 105177998-105178018 | AAUCACUUGAGCCCAGGAGG | 2272 |
| 54790_1_6923 | + | chr4: 105178001-105178021 | CACUUGAGCCCAGGAGGCGG | 2273 |
| 54790_1_6936 | + | chr4: 105178163-105178183 | UUUACAUAAUUGCCAAAACU | 2274 |
| 54790_1_6937 | + | chr4: 105178164-105178184 | UUACAUAAUUGCCAAAACUU | 2275 |
| 54790_1_6944 | + | chr4: 105178196-105178216 | GAUAUCCUUUAAUAUUUGAG | 2276 |
| 54790_1_6947 | + | chr4: 105178207-105178227 | AUAUUUGAGUGGAUAAACUG | 2277 |
| 54790_1_6958 | + | chr4: 105178273-105178293 | UAUCACAUCAUAAAACGACA | 2278 |
| 54790_1_6965 | + | chr4: 105178322-105178342 | UGAAAGAAGCUAAUCCGAAA | 2279 |
| 54790_1_6967 | + | chr4: 105178359-105178379 | AUUCCAACUAUAUGACAUUC | 2280 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_6971 | + | chr4: 105178376-105178396 | UUCCGGAAAAGCCAAAAUUA | 2281 |
| 54790_1_6979 | + | chr4: 105178407-105178427 | AAAAGAGCAGUGUUUUCCAG | 2282 |
| 54790_1_6981 | + | chr4: 105178408-105178428 | AAAGAGCAGUGUUUUCCAGA | 2283 |
| 54790_1_6984 | + | chr4: 105178411-105178431 | GAGCAGUGUUUUCCAGAGGG | 2284 |
| 54790_1_6985 | + | chr4: 105178421-105178441 | UUCCAGAGGGAGGAAUGUAU | 2285 |
| 54790_1_6995 | + | chr4: 105178466-105178486 | GAAUCUAUGUAAUACUAUAG | 2286 |
| 54790_1_6997 | + | chr4: 105178469-105178489 | UCUAUGUAAUACUAUAGUGG | 2287 |
| 54790_1_6999 | + | chr4: 105178504-105178524 | AUACAUUUGUCCAAACACGU | 2288 |
| 54790_1_7005 | + | chr4: 105178542-105178562 | GUGAACCCUAAUGUAAACUA | 2289 |
| 54790_1_7007 | + | chr4: 105178543-105178563 | UGAACCCUAAUGUAAACUAU | 2290 |
| 54790_1_7008 | + | chr4: 105178544-105178564 | GAACCCUAAUGUAAACUAUG | 2291 |
| 54790_1_7010 | + | chr4: 105178549-105178569 | CUAAUGUAAACUAUGGGGUU | 2292 |
| 54790_1_7011 | + | chr4: 105178550-105178570 | UAAUGUAAACUAUGGGGUUU | 2293 |
| 54790_1_7014 | + | chr4: 105178572-105178592 | GUAUCAAAAUGCAUCAAUGU | 2294 |
| 54790_1_7017 | + | chr4: 105178603-105178623 | UUGUAACAAAUAUACCACUC | 2295 |
| 54790_1_7020 | + | chr4: 105178608-105178628 | ACAAAUAUACCACUCUGGUA | 2296 |
| 54790_1_7022 | + | chr4: 105178609-105178629 | CAAAUAUACCACUCUGGUAU | 2297 |
| 54790_1_7024 | + | chr4: 105178622-105178642 | CUGGUAUGGGAUGUUGAUAA | 2298 |
| 54790_1_7027 | + | chr4: 105178623-105178643 | UGGUAUGGGAUGUUGAUAAU | 2299 |
| 54790_1_7028 | + | chr4: 105178624-105178644 | GGUAUGGGAUGUUGAUAAUG | 2300 |
| 54790_1_7030 | + | chr4: 105178628-105178648 | UGGGAUGUUGAUAAUGGGA | 2301 |
| 54790_1_7032 | + | chr4: 105178634-105178654 | GUUGAUAAUGGGGAAGGUUG | 2302 |
| 54790_1_7033 | + | chr4: 105178635-105178655 | UUGAUAAUGGGGAAGGUUGU | 2303 |
| 54790_1_7036 | + | chr4: 105178642-105178662 | UGGGGAAGGUUGUGGGUCUG | 2304 |
| 54790_1_7038 | + | chr4: 105178643-105178663 | GGGGAAGGUUGUGGGUCUGU | 2305 |
| 54790_1_7040 | + | chr4: 105178644-105178664 | GGGAAGGUUGUGGGUCUGUG | 2306 |
| 54790_1_7043 | + | chr4: 105178649-105178669 | GGUUGUGGGUCUGUGGGGAC | 2307 |
| 54790_1_7044 | + | chr4: 105178650-105178670 | GUUGUGGGUCUGUGGGGACA | 2308 |
| 54790_1_7045 | + | chr4: 105178651-105178671 | UUGUGGGUCUGUGGGGACAG | 2309 |
| 54790_1_7049 | + | chr4: 105178658-105178678 | UCUGUGGGGACAGGGGUAUA | 2310 |
| 54790_1_7050 | + | chr4: 105178659-105178679 | CUGUGGGGACAGGGGUAUAU | 2311 |
| 54790_1_7068 | + | chr4: 105178774-105178794 | AAUAAUAAUAAAAUAAAUUU | 2312 |
| 54790_1_7084 | + | chr4: 105178879-105178899 | UGAGACUGAGUAAUUUAUAA | 2313 |
| 54790_1_7089 | + | chr4: 105178912-105178932 | AAUUGACUCACAGUUUAGCA | 2314 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_7093 | + | chr4: 105178916-105178936 | GACUCACAGUUUAGCAUGGC | 2315 |
| 54790_1_7097 | + | chr4: 105178917-105178937 | ACUCACAGUUUAGCAUGGCU | 2316 |
| 54790_1_7098 | + | chr4: 105178918-105178938 | CUCACAGUUUAGCAUGGCUG | 2317 |
| 54790_1_7100 | + | chr4: 105178921-105178941 | ACAGUUUAGCAUGGCUGGGG | 2318 |
| 54790_1_7102 | + | chr4: 105178928-105178948 | AGCAUGGCUGGGGAGGUCUC | 2319 |
| 54790_1_7106 | + | chr4: 105178945-105178965 | CUCAGGAAACUUAACAGUCA | 2320 |
| 54790_1_7107 | + | chr4: 105178949-105178969 | GGAAACUUAACAGUCAUGGC | 2321 |
| 54790_1_7109 | + | chr4: 105178965-105178985 | UGGCAGGUGACUUCACAAAG | 2322 |
| 54790_1_7111 | + | chr4: 105178969-105178989 | AGGUGACUUCACAAAGUGGC | 2323 |
| 54790_1_7114 | + | chr4: 105178973-105178993 | GACUUCACAAAGUGGCAGGA | 2324 |
| 54790_1_7127 | + | chr4: 105179059-105179079 | UCCCUAUGAUGAGAACAGCA | 2325 |
| 54790_1_7130 | + | chr4: 105179060-105179080 | CCCUAUGAUGAGAACAGCAU | 2326 |
| 54790_1_7131 | + | chr4: 105179061-105179081 | CCUAUGAUGAGAACAGCAUG | 2327 |
| 54790_1_7132 | + | chr4: 105179062-105179082 | CUAUGAUGAGAACAGCAUGG | 2328 |
| 54790_1_7133 | + | chr4: 105179096-105179116 | AUGAUCCAAUUACUUCCACC | 2329 |
| 54790_1_7137 | + | chr4: 105179115-105179135 | CUGGUCUCUGCCUUGACACA | 2330 |
| 54790_1_7138 | + | chr4: 105179116-105179136 | UGGUCUCUGCCUUGACACAU | 2331 |
| 54790_1_7140 | + | chr4: 105179124-105179144 | GCCUUGACACAUGGGUAUUA | 2332 |
| 54790_1_7145 | + | chr4: 105179133-105179153 | CAUGGGUAUUAUGGAGAUUA | 2333 |
| 54790_1_7147 | + | chr4: 105179134-105179154 | AUGGGUAUUAUGGAGAUUAU | 2334 |
| 54790_1_7148 | + | chr4: 105179135-105179155 | UGGGUAUUAUGGAGAUUAUG | 2335 |
| 54790_1_7153 | + | chr4: 105179159-105179179 | UUAUAAUUCAAGAUGAGAUU | 2336 |
| 54790_1_7154 | + | chr4: 105179160-105179180 | UAUAAUUCAAGAUGAGAUUU | 2337 |
| 54790_1_7157 | + | chr4: 105179163-105179183 | AAUUCAAGAUGAGAUUUGGG | 2338 |
| 54790_1_7160 | + | chr4: 105179164-105179184 | AUUCAAGAUGAGAUUUGGGU | 2339 |
| 54790_1_7161 | + | chr4: 105179165-105179185 | UUCAAGAUGAGAUUUGGGUG | 2340 |
| 54790_1_7167 | + | chr4: 105179215-105179235 | AAACUAUGUCUUUUCUUUUA | 2341 |
| 54790_1_7168 | + | chr4: 105179216-105179236 | AACUAUGUCUUUUCUUUUAU | 2342 |
| 54790_1_7169 | + | chr4: 105179217-105179237 | ACUAUGUCUUUUCUUUUAUG | 2343 |
| 54790_1_7183 | + | chr4: 105179272-105179292 | GACCUCCAUUUUCCAAUUUC | 2344 |
| 54790_1_7188 | + | chr4: 105179277-105179297 | CCAUUUUCCAAUUUCUGGUU | 2345 |
| 54790_1_7209 | + | chr4: 105179363-105179383 | AAUCUUUCAUUAAAAGAAAU | 2346 |
| 54790_1_7211 | + | chr4: 105179364-105179384 | AUCUUUCAUUAAAAGAAAUA | 2347 |
| 54790_1_7213 | + | chr4: 105179365-105179385 | UCUUUCAUUAAAAGAAAUAG | 2348 |
| 54790_1_7214 | + | chr4: 105179368-105179388 | UUCAUUAAAAGAAAUAGGGG | 2349 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_7219 | + | chr4: 105179374-105179394 | AAAAGAAAUAGGGGAGGUGA | 2350 |
| 54790_1_7222 | + | chr4: 105179375-105179395 | AAAGAAAUAGGGGAGGUGAU | 2351 |
| 54790_1_7224 | + | chr4: 105179376-105179396 | AAGAAAUAGGGGAGGUGAUG | 2352 |
| 54790_1_7225 | + | chr4: 105179377-105179397 | AGAAAUAGGGGAGGUGAUGG | 2353 |
| 54790_1_7228 | + | chr4: 105179397-105179417 | GGGAUAUCCAUGAGUGUCCA | 2354 |
| 54790_1_7229 | + | chr4: 105179398-105179418 | GGAUAUCCAUGAGUGUCCAU | 2355 |
| 54790_1_7234 | + | chr4: 105179450-105179470 | AUGAUACUGCAAAGCCUACA | 2356 |
| 54790_1_7243 | + | chr4: 105179532-105179552 | AUCUUGUUUCAUUUUAUGUG | 2357 |
| 54790_1_7259 | + | chr4: 105179583-105179603 | UGAAAAAUAUCCUCUUCAUU | 2358 |
| 54790_1_7260 | + | chr4: 105179584-105179604 | GAAAAAUAUCCUCUUCAUUU | 2359 |
| 54790_1_7277 | + | chr4: 105179688-105179708 | AUAAUGCAUGACUUCAUUCA | 2360 |
| 54790_1_7278 | + | chr4: 105179697-105179717 | GACUUCAUUCAUGGCUCUCU | 2361 |
| 54790_1_7281 | + | chr4: 105179719-105179739 | GUGACCUGUGUACCCUGACC | 2362 |
| 54790_1_7283 | + | chr4: 105179753-105179773 | AGAGUAUUAAGUCAUUUCAG | 2363 |
| 54790_1_7288 | + | chr4: 105179766-105179786 | AUUUCAGUGGCACAUGUUUG | 2364 |
| 54790_1_7289 | + | chr4: 105179767-105179787 | UUUCAGUGGCACAUGUUUGA | 2365 |
| 54790_1_7296 | + | chr4: 105179786-105179806 | AGGGAAGAUUGACAUCCCAC | 2366 |
| 54790_1_7301 | + | chr4: 105179835-105179855 | AAGCAGCUGCAUUCCUAGUG | 2367 |
| 54790_1_7303 | + | chr4: 105179862-105179882 | AUUAAGUUUAUCCCACUAUU | 2368 |
| 54790_1_7307 | + | chr4: 105179868-105179888 | UUUAUCCCACUAUUAGGUUC | 2369 |
| 54790_1_7314 | + | chr4: 105179893-105179913 | UAUUACUUGUCAUGCCCAAG | 2370 |
| 54790_1_7319 | + | chr4: 105179922-105179942 | UUUCUAGCAUGCAGAGUAUC | 2371 |
| 54790_1_7324 | + | chr4: 105179932-105179952 | GCAGAGUAUCUGGUUUUUAA | 2372 |
| 54790_1_7332 | + | chr4: 105179965-105179985 | GAAAUAAAAUGUGCCUACUA | 2373 |
| 54790_1_7333 | + | chr4: 105179966-105179986 | AAAUAAAAUGUGCCUACUAA | 2374 |
| 54790_1_7339 | + | chr4: 105180011-105180031 | UCUUUCACUGUUUUUUUCU | 2375 |
| 54790_1_7342 | + | chr4: 105180014-105180034 | UUCACUGUUUUUUUCUUGG | 2376 |
| 54790_1_7353 | + | chr4: 105180037-105180057 | UUACAGUAGUUAUGCCUUUC | 2377 |
| 54790_1_7355 | + | chr4: 105180045-105180065 | GUUAUGCCUUUCUGGUCAGC | 2378 |
| 54790_1_7363 | + | chr4: 105180093-105180113 | CUUUCACAUCUUCAAGUGUA | 2379 |
| 54790_1_7375 | + | chr4: 105180168-105180188 | CUUUCAGUAUUGAUUUCUCA | 2380 |
| 54790_1_7383 | + | chr4: 105180191-105180211 | CCUAUGAACCUGAGUCAACU | 2381 |
| 54790_1_7385 | + | chr4: 105180199-105180219 | CCUGAGUCAACUUGGCAUAA | 2382 |
| 54790_1_7391 | + | chr4: 105180237-105180257 | UUCUCUAAAUGCAGAGUCAG | 2383 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_7399 | + | chr4: 105180284-105180304 | GCUCAGUGAUAACAUUAAAA | 2384 |
| 54790_1_7410 | + | chr4: 105180351-105180371 | AAAUCUCAGUCAUUAAUACA | 2385 |
| 54790_1_7413 | + | chr4: 105180354-105180374 | UCUCAGUCAUUAAUACAUGG | 2386 |
| 54790_1_7415 | + | chr4: 105180388-105180408 | UAUUACAUGCCUGUGCUUCU | 2387 |
| 54790_1_7430 | + | chr4: 105180472-105180492 | UUAUCUUUUUUGUUUUACC | 2388 |
| 54790_1_7460 | + | chr4: 105180574-105180594 | AAUAUUCUCCAUGAUCUCCA | 2389 |
| 54790_1_7469 | + | chr4: 105180637-105180657 | UAUCAUUUUUUUUUUUUCU | 2390 |
| 54790_1_7486 | + | chr4: 105180662-105180682 | ACAGUCUCACUCUGUUGCCC | 2391 |
| 54790_1_7489 | + | chr4: 105180666-105180686 | UCUCACUCUGUUGCCCAGGC | 2392 |
| 54790_1_7490 | + | chr4: 105180667-105180687 | CUCACUCUGUUGCCCAGGCU | 2393 |
| 54790_1_7497 | + | chr4: 105180743-105180763 | AUUCUCCUGCCUCAGCCUGC | 2394 |
| 54790_1_7498 | + | chr4: 105180744-105180764 | UUCUCCUGCCUCAGCCUGCC | 2395 |
| 54790_1_7502 | + | chr4: 105180760-105180780 | UGCCGGGUAGCUAGAAUUAC | 2396 |
| 54790_1_7503 | + | chr4: 105180779-105180799 | CAGGCAUGUGCCACCACACC | 2397 |
| 54790_1_7507 | + | chr4: 105180807-105180827 | UCUGUAUUUUUAGUAGAGAC | 2398 |
| 54790_1_7508 | + | chr4: 105180808-105180828 | CUGUAUUUUUAGUAGAGACA | 2399 |
| 54790_1_7514 | + | chr4: 105180822-105180842 | GAGACAGGGUUUCACGAUGU | 2400 |
| 54790_1_7515 | + | chr4: 105180831-105180851 | UUUCACGAUGUUGGCCAGAC | 2401 |
| 54790_1_7520 | + | chr4: 105180852-105180872 | GGUCUUGAACUCCUGACCUC | 2402 |
| 54790_1_7523 | + | chr4: 105180885-105180905 | ACCGCAGCCUCCCAAAGUGC | 2403 |
| 54790_1_7525 | + | chr4: 105180894-105180914 | UCCCAAAGUGCUGGAAUUAC | 2404 |
| 54790_1_7527 | + | chr4: 105180901-105180921 | GUGCUGGAAUUACAGGCGUG | 2405 |
| 54790_1_7529 | + | chr4: 105180913-105180933 | CAGGCGUGAGGCACUGCAUC | 2406 |
| 54790_1_7568 | + | chr4: 105181171-105181191 | GCUACGAUCUAUAUACUCCU | 2407 |
| 54790_1_7577 | + | chr4: 105181226-105181246 | UGUGUGUGUCUGUAUAGUAG | 2408 |
| 54790_1_7585 | + | chr4: 105181266-105181286 | UAGUCACAAUAUGCUUUUUG | 2409 |
| 54790_1_7590 | + | chr4: 105181282-105181302 | UUUGAGGAUUUCCUUUUCC | 2410 |
| 54790_1_7592 | + | chr4: 105181283-105181303 | UUGAGGAUUUCCUUUUCCU | 2411 |
| 54790_1_7626 | + | chr4: 105181394-105181414 | CUCUUCCAUCUUAGAAGAGC | 2412 |
| 54790_1_7629 | + | chr4: 105181425-105181445 | AACCGACUCUUCUUUUAUCU | 2413 |
| 54790_1_7635 | + | chr4: 105181442-105181462 | UCUUGGUUUCUACAACACAG | 2414 |
| 54790_1_7641 | + | chr4: 105181475-105181495 | ACUUUAAUCCCUUUUAACAC | 2415 |
| 54790_1_7659 | + | chr4: 105181548-105181568 | AAAAUCUAGCAAAUAAAAAA | 2416 |
| 54790_1_7676 | + | chr4: 105181663-105181683 | AUUAUGAUAUGCUUAUUCAU | 2417 |
| 54790_1_7682 | + | chr4: 105181703-105181723 | GCAAUAGUGUAGCCCCUUCU | 2418 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_7695 | + | chr4: 105181796-105181816 | UUGUUAUAAAAAUACUCAUU | 2419 |
| 54790_1_7713 | + | chr4: 105181876-105181896 | UUAUACUACUUUCUUUAUUU | 2420 |
| 54790_1_7716 | + | chr4: 105181877-105181897 | UAUACUACUUUCUUUAUUUA | 2421 |
| 54790_1_7722 | + | chr4: 105181880-105181900 | ACUACUUUCUUUAUUUAGGG | 2422 |
| 54790_1_7729 | + | chr4: 105181906-105181926 | GUAUUUAAAUUCUGUUAUCU | 2423 |
| 54790_1_7774 | + | chr4: 105182067-105182087 | UUUCCCUAUCAUUUGUUCUC | 2424 |
| 54790_1_7783 | + | chr4: 105182112-105182132 | CAUUUUUUUCCAGUGACAAA | 2425 |
| 54790_1_7806 | + | chr4: 105182194-105182214 | UGCAAACAACCAGAGCUGAU | 2426 |
| 54790_1_7807 | + | chr4: 105182201-105182221 | AACCAGAGCUGAUAGGCAGC | 2427 |
| 54790_1_7809 | + | chr4: 105182216-105182236 | GCAGCAGGUGCACAUGAGUG | 2428 |
| 54790_1_7810 | + | chr4: 105182228-105182248 | CAUGAGUGUGGCUGUGCUGA | 2429 |
| 54790_1_7812 | + | chr4: 105182248-105182268 | UGGUUACUGAAAGAUUUCCA | 2430 |
| 54790_1_7818 | + | chr4: 105182304-105182324 | GCUCCUUCCCCAUUACUCCC | 2431 |
| 54790_1_7819 | + | chr4: 105182305-105182325 | CUCCUUCCCCAUUACUCCCU | 2432 |
| 54790_1_7824 | + | chr4: 105182340-105182360 | CCUGCAGCUAGAAUAAUAAA | 2433 |
| 54790_1_7825 | + | chr4: 105182348-105182368 | UAGAAUAAUAAAUGGCAUGU | 2434 |
| 54790_1_7827 | + | chr4: 105182358-105182378 | AAUGGCAUGUAGGUUCCUCU | 2435 |
| 54790_1_7830 | + | chr4: 105182389-105182409 | CCAGCACUAUGUCUCAUGCC | 2436 |
| 54790_1_7833 | + | chr4: 105182431-105182451 | UUUUGAUUAUCACUCCUGUG | 2437 |
| 54790_1_7839 | + | chr4: 105182436-105182456 | AUUAUCACUCCUGUGUGGUA | 2438 |
| 54790_1_7840 | + | chr4: 105182437-105182457 | UUAUCACUCCUGUGUGGUAA | 2439 |
| 54790_1_7858 | + | chr4: 105182551-105182571 | UAGUUUGUUUUUAACAAACC | 2440 |
| 54790_1_7906 | + | chr4: 105182695-105182715 | UUAGAGAAUAUUGUUACUGA | 2441 |
| 54790_1_7941 | + | chr4: 105182864-105182884 | CUUUAAACCUUAGCUCAUAU | 2442 |
| 54790_1_7948 | + | chr4: 105182902-105182922 | CAUCCUUAGAUGAAGAUAUU | 2443 |
| 54790_1_7949 | + | chr4: 105182903-105182923 | AUCCUUAGAUGAAGAUAUUU | 2444 |
| 54790_1_7964 | + | chr4: 105182973-105182993 | UCCAUUUGAAGAAAUUGUA | 2445 |
| 54790_1_7966 | + | chr4: 105182977-105182997 | UUUUGAAGAAAUUGUAAGGU | 2446 |
| 54790_1_7967 | + | chr4: 105182978-105182998 | UUUGAAGAAAUUGUAAGGUA | 2447 |
| 54790_1_7976 | + | chr4: 105183043-105183063 | AAAAUCAUUUUUAAAAUAUC | 2448 |
| 54790_1_7977 | + | chr4: 105183044-105183064 | AAAUCAUUUUUAAAAUAUCU | 2449 |
| 54790_1_7983 | + | chr4: 105183061-105183081 | UCUGGGUUAAUGCUAUAGAU | 2450 |
| 54790_1_7992 | + | chr4: 105183117-105183137 | GUUUAUUGAUCCUCAAUCUG | 2451 |
| 54790_1_7997 | + | chr4: 105183130-105183150 | CAAUCUGUGGCUGUUUUAAA | 2452 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_8004 | + | chr4: 105183164-105183184 | AGUUCAGUCUAAGAGAACCA | 2453 |
| 54790_1_8015 | + | chr4: 105183230-105183250 | AUAUUAAAUUACUAAAUAUA | 2454 |
| 54790_1_8021 | + | chr4: 105183261-105183281 | AUAUAUUGUAAAAAUUGCUU | 2455 |
| 54790_1_8026 | + | chr4: 105183282-105183302 | GGAAUCAAUAAUAAGUAUUG | 2456 |
| 54790_1_8032 | + | chr4: 105183315-105183335 | UAGUUAUAUAUUACAAUGUA | 2457 |
| 54790_1_8033 | + | chr4: 105183316-105183336 | AGUUAUAUAUUACAAUGUAA | 2458 |
| 54790_1_8067 | + | chr4: 105183465-105183485 | AUUCGAUAGUAUCUAAAUCA | 2459 |
| 54790_1_8070 | + | chr4: 105183487-105183507 | GAAUCAUAAAACCUUAAAGC | 2460 |
| 54790_1_8071 | + | chr4: 105183488-105183508 | AAUCAUAAAACCUUAAAGCU | 2461 |
| 54790_1_8074 | + | chr4: 105183492-105183512 | AUAAAACCUUAAAGCUGGGU | 2462 |
| 54790_1_8079 | + | chr4: 105183524-105183544 | AAUACAAUUUAACAUCUUAU | 2463 |
| 54790_1_8083 | + | chr4: 105183556-105183576 | CCUCAGUUUCCCUAAGUGAU | 2464 |
| 54790_1_8088 | + | chr4: 105183577-105183597 | GGCUCAAGAUCAUGAAUUUA | 2465 |
| 54790_1_8091 | + | chr4: 105183580-105183600 | UCAAGAUCAUGAAUUUAUGG | 2466 |
| 54790_1_8108 | + | chr4: 105183660-105183680 | CUACCCCUUAGUUUGCCUG | 2467 |
| 54790_1_8109 | + | chr4: 105183661-105183681 | UACCCCCUUAGUUUGCCUGU | 2468 |
| 54790_1_8111 | + | chr4: 105183668-105183688 | UUAGUUUGCCUGUGGGUUUA | 2469 |
| 54790_1_8117 | + | chr4: 105183678-105183698 | UGUGGGUUUAUGGAAGUUAC | 2470 |
| 54790_1_8155 | + | chr4: 105183894-105183914 | AUACUACUUGAAAUUUCUAG | 2471 |
| 54790_1_8156 | + | chr4: 105183895-105183915 | UACUACUUGAAAUUUCUAGC | 2472 |
| 54790_1_8158 | + | chr4: 105183896-105183916 | ACUACUUGAAAUUUCUAGCG | 2473 |
| 54790_1_8163 | + | chr4: 105183913-105183933 | GCGGGGAUCUCUAAAAUGCC | 2474 |
| 54790_1_8166 | + | chr4: 105183921-105183941 | CUCUAAAAUGCCUGGAUGUU | 2475 |
| 54790_1_8167 | + | chr4: 105183926-105183946 | AAAUGCCUGGAUGUUAGGAA | 2476 |
| 54790_1_8174 | + | chr4: 105183965-105183985 | AAUUAUAUUUCUAUUUUAG | 2477 |
| 54790_1_8184 | + | chr4: 105183993-105184013 | AAAUAAACCAUACCCUUAAG | 2478 |
| 54790_1_8191 | + | chr4: 105184031-105184051 | AUUUUGAGCACAUCCUUCAU | 2479 |
| 54790_1_8197 | + | chr4: 105184052-105184072 | GGCCCAGUCUCUGACCAGUG | 2480 |
| 54790_1_8218 | + | chr4: 105184141-105184161 | AUUUUCUGUGUGAUGUUUAU | 2481 |
| 54790_1_8219 | + | chr4: 105184142-105184162 | UUUUCUGUGUGAUGUUUAUA | 2482 |
| 54790_1_8229 | + | chr4: 105184172-105184192 | UUCUGAAAUGUUUUCCAUCU | 2483 |
| 54790_1_8245 | + | chr4: 105184231-105184251 | UCAUAACUUCUUUUUAUUUU | 2484 |
| 54790_1_8260 | + | chr4: 105184311-105184331 | ACCUCUCAUGUUCCAGUGUU | 2485 |
| 54790_1_8267 | + | chr4: 105184338-105184358 | UAAAUAAUCACUUUGUAUAA | 2486 |
| 54790_1_8271 | + | chr4: 105184367-105184387 | UAUGUUAAAUUGUUUAUAAC | 2487 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_8272 | + | chr4: 105184370-105184390 | GUUAAAUUGUUUAUAACUGG | 2488 |
| 54790_1_8277 | + | chr4: 105184392-105184412 | GUUGAUAUUUCAGCCUUGUU | 2489 |
| 54790_1_8287 | + | chr4: 105184439-105184459 | UAAUUAGAAACAACCUCAUA | 2490 |
| 54790_1_8292 | + | chr4: 105184464-105184484 | UAUGCUUGUUUUUAUCUUCA | 2491 |
| 54790_1_8305 | + | chr4: 105184497-105184517 | GCAAACACUGAGUUCUUUAC | 2492 |
| 54790_1_8306 | + | chr4: 105184498-105184518 | CAAACACUGAGUUCUUUACU | 2493 |
| 54790_1_8313 | + | chr4: 105184522-105184542 | GUCACCACUUUGUCUAUGUU | 2494 |
| 54790_1_8316 | + | chr4: 105184525-105184545 | ACCACUUUGUCUAUGUUAGG | 2495 |
| 54790_1_8319 | + | chr4: 105184531-105184551 | UUGUCUAUGUUAGGAGGAGC | 2496 |
| 54790_1_8324 | + | chr4: 105184549-105184569 | GCAGGAAGUGAAUACAUUUA | 2497 |
| 54790_1_8333 | + | chr4: 105184588-105184608 | UAAAACUUUGACUACUGUAG | 2498 |
| 54790_1_8339 | + | chr4: 105184608-105184628 | UGGUUUUUUAAAGCAUUAAC | 2499 |
| 54790_1_8349 | + | chr4: 105184663-105184683 | CUGAAAUAGCACUUCCCUUU | 2500 |
| 54790_1_8353 | + | chr4: 105184677-105184697 | CCCUUUAGGCACUGUACAGU | 2501 |
| 54790_1_8359 | + | chr4: 105184698-105184718 | GGAAUCAUUUACUUGCAGAG | 2502 |
| 54790_1_8370 | + | chr4: 105184750-105184770 | GUACUCAUGUGUAUAAGAAU | 2503 |
| 54790_1_8374 | + | chr4: 105184765-105184785 | AGAAUAGGAGAAACACUUUG | 2504 |
| 54790_1_8375 | + | chr4: 105184766-105184786 | GAAUAGGAGAAACACUUUGU | 2505 |
| 54790_1_8377 | + | chr4: 105184781-105184801 | UUUGUGGGCAUAUCCUGCUG | 2506 |
| 54790_1_8384 | + | chr4: 105184831-105184851 | AGUCUCAUCCCAUUUAAACC | 2507 |
| 54790_1_8387 | + | chr4: 105184834-105184854 | CUCAUCCCAUUUAAACCUGG | 2508 |
| 54790_1_8395 | + | chr4: 105184880-105184900 | AGCCAAAGCAGCAUUUCAAC | 2509 |
| 54790_1_8398 | + | chr4: 105184884-105184904 | AAAGCAGCAUUUCAACAGGA | 2510 |
| 54790_1_8402 | + | chr4: 105184900-105184920 | AGGAAGGAAACAUCUAUUAC | 2511 |
| 54790_1_8404 | + | chr4: 105184901-105184921 | GGAAGGAAACAUCUAUUACU | 2512 |
| 54790_1_8405 | + | chr4: 105184902-105184922 | GAAGGAAACAUCUAUUACUG | 2513 |
| 54790_1_8411 | + | chr4: 105184926-105184946 | UUUGAAGAAACAUGCCAUGA | 2514 |
| 54790_1_8416 | + | chr4: 105184945-105184965 | AAGGUGUACUAAUAUCACAA | 2515 |
| 54790_1_8418 | + | chr4: 105184946-105184966 | AGGUGUACUAAUAUCACAAA | 2516 |
| 54790_1_8421 | + | chr4: 105184950-105184970 | GUACUAAUAUCACAAAGGGA | 2517 |
| 54790_1_8422 | + | chr4: 105184951-105184971 | UACUAAUAUCACAAAGGGAA | 2518 |
| 54790_1_8425 | + | chr4: 105184955-105184975 | AAUAUCACAAAGGGAAGGGA | 2519 |
| 54790_1_8428 | + | chr4: 105184997-105185017 | ACAAAGUCCCUUUUUUGUAA | 2520 |
| 54790_1_8435 | + | chr4: 105185024-105185044 | GUUUGAUGAUGUUUGAUCAA | 2521 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_8437 | + | chr4: 105185027-105185047 | UGAUGAUGUUUGAUCAAUGG | 2522 |
| 54790_1_8444 | + | chr4: 105185044-105185064 | UGGUGGAUCUAUCUCUUGAA | 2523 |
| 54790_1_8449 | + | chr4: 105185068-105185088 | AAAUGCAUUUAAACCCCAAA | 2524 |
| 54790_1_8451 | + | chr4: 105185071-105185091 | UGCAUUUAAACCCCAAAUGG | 2525 |
| 54790_1_8454 | + | chr4: 105185085-105185105 | AAAUGGAGGAUUCUUAUAUA | 2526 |
| 54790_1_8458 | + | chr4: 105185120-105185140 | AAUGAUAUAUUCAUGUUUAU | 2527 |
| 54790_1_8460 | + | chr4: 105185132-105185152 | AUGUUUAUAGGUAGAGUGAC | 2528 |
| 54790_1_8467 | + | chr4: 105185147-105185167 | GUGACUGGUUUUUAGAGAAG | 2529 |
| 54790_1_8489 | + | chr4: 105185194-105185214 | ACGAAAACUUGUCUGUCUCU | 2530 |
| 54790_1_8507 | + | chr4: 105185264-105185284 | CUGAAUCUCCUACAAGCUUG | 2531 |
| 54790_1_8508 | + | chr4: 105185267-105185287 | AAUCUCCUACAAGCUUGUGG | 2532 |
| 54790_1_8513 | + | chr4: 105185296-105185316 | AGCAUGUUGAAUAAGAGCAC | 2533 |
| 54790_1_8515 | + | chr4: 105185302-105185322 | UUGAAUAAGAGCACAGGCUC | 2534 |
| 54790_1_8518 | + | chr4: 105185305-105185325 | AAUAAGAGCACAGGCUCUGG | 2535 |
| 54790_1_8520 | + | chr4: 105185323-105185343 | GGAGGCCCUGCCACCCACAA | 2536 |
| 54790_1_8521 | + | chr4: 105185324-105185344 | GAGGCCCUGCCACCCACAAA | 2537 |
| 54790_1_8522 | + | chr4: 105185334-105185354 | CACCCACAAAGGGUGUGCUA | 2538 |
| 54790_1_8541 | + | chr4: 105185429-105185449 | CUUUUUUUUCUAAAUCUAUU | 2539 |
| 54790_1_8554 | + | chr4: 105185482-105185502 | UUCUAAAACACAGUGAGACC | 2540 |
| 54790_1_8557 | + | chr4: 105185490-105185510 | CACAGUGAGACCAGGCGCAG | 2541 |
| 54790_1_8559 | + | chr4: 105185518-105185538 | GCCUGUAAUCCCAGCACUUU | 2542 |
| 54790_1_8561 | + | chr4: 105185521-105185541 | UGUAAUCCCAGCACUUUCGG | 2543 |
| 54790_1_8563 | + | chr4: 105185527-105185547 | CCCAGCACUUUCGGAGGCCG | 2544 |
| 54790_1_8565 | + | chr4: 105185534-105185554 | CUUUCGGAGGCCGAGGUAUG | 2545 |
| 54790_1_8569 | + | chr4: 105185543-105185563 | GCCGAGGUAUGCGGAUCACG | 2546 |
| 54790_1_8572 | + | chr4: 105185548-105185568 | GGUAUGCGGAUCACGAGGUC | 2547 |
| 54790_1_8574 | + | chr4: 105185566-105185586 | UCAGGAGAUCGAGACCAUCC | 2548 |
| 54790_1_8575 | + | chr4: 105185575-105185595 | CGAGACCAUCCUGGCUAACA | 2549 |
| 54790_1_8577 | + | chr4: 105185615-105185635 | UAAAAUACAAAAAUUAGCC | 2550 |
| 54790_1_8580 | + | chr4: 105185620-105185640 | AUACAAAAUUAGCCAGGCG | 2551 |
| 54790_1_8581 | + | chr4: 105185621-105185641 | UACAAAAUUAGCCAGGCGU | 2552 |
| 54790_1_8583 | + | chr4: 105185622-105185642 | ACAAAAUUAGCCAGGCGUG | 2553 |
| 54790_1_8584 | + | chr4: 105185623-105185643 | CAAAAUUAGCCAGGCGUGG | 2554 |
| 54790_1_8587 | + | chr4: 105185651-105185671 | GCCUGUAAUCCCAGCUACUC | 2555 |
| 54790_1_8589 | + | chr4: 105185654-105185674 | UGUAAUCCCAGCUACUCAGG | 2556 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_8591 | + | chr4: 105185660-105185680 | CCCAGCUACUCAGGAGGCUG | 2557 |
| 54790_1_8593 | + | chr4: 105185664-105185684 | GCUACUCAGGAGGCUGAGGC | 2558 |
| 54790_1_8597 | + | chr4: 105185671-105185691 | AGGAGGCUGAGGCAGGAGAA | 2559 |
| 54790_1_8601 | + | chr4: 105185681-105185701 | GGCAGGAGAAUGGCGUGAAC | 2560 |
| 54790_1_8602 | + | chr4: 105185682-105185702 | GCAGGAGAAUGGCGUGAACC | 2561 |
| 54790_1_8605 | + | chr4: 105185683-105185703 | CAGGAGAAUGGCGUGAACCG | 2562 |
| 54790_1_8606 | + | chr4: 105185686-105185706 | GAGAAUGGCGUGAACCGGGG | 2563 |
| 54790_1_8609 | + | chr4: 105185689-105185709 | AAUGGCGUGAACCGGGGAGG | 2564 |
| 54790_1_8613 | + | chr4: 105185732-105185752 | CGCACCACUGCACUCCAGCC | 2565 |
| 54790_1_8614 | + | chr4: 105185733-105185753 | GCACCACUGCACUCCAGCCU | 2566 |
| 54790_1_8620 | + | chr4: 105185814-105185834 | UUAUAAAGAUAAAAUAGAAU | 2567 |
| 54790_1_8625 | + | chr4: 105185826-105185846 | AAUAGAAUAGGCUUCAAUUU | 2568 |
| 54790_1_8626 | + | chr4: 105185827-105185847 | AUAGAAUAGGCUUCAAUUUA | 2569 |
| 54790_1_8629 | + | chr4: 105185835-105185855 | GGCUUCAAUUUAGGGAACAA | 2570 |
| 54790_1_8635 | + | chr4: 105185849-105185869 | GAACAAAGGAAAAUAUGUUU | 2571 |
| 54790_1_8640 | + | chr4: 105185886-105185906 | CAAAAUGAUUGCAACUUUGA | 2572 |
| 54790_1_8648 | + | chr4: 105185923-105185943 | UUCAAUUAAAAAUGUAGAUA | 2573 |
| 54790_1_8651 | + | chr4: 105185927-105185947 | AUUAAAAAUGUAGAUAUGGC | 2574 |
| 54790_1_8652 | + | chr4: 105185928-105185948 | UUAAAAAUGUAGAUAUGGCU | 2575 |
| 54790_1_8654 | + | chr4: 105185933-105185953 | AAUGUAGAUAUGGCUGGGCG | 2576 |
| 54790_1_8655 | + | chr4: 105185936-105185956 | GUAGAUAUGGCUGGGCGUGG | 2577 |
| 54790_1_8658 | + | chr4: 105185963-105185983 | CACCUGUAAUCCCAGCACUU | 2578 |
| 54790_1_8659 | + | chr4: 105185967-105185987 | UGUAAUCCCAGCACUUUGGA | 2579 |
| 54790_1_8660 | + | chr4: 105185977-105185997 | GCACUUUGGAAGGUUGACGC | 2580 |
| 54790_1_8662 | + | chr4: 105185980-105186000 | CUUUGGAAGGUUGACGCAGG | 2581 |
| 54790_1_8666 | + | chr4: 105185991-105186011 | UGACGCAGGUGGAUCACUUG | 2582 |
| 54790_1_8669 | + | chr4: 105185996-105186016 | CAGGUGGAUCACUUGAGGUU | 2583 |
| 54790_1_8674 | + | chr4: 105186014-105186034 | UUAGGAGUUUGAGACCUGCC | 2584 |
| 54790_1_8675 | + | chr4: 105186015-105186035 | UAGGAGUUUGAGACCUGCCU | 2585 |
| 54790_1_8681 | + | chr4: 105186065-105186085 | AAAUAAACAAAAAAUGUGC | 2586 |
| 54790_1_8682 | + | chr4: 105186066-105186086 | AAAUAAACAAAAAAUGUGCU | 2587 |
| 54790_1_8683 | + | chr4: 105186071-105186091 | AACAAAAAUGUGCUGGGUG | 2588 |
| 54790_1_8684 | + | chr4: 105186074-105186094 | AAAAAUGUGCUGGGUGUGG | 2589 |
| 54790_1_8687 | + | chr4: 105186101-105186121 | UGCCUGUAGUCCUAGCCACU | 2590 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_8689 | + | chr4: 105186102-105186122 | GCCUGUAGUCCUAGCCACUU | 2591 |
| 54790_1_8693 | + | chr4: 105186114-105186134 | AGCCACUUGGGAGACUGAGA | 2592 |
| 54790_1_8695 | + | chr4: 105186118-105186138 | ACUUGGGAGACUGAGAUGGA | 2593 |
| 54790_1_8700 | + | chr4: 105186133-105186153 | AUGGAAGGAUAGCUUGAGUC | 2594 |
| 54790_1_8702 | + | chr4: 105186134-105186154 | UGGAAGGAUAGCUUGAGUCU | 2595 |
| 54790_1_8703 | + | chr4: 105186137-105186157 | AAGGAUAGCUUGAGUCUGGG | 2596 |
| 54790_1_8709 | + | chr4: 105186183-105186203 | CGUGCCACUGCACUUGAGCC | 2597 |
| 54790_1_8710 | + | chr4: 105186184-105186204 | GUGCCACUGCACUUGAGCCU | 2598 |
| 54790_1_8717 | + | chr4: 105186252-105186272 | AACAACAGUAGAUAUGUGUG | 2599 |
| 54790_1_8719 | + | chr4: 105186253-105186273 | ACAACAGUAGAUAUGUGUGU | 2600 |
| 54790_1_8722 | + | chr4: 105186281-105186301 | GAACAUUUAAAUGUGCUCAU | 2601 |
| 54790_1_8726 | + | chr4: 105186310-105186330 | UUUUUCUUUAACCCCCUUCA | 2602 |
| 54790_1_8747 | + | chr4: 105186405-105186425 | UUAUAACUCUCAAUGUAUCA | 2603 |
| 54790_1_8754 | + | chr4: 105186412-105186432 | UCUCAAUGUAUCAUGGCAGA | 2604 |
| 54790_1_8766 | + | chr4: 105186477-105186497 | UUUUUUUUUUUUUUUGAGA | 2605 |
| 54790_1_8785 | + | chr4: 105186498-105186518 | GGAGUCUCACUCUGUCACCC | 2606 |
| 54790_1_8787 | + | chr4: 105186502-105186522 | UCUCACUCUGUCACCCAGGC | 2607 |
| 54790_1_8789 | + | chr4: 105186512-105186532 | UCACCCAGGCUGGAGUGCAG | 2608 |
| 54790_1_8792 | + | chr4: 105186547-105186567 | UUAUUGCAACCUCCGCCUCC | 2609 |
| 54790_1_8794 | + | chr4: 105186550-105186570 | UUGCAACCUCCGCCUCCUGG | 2610 |
| 54790_1_8798 | + | chr4: 105186583-105186603 | GCCUCAGCCUCCCCAGUAGC | 2611 |
| 54790_1_8800 | + | chr4: 105186584-105186604 | CCUCAGCCUCCCCAGUAGCU | 2612 |
| 54790_1_8801 | + | chr4: 105186592-105186612 | UCCCCAGUAGCUGGGACUAC | 2613 |
| 54790_1_8803 | + | chr4: 105186611-105186631 | CAGGCUUGCACCACCAUGCC | 2614 |
| 54790_1_8807 | + | chr4: 105186639-105186659 | UUUUAUAUUUUUAGUAGAGA | 2615 |
| 54790_1_8809 | + | chr4: 105186640-105186660 | UUUAUAUUUUUAGUAGAGAC | 2616 |
| 54790_1_8810 | + | chr4: 105186641-105186661 | UUAUAUUUUUAGUAGAGACG | 2617 |
| 54790_1_8819 | + | chr4: 105186660-105186680 | GGGGUUUCAUCAUGUUGUCU | 2618 |
| 54790_1_8820 | + | chr4: 105186664-105186684 | UUUCAUCAUGUUGUCUAGGC | 2619 |
| 54790_1_8824 | + | chr4: 105186702-105186722 | CUCAAGUGAUCCACCCACCU | 2620 |
| 54790_1_8826 | + | chr4: 105186718-105186738 | ACCUUGGCCUCCCAAAGUGC | 2621 |
| 54790_1_8828 | + | chr4: 105186719-105186739 | CCUUGGCCUCCCAAAGUGCU | 2622 |
| 54790_1_8830 | + | chr4: 105186727-105186747 | UCCCAAAGUGCUGGGAUUGC | 2623 |
| 54790_1_8832 | + | chr4: 105186742-105186762 | AUUGCAGGCAUGAGCCACCG | 2624 |
| 54790_1_8834 | + | chr4: 105186747-105186767 | AGGCAUGAGCCACCGCGGCC | 2625 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_8845 | + | chr4: 105186844-105186864 | UUAUCAGAAUAUUAUCAUAU | 2626 |
| 54790_1_8855 | + | chr4: 105186880-105186900 | CUGAACAAAGCCAGAAUUAU | 2627 |
| 54790_1_8858 | + | chr4: 105186889-105186909 | GCCAGAAUUAUUGGCUACUG | 2628 |
| 54790_1_8866 | + | chr4: 105186925-105186945 | CAAGAGACUAUUCUAUUUGU | 2629 |
| 54790_1_8867 | + | chr4: 105186926-105186946 | AAGAGACUAUUCUAUUUGUU | 2630 |
| 54790_1_8869 | + | chr4: 105186927-105186947 | AGAGACUAUUCUAUUUGUUG | 2631 |
| 54790_1_8876 | + | chr4: 105186948-105186968 | GGAUCACCUCUUUUUACUAA | 2632 |
| 54790_1_8878 | + | chr4: 105186949-105186969 | GAUCACCUCUUUUUACUAAA | 2633 |
| 54790_1_8879 | + | chr4: 105186950-105186970 | AUCACCUCUUUUUACUAAAG | 2634 |
| 54790_1_8881 | + | chr4: 105186960-105186980 | UUUACUAAAGGGGACUGUUU | 2635 |
| 54790_1_8883 | + | chr4: 105186961-105186981 | UUACUAAAGGGGACUGUUUU | 2636 |
| 54790_1_8892 | + | chr4: 105186983-105187003 | GCAUAUAAAACUAGAAUUCA | 2637 |
| 54790_1_8901 | + | chr4: 105187036-105187056 | CCAGUCAACCAGAUAACUGC | 2638 |
| 54790_1_8903 | + | chr4: 105187059-105187079 | UAGUGACACUCAUGUCCUCC | 2639 |
| 54790_1_8907 | + | chr4: 105187088-105187108 | AAUCUUGUGCCAGCUCAGAG | 2640 |
| 54790_1_8910 | + | chr4: 105187089-105187109 | AUCUUGUGCCAGCUCAGAGA | 2641 |
| 54790_1_8915 | + | chr4: 105187142-105187162 | AAGAACCACAAGCACCACCU | 2642 |
| 54790_1_8940 | + | chr4: 105187262-105187282 | UAUUUUAAACAGAAAACAGA | 2643 |
| 54790_1_8944 | + | chr4: 105187293-105187313 | CCUCUGCCUUCCUCAGUAUU | 2644 |
| 54790_1_8953 | + | chr4: 105187339-105187359 | UUAAGAGUCUAAUCAUAUAC | 2645 |
| 54790_1_8974 | + | chr4: 105187463-105187483 | CUGCCUGAUGAAUAUUUAUU | 2646 |
| 54790_1_9045 | + | chr4: 105187802-105187822 | UUCUACCACUUCACACUCAC | 2647 |
| 54790_1_9047 | + | chr4: 105187803-105187823 | UCUACCACUUCACACUCACU | 2648 |
| 54790_1_9050 | + | chr4: 105187807-105187827 | CCACUUCACACUCACUGGGA | 2649 |
| 54790_1_9052 | + | chr4: 105187836-105187856 | UUUUUAAAACAUACAAUAAC | 2650 |
| 54790_1_9058 | + | chr4: 105187847-105187867 | UACAAUAACAGGUGUUAGUG | 2651 |
| 54790_1_9061 | + | chr4: 105187853-105187873 | AACAGGUGUUAGUGCGGAUA | 2652 |
| 54790_1_9063 | + | chr4: 105187862-105187882 | UAGUGCGGAUAUGGAAAAAU | 2653 |
| 54790_1_9069 | + | chr4: 105187884-105187904 | GAACCCUGACACAUUGCUAG | 2654 |
| 54790_1_9070 | + | chr4: 105187896-105187916 | AUUGCUAGUGGAAUGUAAAA | 2655 |
| 54790_1_9072 | + | chr4: 105187922-105187942 | AGCCACUUUGCAAAACAGUU | 2656 |
| 54790_1_9079 | + | chr4: 105187947-105187967 | GUUCAUCAAAAGAUUAAGCA | 2657 |
| 54790_1_9084 | + | chr4: 105187981-105188001 | GACCCAGUAGUUUCGCUCUU | 2658 |
| 54790_1_9085 | + | chr4: 105187982-105188002 | ACCCAGUAGUUUCGCUCUUA | 2659 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_9100 | + | chr4: 105188081-105188101 | CAUUAUUCACAAUAGCCUAA | 2660 |
| 54790_1_9105 | + | chr4: 105188109-105188129 | GCAACCCAAAUGCCUACAGA | 2661 |
| 54790_1_9108 | + | chr4: 105188117-105188137 | AAUGCCUACAGAUGGAUGAA | 2662 |
| 54790_1_9111 | + | chr4: 105188132-105188152 | AUGAAUGGAUAAACAGAAUG | 2663 |
| 54790_1_9113 | + | chr4: 105188148-105188168 | AAUGUGGUAUAGACAUACAA | 2664 |
| 54790_1_9116 | + | chr4: 105188171-105188191 | ACUAUUAUUCAACCUUAAAG | 2665 |
| 54790_1_9127 | + | chr4: 105188205-105188225 | GACACAUGCUAGAAAAUAAA | 2666 |
| 54790_1_9129 | + | chr4: 105188230-105188250 | CUUGUAUACAUUCUACUAAG | 2667 |
| 54790_1_9136 | + | chr4: 105188279-105188299 | AUUAUGAUUCCACUUACAUG | 2668 |
| 54790_1_9143 | + | chr4: 105188306-105188326 | UAGAAUAGUCAAAUUAAUAG | 2669 |
| 54790_1_9149 | + | chr4: 105188332-105188352 | ACAGUAGAAUAAUGAUUGCC | 2670 |
| 54790_1_9151 | + | chr4: 105188333-105188353 | CAGUAGAAUAAUGAUUGCCA | 2671 |
| 54790_1_9152 | + | chr4: 105188334-105188354 | AGUAGAAUAAUGAUUGCCAG | 2672 |
| 54790_1_9155 | + | chr4: 105188338-105188358 | GAAUAAUGAUUGCCAGGGGC | 2673 |
| 54790_1_9156 | + | chr4: 105188339-105188359 | AAUAAUGAUUGCCAGGGGCU | 2674 |
| 54790_1_9159 | + | chr4: 105188342-105188362 | AAUGAUUGCCAGGGGCUGGG | 2675 |
| 54790_1_9162 | + | chr4: 105188345-105188365 | GAUUGCCAGGGGCUGGGAGG | 2676 |
| 54790_1_9167 | + | chr4: 105188354-105188374 | GGGCUGGGAGGAGGAGCAAA | 2677 |
| 54790_1_9168 | + | chr4: 105188355-105188375 | GGCUGGGAGGAGGAGCAAAU | 2678 |
| 54790_1_9178 | + | chr4: 105188392-105188412 | UGAGUAUAGAAUUUCUGUUU | 2679 |
| 54790_1_9184 | + | chr4: 105188410-105188430 | UUAGGAAGAUGAAAAAGUUC | 2680 |
| 54790_1_9189 | + | chr4: 105188416-105188436 | AGAUGAAAAGUUCUGGAGA | 2681 |
| 54790_1_9190 | + | chr4: 105188417-105188437 | GAUGAAAAGUUCUGGAGAU | 2682 |
| 54790_1_9191 | + | chr4: 105188420-105188440 | GAAAAGUUCUGGAGAUGGG | 2683 |
| 54790_1_9192 | + | chr4: 105188429-105188449 | CUGGAGAUGGGUGGCAGUGA | 2684 |
| 54790_1_9199 | + | chr4: 105188483-105188503 | CAGAAUAGUAUACUUAAAUA | 2685 |
| 54790_1_9201 | + | chr4: 105188492-105188512 | AUACUUAAAUAUGGUUUGAA | 2686 |
| 54790_1_9218 | + | chr4: 105188566-105188586 | CCAAAGAAGCAUUAUUUAUG | 2687 |
| 54790_1_9221 | + | chr4: 105188576-105188596 | AUUAUUUAUGAGGCUAAAAG | 2688 |
| 54790_1_9226 | + | chr4: 105188611-105188631 | AGUUCAUCAUUGAUAGCUAA | 2689 |
| 54790_1_9229 | + | chr4: 105188619-105188639 | AUUGAUAGCUAAAGGAAACA | 2690 |
| 54790_1_9234 | + | chr4: 105188654-105188674 | GUAGAAUAUUAGUCAUACAA | 2691 |
| 54790_1_9242 | + | chr4: 105188733-105188753 | UGAAAGAAACCAGACGUAAA | 2692 |
| 54790_1_9243 | + | chr4: 105188748-105188768 | GUAAAGGCCAAAUUUUGUA | 2693 |
| 54790_1_9251 | + | chr4: 105188778-105188798 | UAUAUAAAGUCGUUCAAAAU | 2694 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_1_9255 | + | chr4: 105188810-105188830 | AAAGACUGAAAGUUGAUUAG | 2695 |
| 54790_1_9256 | + | chr4: 105188819-105188839 | AAGUUGAUUAGUGGUCACCA | 2696 |
| 54790_1_9259 | + | chr4: 105188824-105188844 | GAUUAGUGGUCACCAAGGCC | 2697 |
| 54790_1_9261 | + | chr4: 105188825-105188845 | AUUAGUGGUCACCAAGGCCC | 2698 |
| 54790_1_9264 | + | chr4: 105188826-105188846 | UUAGUGGUCACCAAGGCCCG | 2699 |
| 54790_1_9266 | + | chr4: 105188827-105188847 | UAGUGGUCACCAAGGCCCGG | 2700 |
| 54790_1_9269 | + | chr4: 105188830-105188850 | UGGUCACCAAGGCCCGGGGG | 2701 |
| 54790_1_9273 | + | chr4: 105188846-105188866 | GGGGAGGAAUGAAUGAAAAC | 2702 |
| 54790_1_9275 | + | chr4: 105188856-105188876 | GAAUGAAAACUGGCUCCUAA | 2703 |
| 54790_1_9276 | + | chr4: 105188857-105188877 | AAUGAAAACUGGCUCCUAAU | 2704 |
| 54790_1_9278 | + | chr4: 105188863-105188883 | AACUGGCUCCUAAUGGGUAC | 2705 |
| 54790_1_9279 | + | chr4: 105188864-105188884 | ACUGGCUCCUAAUGGGUACU | 2706 |
| 54790_1_9282 | + | chr4: 105188872-105188892 | CUAAUGGGUACUGGGUUUUU | 2707 |
| 54790_1_9283 | + | chr4: 105188873-105188893 | UAAUGGGUACUGGGUUUUUU | 2708 |
| 54790_1_9284 | + | chr4: 105188874-105188894 | AAUGGGUACUGGGUUUUUUG | 2709 |
| 54790_1_9288 | + | chr4: 105188879-105188899 | GUACUGGGUUUUUUGGGGCG | 2710 |
| 54790_1_9289 | + | chr4: 105188880-105188900 | UACUGGGUUUUUUGGGGCGA | 2711 |
| 54790_1_9291 | + | chr4: 105188881-105188901 | ACUGGGUUUUUUGGGGCGAG | 2712 |
| 54790_1_9293 | + | chr4: 105188882-105188902 | CUGGGUUUUUUGGGGCGAGG | 2713 |
| 54790_1_9304 | + | chr4: 105188925-105188945 | UAGAAUUUGAUAGUAAUGAU | 2714 |
| 54790_1_9308 | + | chr4: 105188934-105188954 | AUAGUAAUGAUAGGUGAGAG | 2715 |
| 54790_1_9318 | + | chr4: 105188985-105189005 | ACUGACUCAUAUACUUUACA | 2716 |
| 54790_1_9319 | + | chr4: 105188998-105189018 | CUUUACAAGGAUGUAUUUUA | 2717 |
| 54790_1_9327 | + | chr4: 105189043-105189063 | ACCCCUUAAAUUUUAACGUA | 2718 |
| 54790_1_9338 | + | chr4: 105189105-105189125 | AGUCUCAGCUUACUAUUUCU | 2719 |
| 54790_1_9351 | + | chr4: 105189158-105189178 | UCCCUUCUUACUCUGUAAAA | 2720 |
| 54790_1_9352 | + | chr4: 105189159-105189179 | CCCUUCUUACUCUGUAAAAU | 2721 |
| 54790_1_9359 | + | chr4: 105189226-105189246 | AUUUUUUUGAGUGUUAAAUG | 2722 |
| 54790_1_9367 | + | chr4: 105189259-105189279 | AGUGCAUCUAGCAUAGUGUC | 2723 |
| 54790_1_9370 | + | chr4: 105189278-105189298 | CUGGCAUUUACCAAGAACCC | 2724 |
| 54790_1_9373 | + | chr4: 105189279-105189299 | UGGCAUUUACCAAGAACCCC | 2725 |
| 54790_1_9380 | + | chr4: 105189327-105189347 | ACUAUUCCAGAUACUAUUUC | 2726 |
| 54790_1_9386 | + | chr4: 105189357-105189377 | AAUACUGUUUCCAUAUAUUC | 2727 |
| 54790_1_9388 | + | chr4: 105189364-105189384 | UUUCCAUAUAUUCAGGACAA | 2728 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_9397 | + | chr4: 105189417-105189437 | CUUUAGAUUCUGUUUCAAAU | 2729 |
| 54790_1_9422 | + | chr4: 105189557-105189577 | UCCUCUUUUCUCUCUGCCCU | 2730 |
| 54790_1_9429 | + | chr4: 105189567-105189587 | UCUCUGCCCUUGGAACUCUG | 2731 |
| 54790_1_9447 | + | chr4: 105189676-105189696 | UUGACCAAUUAAGUCUUACU | 2732 |
| 54790_1_9448 | + | chr4: 105189677-105189697 | UGACCAAUUAAGUCUUACUU | 2733 |
| 54790_1_9453 | + | chr4: 105189695-105189715 | UUGGGUUAUGUUUUUAAAGU | 2734 |
| 54790_1_9456 | + | chr4: 105189707-105189727 | UUUAAAGUAGGUAUCUUAUU | 2735 |
| 54790_1_9459 | + | chr4: 105189710-105189730 | AAAGUAGGUAUCUUAUUAGG | 2736 |
| 54790_1_9478 | + | chr4: 105189825-105189845 | CUUAGCAUGUUACCUUGACA | 2737 |
| 54790_1_9494 | + | chr4: 105189889-105189909 | UGCCACAUCUCAUGAAGUAC | 2738 |
| 54790_1_9495 | + | chr4: 105189890-105189910 | GCCACAUCUCAUGAAGUACA | 2739 |
| 54790_1_9499 | + | chr4: 105189933-105189953 | GACUUCAUCUUACAGUCACC | 2740 |
| 54790_1_9511 | + | chr4: 105190001-105190021 | AAAUCCUCAACUUCUUACCU | 2741 |
| 54790_1_9517 | + | chr4: 105190035-105190055 | UAAGCCACACUGUGAACCAC | 2742 |
| 54790_1_9520 | + | chr4: 105190066-105190086 | GAUGAAGUAAUAUAAGCCAC | 2743 |
| 54790_1_9521 | + | chr4: 105190092-105190112 | UUAAGCCUCAUUGAUUAUUG | 2744 |
| 54790_1_9529 | + | chr4: 105190121-105190141 | UGUGAAGACUAAAGAUGCUU | 2745 |
| 54790_1_9530 | + | chr4: 105190122-105190142 | GUGAAGACUAAAGAUGCUUU | 2746 |
| 54790_1_9531 | + | chr4: 105190127-105190147 | GACUAAAGAUGCUUUGGGCA | 2747 |
| 54790_1_9537 | + | chr4: 105190163-105190183 | AGAUAUUAGAAUUGUUAUUA | 2748 |
| 54790_1_9554 | + | chr4: 105190229-105190249 | UUUUAACAGCCACACUGUAA | 2749 |
| 54790_1_9561 | + | chr4: 105190246-105190266 | UAAUGGAAAUAUCCAAUUAU | 2750 |
| 54790_1_9563 | + | chr4: 105190278-105190298 | CCUUUUAAACUCUUUAUAUC | 2751 |
| 54790_1_9576 | – | chr4: 105147002-105147022 | AGAAGAAAGGGAGAGUUUCG | 2752 |
| 54790_1_9578 | – | chr4: 105147014-105147034 | AAAGCGAAGGGGAGAAGAAA | 2753 |
| 54790_1_9581 | – | chr4: 105147015-105147035 | AAAAGCGAAGGGGAGAAGAA | 2754 |
| 54790_1_9586 | – | chr4: 105147025-105147045 | AAGCCCGAGAAAAAGCGAAG | 2755 |
| 54790_1_9588 | – | chr4: 105147026-105147046 | GAAGCCCGAGAAAAGCGAA | 2756 |
| 54790_1_9591 | – | chr4: 105147027-105147047 | GGAAGCCCGAGAAAAGCGA | 2757 |
| 54790_1_9599 | – | chr4: 105147048-105147068 | AGGGUUUGCUCCCCAGUCCC | 2758 |
| 54790_1_9604 | – | chr4: 105147067-105147087 | UAUUUGUGGGUGACACUACA | 2759 |
| 54790_1_9605 | – | chr4: 105147068-105147088 | GUAUUUGUGGGUGACACUAC | 2760 |
| 54790_1_9609 | – | chr4: 105147080-105147100 | UCUUCCCUCUUGGUAUUUGU | 2761 |
| 54790_1_9610 | – | chr4: 105147081-105147101 | CUCUUCCCUCUUGGUAUUUG | 2762 |
| 54790_1_9614 | – | chr4: 105147090-105147110 | GAAGCUUCCCUCUUCCCUCU | 2763 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_9619 | - | chr4: 105147127-105147147 | AUUUGUCAGCCAUGUUGAAG | 2764 |
| 54790_1_9625 | - | chr4: 105147162-105147182 | ACAGGUUUAAAAGGGGUAGA | 2765 |
| 54790_1_9627 | - | chr4: 105147163-105147183 | UACAGGUUUAAAAGGGGUAG | 2766 |
| 54790_1_9631 | - | chr4: 105147169-105147189 | CAGAACUACAGGUUUAAAAG | 2767 |
| 54790_1_9632 | - | chr4: 105147170-105147190 | ACAGAACUACAGGUUUAAAA | 2768 |
| 54790_1_9634 | - | chr4: 105147171-105147191 | CACAGAACUACAGGUUUAAA | 2769 |
| 54790_1_9636 | - | chr4: 105147180-105147200 | AGAAGAGAACACAGAACUAC | 2770 |
| 54790_1_9647 | - | chr4: 105147205-105147225 | AUGAGGGGACGAGCAUUAGG | 2771 |
| 54790_1_9649 | - | chr4: 105147208-105147228 | GAGAUGAGGGGACGAGCAUU | 2772 |
| 54790_1_9656 | - | chr4: 105147220-105147240 | UAAGUUUUCUGGGAGAUGAG | 2773 |
| 54790_1_9658 | - | chr4: 105147221-105147241 | GUAAGUUUUCUGGGAGAUGA | 2774 |
| 54790_1_9660 | - | chr4: 105147222-105147242 | GGUAAGUUUUCUGGGAGAUG | 2775 |
| 54790_1_9663 | - | chr4: 105147230-105147250 | GGCACAAAGGUAAGUUUUCU | 2776 |
| 54790_1_9666 | - | chr4: 105147231-105147251 | AGGCACAAAGGUAAGUUUUC | 2777 |
| 54790_1_9668 | - | chr4: 105147243-105147263 | CCGGCUCGUCGGAGGCACAA | 2778 |
| 54790_1_9669 | - | chr4: 105147251-105147271 | CCGGGAAACCGGCUCGUCGG | 2779 |
| 54790_1_9671 | - | chr4: 105147254-105147274 | AGGCCGGGAAACCGGCUCGU | 2780 |
| 54790_1_9674 | - | chr4: 105147262-105147282 | AUUAAAAAAGGCCGGGAAAC | 2781 |
| 54790_1_9678 | - | chr4: 105147269-105147289 | UCUGAGGAUUAAAAAAGGCC | 2782 |
| 54790_1_9681 | - | chr4: 105147270-105147290 | UUCUGAGGAUUAAAAAAGGC | 2783 |
| 54790_1_9683 | - | chr4: 105147274-105147294 | ACUUUCUGAGGAUUAAAAA | 2784 |
| 54790_1_9686 | - | chr4: 105147285-105147305 | AUUUAAAAAUCACUUUUCUG | 2785 |
| 54790_1_9692 | - | chr4: 105147315-105147335 | AAAGCUGAACUAUUUUAGAA | 2786 |
| 54790_1_9699 | - | chr4: 105147353-105147373 | AACAGGGGAAGAGGAUUAAA | 2787 |
| 54790_1_9701 | - | chr4: 105147354-105147374 | AAACAGGGGAAGAGGAUUAA | 2788 |
| 54790_1_9704 | - | chr4: 105147362-105147382 | CACGAAAGAAACAGGGGAAG | 2789 |
| 54790_1_9710 | - | chr4: 105147368-105147388 | CACUUACACGAAAGAAACAG | 2790 |
| 54790_1_9712 | - | chr4: 105147369-105147389 | UCACUUACACGAAAGAAACA | 2791 |
| 54790_1_9713 | - | chr4: 105147370-105147390 | UUCACUUACACGAAAGAAAC | 2792 |
| 54790_1_9721 | - | chr4: 105147401-105147421 | UGAGGUUGUUCAGGAUAAAC | 2793 |
| 54790_1_9723 | - | chr4: 105147402-105147422 | CUGAGGUUGUUCAGGAUAAA | 2794 |
| 54790_1_9726 | - | chr4: 105147410-105147430 | UGUUCUCUCUGAGGUUGUUC | 2795 |
| 54790_1_9728 | - | chr4: 105147419-105147439 | CCCUAUCAGUGUUCUCUCUG | 2796 |
| 54790_1_9731 | - | chr4: 105147452-105147472 | AGACCCUACAGCUGAUAAAA | 2797 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_9732 | − | chr4: 105147453-105147473 | CAGACCCUACAGCUGAUAAA | 2798 |
| 54790_1_9734 | − | chr4: 105147494-105147514 | GGGGAUAAGAAGGUAGGAGG | 2799 |
| 54790_1_9736 | − | chr4: 105147497-105147517 | AAGGGGGAUAAGAAGGUAGG | 2800 |
| 54790_1_9738 | − | chr4: 105147500-105147520 | CUAAAGGGGAUAAGAAGGU | 2801 |
| 54790_1_9741 | − | chr4: 105147504-105147524 | CCCCCUAAAGGGGAUAAGA | 2802 |
| 54790_1_9746 | − | chr4: 105147513-105147533 | UUCGUACAGCCCCCUAAAGG | 2803 |
| 54790_1_9748 | − | chr4: 105147514-105147534 | CUUCGUACAGCCCCCUAAAG | 2804 |
| 54790_1_9749 | − | chr4: 105147515-105147535 | ACUUCGUACAGCCCCCUAAA | 2805 |
| 54790_1_9752 | − | chr4: 105147516-105147536 | CACUUCGUACAGCCCCCUAA | 2806 |
| 54790_1_9757 | − | chr4: 105147587-105147607 | UAACAAAACGCGCGGACUUA | 2807 |
| 54790_1_9759 | − | chr4: 105147595-105147615 | AGCGCCGCUAACAAAACGCG | 2808 |
| 54790_1_9773 | − | chr4: 105147650-105147670 | GUGAGUUCUGGUCUUGUUUG | 2809 |
| 54790_1_9775 | − | chr4: 105147651-105147671 | AGUGAGUUCUGGUCUUGUUU | 2810 |
| 54790_1_9777 | − | chr4: 105147652-105147672 | AAGUGAGUUCUGGUCUUGUU | 2811 |
| 54790_1_9781 | − | chr4: 105147662-105147682 | ACCUUGAGAAAAGUGAGUUC | 2812 |
| 54790_1_9787 | − | chr4: 105147708-105147728 | CAUACAUUCCCCAGGCUGGA | 2813 |
| 54790_1_9789 | − | chr4: 105147712-105147732 | CUUACAUACAUUCCCCAGGC | 2814 |
| 54790_1_9792 | − | chr4: 105147716-105147736 | UUCUCUUACAUACAUUCCCC | 2815 |
| 54790_1_9796 | − | chr4: 105147758-105147778 | UUCGGGAGAAGCACAAAGCC | 2816 |
| 54790_1_9798 | − | chr4: 105147759-105147779 | AUUCGGGAGAAGCACAAAGC | 2817 |
| 54790_1_9802 | − | chr4: 105147775-105147795 | GAACCAAACGAAGCUGAUUC | 2818 |
| 54790_1_9805 | − | chr4: 105147776-105147796 | GGAACCAAACGAAGCUGAUU | 2819 |
| 54790_1_9811 | − | chr4: 105147797-105147817 | UGUCUGCCUGUCACUUACCA | 2820 |
| 54790_1_9814 | − | chr4: 105147836-105147856 | CCCCCUCCCGCCCCCUCCCC | 2821 |
| 54790_1_9815 | − | chr4: 105147837-105147857 | ACCCCCUCCCGCCCCCUCCC | 2822 |
| 54790_1_9827 | − | chr4: 105147904-105147924 | GGAUGGGUUUCAUUUCUUU | 2823 |
| 54790_1_9831 | − | chr4: 105147919-105147939 | UUCACUUCUUUGCUGGGAUU | 2824 |
| 54790_1_9832 | − | chr4: 105147920-105147940 | CUUCACUUCUUUGCUGGGAU | 2825 |
| 54790_1_9834 | − | chr4: 105147925-105147945 | CUGCUCUUCACUUCUUUGCU | 2826 |
| 54790_1_9836 | − | chr4: 105147926-105147946 | UCUGCUCUUCACUUCUUUGC | 2827 |
| 54790_1_9841 | − | chr4: 105147960-105147980 | UCGGUUUCUCUAAUUUGGAU | 2828 |
| 54790_1_9842 | − | chr4: 105147961-105147981 | UUCGGUUUCUCUAAUUUGGA | 2829 |
| 54790_1_9845 | − | chr4: 105147965-105147985 | UCUCUUCGGUUUCUCUAAUU | 2830 |
| 54790_1_9856 | − | chr4: 105148009-105148029 | CUCUCCUCUGUGUCUCUCUU | 2831 |
| 54790_1_9860 | − | chr4: 105148026-105148046 | UCUCUCUUCUUUCUCAUCUC | 2832 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_9875 | − | chr4: 105148085-105148105 | GAUUCAGCAAGAUGCGAGUG | 2833 |
| 54790_1_9884 | − | chr4: 105148171-105148191 | GCCACACUUCAUUAUGUCAU | 2834 |
| 54790_1_9889 | − | chr4: 105148193-105148213 | GCCUUUCCAGGAGUCUAUCC | 2835 |
| 54790_1_9894 | − | chr4: 105148205-105148225 | AUUUCAUUUUCGGCCUUUCC | 2836 |
| 54790_1_9897 | − | chr4: 105148215-105148235 | UAACACUUAUAUUUCAUUUU | 2837 |
| 54790_1_9900 | − | chr4: 105148251-105148271 | AAUUAAAAGUAUAUCAUGAG | 2838 |
| 54790_1_9901 | − | chr4: 105148252-105148272 | UAAUUAAAAGUAUAUCAUGA | 2839 |
| 54790_1_9904 | − | chr4: 105148253-105148273 | GUAAUUAAAAGUAUAUCAUG | 2840 |
| 54790_1_9912 | − | chr4: 105148290-105148310 | CUUAAACAUUAGAUGAAGAA | 2841 |
| 54790_1_9914 | − | chr4: 105148291-105148311 | UCUUAAACAUUAGAUGAAGA | 2842 |
| 54790_1_9929 | − | chr4: 105148334-105148354 | UAUGCACUAAAUUUUACCGC | 2843 |
| 54790_1_9945 | − | chr4: 105148446-105148466 | AUUAUAAUCCCUGACUGAAG | 2844 |
| 54790_1_9946 | − | chr4: 105148447-105148467 | CAUUAUAAUCCCUGACUGAA | 2845 |
| 54790_1_9949 | − | chr4: 105148448-105148468 | CCAUUAUAAUCCCUGACUGA | 2846 |
| 54790_1_9959 | − | chr4: 105148475-105148495 | UGAUGAAUAUCUUUGAAUUU | 2847 |
| 54790_1_9960 | − | chr4: 105148476-105148496 | UUGAUGAAUAUCUUUGAAUU | 2848 |
| 54790_1_9967 | − | chr4: 105148507-105148527 | AUACAAUCUUAUUCCUAUGA | 2849 |
| 54790_1_9977 | − | chr4: 105148600-105148620 | AUGUAAUGAUUUCAUUAGCC | 2850 |
| 54790_1_10028 | − | chr4: 105148861-105148881 | AGUUUUGGAAAUUCGACUUA | 2851 |
| 54790_1_10032 | − | chr4: 105148876-105148896 | CUAUCGAGGACAAAUAGUUU | 2852 |
| 54790_1_10035 | − | chr4: 105148890-105148910 | AGUUACAAAGUGAACUAUCG | 2853 |
| 54790_1_10066 | − | chr4: 105149048-105149068 | UAAUUUUGUUUUAAUUUUA | 2854 |
| 54790_1_10067 | − | chr4: 105149049-105149069 | CUAAUUUUGUUUUAAUUUU | 2855 |
| 54790_1_10072 | − | chr4: 105149079-105149099 | UUUACCAUGAACAGCAUUAA | 2856 |
| 54790_1_10086 | − | chr4: 105149129-105149149 | UGUUUUUAAUUCUGAAUUGC | 2857 |
| 54790_1_10094 | − | chr4: 105149155-105149175 | AAUAUUAGUUUGUUAGCAAA | 2858 |
| 54790_1_10113 | − | chr4: 105149258-105149278 | AGUUAUUCUUAUUUAUUGAG | 2859 |
| 54790_1_10123 | − | chr4: 105149326-105149346 | AAGAAUCUAAAUUUGAUGAC | 2860 |
| 54790_1_10131 | − | chr4: 105149363-105149383 | GCUAUUUUCAGUAUAAAAGU | 2861 |
| 54790_1_10145 | − | chr4: 105149454-105149474 | UAAUUUCUCUUUUCCAACAA | 2862 |
| 54790_1_10153 | − | chr4: 105149516-105149536 | AUAUGGUAAAGAAAGAACUG | 2863 |
| 54790_1_10158 | − | chr4: 105149533-105149553 | AGGUAGUAUGAUCACAUAUA | 2864 |
| 54790_1_10163 | − | chr4: 105149553-105149573 | AUGGAAUUUUGGAGCACCU | 2865 |
| 54790_1_10165 | − | chr4: 105149563-105149583 | AGACAGUCCUAUGGAAUUUU | 2866 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_10169 | − | chr4: 105149572-105149592 | AAUAACCCAAGACAGUCCUA | 2867 |
| 54790_1_10189 | − | chr4: 105149719-105149739 | UGACAAUUUAAACAAAGCAA | 2868 |
| 54790_1_10191 | − | chr4: 105149720-105149740 | AUGACAAUUUAAACAAAGCA | 2869 |
| 54790_1_10197 | − | chr4: 105149748-105149768 | UUAAAGCCUUAAGAAGAGUU | 2870 |
| 54790_1_10203 | − | chr4: 105149785-105149805 | CUCCGGCUUCUGGCAUAAAC | 2871 |
| 54790_1_10204 | − | chr4: 105149795-105149815 | AUAUCAAUUCCUCCGGCUUC | 2872 |
| 54790_1_10205 | − | chr4: 105149802-105149822 | CAAAAUCAUAUCAAUUCCUC | 2873 |
| 54790_1_10208 | − | chr4: 105149842-105149862 | UUCACUUGCCAAUGUCUAGU | 2874 |
| 54790_1_10215 | − | chr4: 105149873-105149893 | CAGGUGCACUUCACUUGUUC | 2875 |
| 54790_1_10220 | − | chr4: 105149892-105149912 | UUUCAUAACAACUCCUUGGC | 2876 |
| 54790_1_10223 | − | chr4: 105149896-105149916 | AUUCUUUCAUAACAACUCCU | 2877 |
| 54790_1_10224 | − | chr4: 105149920-105149940 | CCAGUGCCCAAUAAGGACUU | 2878 |
| 54790_1_10227 | − | chr4: 105149927-105149947 | UACAAGACCAGUGCCCAAUA | 2879 |
| 54790_1_10241 | − | chr4: 105150006-105150026 | GAGUCUUAGAAGAAUUGAUA | 2880 |
| 54790_1_10242 | − | chr4: 105150007-105150027 | GGAGUCUUAGAAGAAUUGAU | 2881 |
| 54790_1_10255 | − | chr4: 105150028-105150048 | CUUACAACAUUGUUUGGGGG | 2882 |
| 54790_1_10257 | − | chr4: 105150031-105150051 | UGACUUACAACAUUGUUUGG | 2883 |
| 54790_1_10258 | − | chr4: 105150032-105150052 | UUGACUUACAACAUUGUUUG | 2884 |
| 54790_1_10260 | − | chr4: 105150033-105150053 | UUUGACUUACAACAUUGUUU | 2885 |
| 54790_1_10262 | − | chr4: 105150034-105150054 | AUUUGACUUACAACAUUGUU | 2886 |
| 54790_1_10270 | − | chr4: 105150077-105150097 | CUUAAUGAGGUCAGUAAUUA | 2887 |
| 54790_1_10272 | − | chr4: 105150090-105150110 | AUAAGAAGGGCUUCUUAAUG | 2888 |
| 54790_1_10274 | − | chr4: 105150103-105150123 | GUGCCUAUGAAUCAUAAGAA | 2889 |
| 54790_1_10275 | − | chr4: 105150104-105150124 | UGUGCCUAUGAAUCAUAAGA | 2890 |
| 54790_1_10282 | − | chr4: 105150127-105150147 | UGGAAAAUAGAGUUUCUGUG | 2891 |
| 54790_1_10288 | − | chr4: 105150147-105150167 | UACUCAGACUUUGGGCAGGA | 2892 |
| 54790_1_10292 | − | chr4: 105150151-105150171 | UACCUACUCAGACUUUGGGC | 2893 |
| 54790_1_10294 | − | chr4: 105150155-105150175 | AAUUUACCUACUCAGACUUU | 2894 |
| 54790_1_10295 | − | chr4: 105150156-105150176 | GAAUUUACCUACUCAGACUU | 2895 |
| 54790_1_10310 | − | chr4: 105150200-105150220 | UUUGAAGAUAUUUUAUUUCA | 2896 |
| 54790_1_10339 | − | chr4: 105150421-105150441 | UAACAUUAAAACAGUCUACA | 2897 |
| 54790_1_10344 | − | chr4: 105150450-105150470 | UUUUAGCCUGUUCCCAAGGU | 2898 |
| 54790_1_10347 | − | chr4: 105150454-105150474 | AAAGUUUUAGCCUGUUCCCA | 2899 |
| 54790_1_10349 | − | chr4: 105150480-105150500 | GAUGAACAAAUACUGACAGC | 2900 |
| 54790_1_10355 | − | chr4: 105150532-105150552 | CCUUAAGAACUACUGUGCAA | 2901 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_10363 | - | chr4: 105150567-105150587 | UAUUCUAUUGCUGCUGGCUU | 2902 |
| 54790_1_10365 | - | chr4: 105150573-105150593 | GGGAGAUAUUCUAUUGCUGC | 2903 |
| 54790_1_10368 | - | chr4: 105150593-105150613 | UCCAAUUGUAAAGUUGGCUU | 2904 |
| 54790_1_10371 | - | chr4: 105150594-105150614 | CUCCAAUUGUAAAGUUGGCU | 2905 |
| 54790_1_10373 | - | chr4: 105150599-105150619 | GAAGGCUCCAAUUGUAAAGU | 2906 |
| 54790_1_10377 | - | chr4: 105150617-105150637 | ACUGGUCUUUCCCACAGUGA | 2907 |
| 54790_1_10379 | - | chr4: 105150635-105150655 | CACCAGCUCUACUUGGCAAC | 2908 |
| 54790_1_10382 | - | chr4: 105150642-105150662 | AGAUAACCACCAGCUCUACU | 2909 |
| 54790_1_10390 | - | chr4: 105150689-105150709 | AUAUUGGCAAAAUCAUUUG | 2910 |
| 54790_1_10391 | - | chr4: 105150704-105150724 | CCAAGUAAAUACUGUAUAUU | 2911 |
| 54790_1_10397 | - | chr4: 105150736-105150756 | CAGUGAGUAGAAAUAGAAAU | 2912 |
| 54790_1_10403 | - | chr4: 105150759-105150779 | UCACAGUAUUCACUCAGUUU | 2913 |
| 54790_1_10411 | - | chr4: 105150844-105150864 | UGACUUUCCCCUUUCCCUCC | 2914 |
| 54790_1_10420 | - | chr4: 105150894-105150914 | CAGACAUACAUAAUUCUUUU | 2915 |
| 54790_1_10422 | - | chr4: 105150923-105150943 | AUAUAGGACAAAAAUAAUGC | 2916 |
| 54790_1_10425 | - | chr4: 105150939-105150959 | GUCUCUGCAAUGUACAAUAU | 2917 |
| 54790_1_10442 | - | chr4: 105151019-105151039 | CCAAAAUUUGUUAUUUGGAA | 2918 |
| 54790_1_10444 | - | chr4: 105151024-105151044 | GGGAUCCAAAAUUUGUUAUU | 2919 |
| 54790_1_10449 | - | chr4: 105151061-105151081 | AGGGUUUCACGAUCCUAAUG | 2920 |
| 54790_1_10451 | - | chr4: 105151069-105151089 | GGAACCGGAGGGUUUCACGA | 2921 |
| 54790_1_10453 | - | chr4: 105151086-105151106 | GGAGUUCACUAGAGAGUGGA | 2922 |
| 54790_1_10457 | - | chr4: 105151109-105151129 | GGUCCCACCAAAGUUUGAGG | 2923 |
| 54790_1_10458 | - | chr4: 105151123-105151143 | GGACUGACACAACGGGUCCC | 2924 |
| 54790_1_10459 | - | chr4: 105151126-105151146 | CCCGGACUGACACAACGGGU | 2925 |
| 54790_1_10460 | - | chr4: 105151127-105151147 | CCCCGGACUGACACAACGGG | 2926 |
| 54790_1_10471 | - | chr4: 105151146-105151166 | AUUUAAAAAACAUCUCUGAC | 2927 |
| 54790_1_10472 | - | chr4: 105151147-105151167 | AAUUUAAAAAACAUCUCUGA | 2928 |
| 54790_1_10474 | - | chr4: 105151148-105151168 | AAAUUUAAAAAACAUCUCUG | 2929 |
| 54790_1_10477 | - | chr4: 105151197-105151217 | AGGACUCAUCGACCCUGAUG | 2930 |
| 54790_1_10480 | - | chr4: 105151205-105151225 | AGAGUCAGAGGACUCAUCGA | 2931 |
| 54790_1_10482 | - | chr4: 105151206-105151226 | UAGAGUCAGAGGACUCAUCG | 2932 |
| 54790_1_10492 | - | chr4: 105151281-105151301 | AACGGACCCGACCUCGCGUC | 2933 |
| 54790_1_10494 | - | chr4: 105151291-105151311 | AGAGGGGAGAACGGACCCG | 2934 |
| 54790_1_10496 | - | chr4: 105151295-105151315 | UCCCAGAGAGGGAGAACGGA | 2935 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_10498 | - | chr4: 105151296-105151316 | AUCCCAGAGAGGGAGAACGG | 2936 |
| 54790_1_10505 | - | chr4: 105151314-105151334 | ACAACACGCUGAAACUCUAU | 2937 |
| 54790_1_10507 | - | chr4: 105151315-105151335 | AACAACACGCUGAAACUCUA | 2938 |
| 54790_1_10519 | - | chr4: 105151343-105151363 | AAUGUGCUUAAAACAAACAA | 2939 |
| 54790_1_10552 | - | chr4: 105151541-105151561 | GAAUUCUUAAAACUGCAGGU | 2940 |
| 54790_1_10554 | - | chr4: 105151545-105151565 | UUCUGAAUUCUUAAAACUGC | 2941 |
| 54790_1_10557 | - | chr4: 105151574-105151594 | GGUCUUACUCGGUGGUGUGG | 2942 |
| 54790_1_10563 | - | chr4: 105151625-105151645 | GGUCCGACCAGAUCUUGAAG | 2943 |
| 54790_1_10566 | - | chr4: 105151639-105151659 | AGAGUGAUACAACGGGUCCG | 2944 |
| 54790_1_10567 | - | chr4: 105151643-105151663 | CCAUAGAGUGAUACAACGGG | 2945 |
| 54790_1_10577 | - | chr4: 105151664-105151684 | AUAAAAAUAACUUAUCUCUG | 2946 |
| 54790_1_10597 | - | chr4: 105151737-105151757 | AUGAUUUCAAGUCAGUUUAG | 2947 |
| 54790_1_10609 | - | chr4: 105151763-105151783 | ACUUUAAUUCUCAGUUUAUU | 2948 |
| 54790_1_10612 | - | chr4: 105151797-105151817 | GUCCGUACUCGGUGGUGUUG | 2949 |
| 54790_1_10614 | - | chr4: 105151816-105151836 | AGGGUUUCACGACCCUAAUG | 2950 |
| 54790_1_10616 | - | chr4: 105151824-105151844 | GGAACAGCAGGGUUUCACGA | 2951 |
| 54790_1_10617 | - | chr4: 105151825-105151845 | CGGAACAGCAGGGUUUCACG | 2952 |
| 54790_1_10620 | - | chr4: 105151858-105151878 | CCAGAGUUUGAGGACUGGAG | 2953 |
| 54790_1_10624 | - | chr4: 105151879-105151899 | AAAGUGGUACAACCGGUCCG | 2954 |
| 54790_1_10625 | - | chr4: 105151883-105151903 | UCCCAAAGUGGUACAACCGG | 2955 |
| 54790_1_10626 | - | chr4: 105151888-105151908 | CUCUGUCCCAAAGUGGUACA | 2956 |
| 54790_1_10635 | - | chr4: 105151902-105151922 | AACAUAAAAAUCAUCUCUGU | 2957 |
| 54790_1_10636 | - | chr4: 105151903-105151923 | AAACAUAAAAAUCAUCUCUG | 2958 |
| 54790_1_10640 | - | chr4: 105151932-105151952 | GACCACACACGGUGGUACGG | 2959 |
| 54790_1_10641 | - | chr4: 105151951-105151971 | AGGACUCAUCGACCCUAAUG | 2960 |
| 54790_1_10642 | - | chr4: 105151959-105151979 | GGAGUCGGAGGACUCAUCGA | 2961 |
| 54790_1_10643 | - | chr4: 105151960-105151980 | CGGAGUCGGAGGACUCAUCG | 2962 |
| 54790_1_10648 | - | chr4: 105151982-105152002 | GGGUCCGAGUUCACUAAGAG | 2963 |
| 54790_1_10649 | - | chr4: 105151983-105152003 | CGGGUCCGAGUUCACUAAGA | 2964 |
| 54790_1_10652 | - | chr4: 105151999-105152019 | UCCAUACUCGGUGGUACGGG | 2965 |
| 54790_1_10654 | - | chr4: 105152019-105152039 | AGGGUUUCACGACCCUAAUA | 2966 |
| 54790_1_10655 | - | chr4: 105152027-105152047 | GGAGCCGGAGGGUUUCACGA | 2967 |
| 54790_1_10657 | - | chr4: 105152028-105152048 | CGGAGCCGGAGGGUUUCACG | 2968 |
| 54790_1_10659 | - | chr4: 105152044-105152064 | CAGUCCACUAGGUGGACGGA | 2969 |
| 54790_1_10661 | - | chr4: 105152061-105152081 | CCAGAGCUUAAGGACUGCAG | 2970 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_10666 | - | chr4: 105152082-105152102 | AAAGUGGUACAACCGGUCUG | 2971 |
| 54790_1_10667 | - | chr4: 105152091-105152111 | CUCUACCCCAAAGUGGUACA | 2972 |
| 54790_1_10673 | - | chr4: 105152105-105152125 | AACAUACAAAUCACCUCUAC | 2973 |
| 54790_1_10674 | - | chr4: 105152106-105152126 | AAACAUACAAAUCACCUCUA | 2974 |
| 54790_1_10676 | - | chr4: 105152107-105152127 | AAAACAUACAAAUCACCUCU | 2975 |
| 54790_1_10678 | - | chr4: 105152113-105152133 | UCGAUUAAAACAUACAAAUC | 2976 |
| 54790_1_10681 | - | chr4: 105152153-105152173 | AGGUCUUAUCGACUCUGAUG | 2977 |
| 54790_1_10686 | - | chr4: 105152201-105152221 | CGUCGGAGACGGAGGGCCCU | 2978 |
| 54790_1_10687 | - | chr4: 105152202-105152222 | GCGUCGGAGACGGAGGGCCC | 2979 |
| 54790_1_10690 | - | chr4: 105152205-105152225 | GUGGCGUCGGAGACGGAGGG | 2980 |
| 54790_1_10691 | - | chr4: 105152206-105152226 | AGUGGCGUCGGAGACGGAGG | 2981 |
| 54790_1_10694 | - | chr4: 105152230-105152250 | CCUCACGUCGUCUCGGUAGA | 2982 |
| 54790_1_10696 | - | chr4: 105152251-105152271 | AGAGAGACGGAGCGGGUCCG | 2983 |
| 54790_1_10699 | - | chr4: 105152255-105152275 | UCUCAGAGAGACGGAGCGGG | 2984 |
| 54790_1_10714 | - | chr4: 105152279-105152299 | UUAUUAAAAAGAAAAAAAC | 2985 |
| 54790_1_10745 | - | chr4: 105152466-105152486 | GUCAACAGUAGGUUCUAUUA | 2986 |
| 54790_1_10746 | - | chr4: 105152467-105152487 | GGUCAACAGUAGGUUCUAUU | 2987 |
| 54790_1_10750 | - | chr4: 105152477-105152497 | UUGACUGAGAGGUCAACAGU | 2988 |
| 54790_1_10752 | - | chr4: 105152488-105152508 | UCCAUUAAAUAUUGACUGAG | 2989 |
| 54790_1_10770 | - | chr4: 105152532-105152552 | UUUUUUCUAGUUAAAUUGCA | 2990 |
| 54790_1_10774 | - | chr4: 105152577-105152597 | UUUCUUUCUUUGAAAGAAAA | 2991 |
| 54790_1_10782 | - | chr4: 105152640-105152660 | UGUGGUGACGUGAGGUCGGA | 2992 |
| 54790_1_10787 | - | chr4: 105152681-105152701 | GUGAACUUGGACCUUCCGUC | 2993 |
| 54790_1_10789 | - | chr4: 105152687-105152707 | CUCUUAGUGAACUUGGACCU | 2994 |
| 54790_1_10790 | - | chr4: 105152691-105152711 | CUUUCUCUUAGUGAACUUGG | 2995 |
| 54790_1_10798 | - | chr4: 105152718-105152738 | GGAUCAGGGUCGAUGAGACC | 2996 |
| 54790_1_10799 | - | chr4: 105152719-105152739 | AGGAUCAGGGUCGAUGAGAC | 2997 |
| 54790_1_10801 | - | chr4: 105152720-105152740 | GAGGAUCAGGGUCGAUGAGA | 2998 |
| 54790_1_10803 | - | chr4: 105152721-105152741 | CGAGGAUCAGGGUCGAUGAG | 2999 |
| 54790_1_10806 | - | chr4: 105152747-105152767 | UUUUAAUCGGUCCACACCAC | 3000 |
| 54790_1_10807 | - | chr4: 105152748-105152768 | UUUUUAAUCGGUCCACACCA | 3001 |
| 54790_1_10808 | - | chr4: 105152749-105152769 | CUUUUUAAUCGGUCCACACC | 3002 |
| 54790_1_10811 | - | chr4: 105152752-105152772 | UAUCUUUUUAAUCGGUCCAC | 3003 |
| 54790_1_10812 | - | chr4: 105152757-105152777 | AUUUUUAUCUUUUUAAUCGG | 3004 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_10815 | – | chr4: 105152797-105152817 | GCUCUAGUCGGACCGGUUGU | 3005 |
| 54790_1_10816 | – | chr4: 105152806-105152826 | GGUCCUCAUGCUCUAGUCGG | 3006 |
| 54790_1_10818 | – | chr4: 105152824-105152844 | GUCCGUCUAGUGGACUCUGG | 3007 |
| 54790_1_10824 | – | chr4: 105152843-105152863 | CGUGAAACCCUCUGGGCCCG | 3008 |
| 54790_1_10825 | – | chr4: 105152847-105152867 | GGGUCGUGAAACCCUCUGGG | 3009 |
| 54790_1_10826 | – | chr4: 105152848-105152868 | AGGGUCGUGAAACCCUCUGG | 3010 |
| 54790_1_10828 | – | chr4: 105152856-105152876 | CGGACAUUAGGGUCGUGAAA | 3011 |
| 54790_1_10831 | – | chr4: 105152857-105152877 | ACGGACAUUAGGGUCGUGAA | 3012 |
| 54790_1_10834 | – | chr4: 105152884-105152904 | AUAGAUUACUGGUCCACGUC | 3013 |
| 54790_1_10837 | – | chr4: 105152892-105152912 | CAUUGAAAAUAGAUUACUGG | 3014 |
| 54790_1_10847 | – | chr4: 105152981-105153001 | GCCUGUAGAAAUUAAAUGUA | 3015 |
| 54790_1_10855 | – | chr4: 105153015-105153035 | UAAAAUGGGUGGCUUUUAUA | 3016 |
| 54790_1_10857 | – | chr4: 105153016-105153036 | UUAAAAUGGGUGGCUUUUAU | 3017 |
| 54790_1_10862 | – | chr4: 105153026-105153046 | ACUUUGUGCUUAAAAUGGG | 3018 |
| 54790_1_10863 | – | chr4: 105153029-105153049 | UUCACUUUUGUGCUUAAAAU | 3019 |
| 54790_1_10864 | – | chr4: 105153030-105153050 | AUUCACUUUUGUGCUUAAAA | 3020 |
| 54790_1_10876 | – | chr4: 105153127-105153147 | GAGACAUAAUAAAGUAUGUU | 3021 |
| 54790_1_10878 | – | chr4: 105153155-105153175 | CCUUUAACUCGUUCAUAUGC | 3022 |
| 54790_1_10887 | – | chr4: 105153176-105153196 | AACGUUUCACAACGGUGACC | 3023 |
| 54790_1_10889 | – | chr4: 105153177-105153197 | AAACGUUUCACAACGGUGAC | 3024 |
| 54790_1_10892 | – | chr4: 105153178-105153198 | AAAACGUUUCACAACGGUGA | 3025 |
| 54790_1_10894 | – | chr4: 105153179-105153199 | CAAAACGUUUCACAACGGUG | 3026 |
| 54790_1_10901 | – | chr4: 105153250-105153270 | GGUGUAGUUACAGUCAUAGU | 3027 |
| 54790_1_10903 | – | chr4: 105153273-105153293 | CUGUAGACUUAUUCUAAUCA | 3028 |
| 54790_1_10906 | – | chr4: 105153295-105153315 | UUACUCAUGUUCAAUUUGAC | 3029 |
| 54790_1_10910 | – | chr4: 105153338-105153358 | UAUGUGAUGUACACUGAUUU | 3030 |
| 54790_1_10917 | – | chr4: 105153369-105153389 | UUCUCUGUUUUGAGAAAAAA | 3031 |
| 54790_1_10930 | – | chr4: 105153443-105153463 | UUCUGACACACAUUUUAAUA | 3032 |
| 54790_1_10936 | – | chr4: 105153491-105153511 | AAGGCCAUUCUAUCAAAAAA | 3033 |
| 54790_1_10943 | – | chr4: 105153510-105153530 | UUAAAAUAUUUUUAACAUAA | 3034 |
| 54790_1_10949 | – | chr4: 105153580-105153600 | UUCUUAUUAUGGAUAGAGAU | 3035 |
| 54790_1_10950 | – | chr4: 105153581-105153601 | AUUCUUAUUAUGGAUAGAGA | 3036 |
| 54790_1_10956 | – | chr4: 105153605-105153625 | UCAAAGGAGUGAGUAUUUAU | 3037 |
| 54790_1_10958 | – | chr4: 105153606-105153626 | GUCAAAGGAGUGAGUAUUUA | 3038 |
| 54790_1_10964 | – | chr4: 105153632-105153652 | CCUUCAAUAAAUUGGAGUGA | 3039 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_10965 | - | chr4: 105153633-105153653 | UCCUUCAAUAAAUUGGAGUG | 3040 |
| 54790_1_10968 | - | chr4: 105153653-105153673 | CAUAUCCGACAUACUUGAAU | 3041 |
| 54790_1_10971 | - | chr4: 105153669-105153689 | CGAUUCGGAUUCGGUACAUA | 3042 |
| 54790_1_10973 | - | chr4: 105153691-105153711 | UCUGACGAAUUGAGUUUACG | 3043 |
| 54790_1_10978 | - | chr4: 105153724-105153744 | UUAUAUCACUAAUUUUCUAA | 3044 |
| 54790_1_11000 | - | chr4: 105153858-105153878 | UAUUACGACAUUACUUGUAA | 3045 |
| 54790_1_11011 | - | chr4: 105153906-105153926 | AGUACUGUACUAUCUGUAGA | 3046 |
| 54790_1_11012 | - | chr4: 105153907-105153927 | GAGUACUGUACUAUCUGUAG | 3047 |
| 54790_1_11021 | - | chr4: 105153953-105153973 | GAAUUAUUAUAAAGUGACAU | 3048 |
| 54790_1_11034 | - | chr4: 105154042-105154062 | UUAACUUUCGUAUAGUAUAC | 3049 |
| 54790_1_11041 | - | chr4: 105154076-105154096 | GAGGAAUCUAAACGGAUAAG | 3050 |
| 54790_1_11047 | - | chr4: 105154151-105154171 | UUUCUUUAGAGUAUGAAUAA | 3051 |
| 54790_1_11062 | - | chr4: 105154216-105154236 | AAGUCGUAUAAGUUUCUCAA | 3052 |
| 54790_1_11063 | - | chr4: 105154217-105154237 | AAAGUCGUAUAAGUUUCUCA | 3053 |
| 54790_1_11070 | - | chr4: 105154240-105154260 | AAAUUUCGUAUAUUAAGUCA | 3054 |
| 54790_1_11071 | - | chr4: 105154241-105154261 | AAAAUUUCGUAUAUUAAGUC | 3055 |
| 54790_1_11102 | - | chr4: 105154455-105154475 | AGGGUUUCACGGUCCUAAUG | 3056 |
| 54790_1_11103 | - | chr4: 105154463-105154483 | GGAACCGGAGGGUUUCACGG | 3057 |
| 54790_1_11106 | - | chr4: 105154480-105154500 | UUUGAAGACCAGAGGGCGGA | 3058 |
| 54790_1_11108 | - | chr4: 105154493-105154513 | GGUCUGAUUAGAGUUUGAAG | 3059 |
| 54790_1_11111 | - | chr4: 105154523-105154543 | GUAUCCUUCUCAUCUAUAAG | 3060 |
| 54790_1_11122 | - | chr4: 105154589-105154609 | UCUUCCCAUAUGAGCUCUAA | 3061 |
| 54790_1_11134 | - | chr4: 105154697-105154717 | AUCUCCUGAACUGAAUGGCU | 3062 |
| 54790_1_11136 | - | chr4: 105154702-105154722 | GUUACAUCUCCUGAACUGAA | 3063 |
| 54790_1_11143 | - | chr4: 105154724-105154744 | AGACAUUCCUUUUAACACUU | 3064 |
| 54790_1_11144 | - | chr4: 105154725-105154745 | CAGACAUUCCUUUUAACACU | 3065 |
| 54790_1_11148 | - | chr4: 105154766-105154786 | AGCGUUUCACGACCCUAAUG | 3066 |
| 54790_1_11150 | - | chr4: 105154774-105154794 | GAAGGCGGAGCGUUUCACGA | 3067 |
| 54790_1_11152 | - | chr4: 105154775-105154795 | UGAAGGCGGAGCGUUUCACG | 3068 |
| 54790_1_11161 | - | chr4: 105154833-105154853 | CCCCAAAACGGUACAACGGG | 3069 |
| 54790_1_11169 | - | chr4: 105154852-105154872 | CACGUAAAAAACAUCCCUAC | 3070 |
| 54790_1_11170 | - | chr4: 105154853-105154873 | ACACGUAAAAAACAUCCCUA | 3071 |
| 54790_1_11172 | - | chr4: 105154854-105154874 | AACACGUAAAAAACAUCCCU | 3072 |
| 54790_1_11174 | - | chr4: 105154858-105154878 | AUUAAACACGUAAAAAACAU | 3073 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_11176 | − | chr4: 105154859-105154879 | GAUUAAACACGUAAAAAACA | 3074 |
| 54790_1_11178 | − | chr4: 105154900-105154920 | GUGUUCAUGGACCUUGAUGU | 3075 |
| 54790_1_11180 | − | chr4: 105154901-105154921 | GGUGUUCAUGGACCUUGAUG | 3076 |
| 54790_1_11182 | − | chr4: 105154910-105154930 | CGGAGUCGGGGUGUUCAUGG | 3077 |
| 54790_1_11187 | − | chr4: 105154949-105154969 | GUGACGUCGGAGUUGAAGGG | 3078 |
| 54790_1_11188 | − | chr4: 105154974-105154994 | CUUCACACCCCGUGGUUGU | 3079 |
| 54790_1_11192 | − | chr4: 105154985-105155005 | AGUGGGUCCGACUUCACACC | 3080 |
| 54790_1_11193 | − | chr4: 105154986-105155006 | CAGUGGGUCCGACUUCACAC | 3081 |
| 54790_1_11195 | − | chr4: 105154987-105155007 | ACAGUGGGUCCGACUUCACA | 3082 |
| 54790_1_11197 | − | chr4: 105154988-105155008 | AACAGUGGGUCCGACUUCAC | 3083 |
| 54790_1_11200 | − | chr4: 105154999-105155019 | UCCCAGAGUAAAACAGUGGG | 3084 |
| 54790_1_11212 | − | chr4: 105155018-105155038 | UAGAAAAAAAAACUCUCUCU | 3085 |
| 54790_1_11214 | − | chr4: 105155019-105155039 | AUAGAAAAAAAAACUCUCUC | 3086 |
| 54790_1_11250 | − | chr4: 105155211-105155231 | AAAAUCUGAAACAUGACAAG | 3087 |
| 54790_1_11264 | − | chr4: 105155284-105155304 | AUGCCACAGUAUCAGUUAAC | 3088 |
| 54790_1_11284 | − | chr4: 105155364-105155384 | CCCUGUUUCUCACUUUGUCC | 3089 |
| 54790_1_11288 | − | chr4: 105155406-105155426 | GCAGCCAUGUGUAGCAAAGA | 3090 |
| 54790_1_11295 | − | chr4: 105155444-105155464 | GUGGUUUGUAGAAGUUCUGC | 3091 |
| 54790_1_11301 | − | chr4: 105155463-105155483 | GCACUCAUUUUACCUGUAAG | 3092 |
| 54790_1_11304 | − | chr4: 105155503-105155523 | CUACAAGUCAUAGUUCCAUA | 3093 |
| 54790_1_11305 | − | chr4: 105155504-105155524 | ACUACAAGUCAUAGUUCCAU | 3094 |
| 54790_1_11313 | − | chr4: 105155578-105155598 | CUGGUAUCUAGAAUUACAUA | 3095 |
| 54790_1_11316 | − | chr4: 105155597-105155617 | CAUUGCACAACAAGAAUGUC | 3096 |
| 54790_1_11322 | − | chr4: 105155627-105155647 | CAUUCUCAUGAGAAUAAAA | 3097 |
| 54790_1_11324 | − | chr4: 105155628-105155648 | GCAUUCUCAUGAGAAUAAAA | 3098 |
| 54790_1_11329 | − | chr4: 105155661-105155681 | CCCAAGGUAUGGGAUCCAAC | 3099 |
| 54790_1_11331 | − | chr4: 105155671-105155691 | CAGUCAUGGUCCCAAGGUAU | 3100 |
| 54790_1_11332 | − | chr4: 105155672-105155692 | UCAGUCAUGGUCCCAAGGUA | 3101 |
| 54790_1_11335 | − | chr4: 105155677-105155697 | AGUUAUCAGUCAUGGUCCCA | 3102 |
| 54790_1_11339 | − | chr4: 105155685-105155705 | UCCACUCCAGUUAUCAGUCA | 3103 |
| 54790_1_11348 | − | chr4: 105155779-105155799 | AGCCAAUAUACUUCCUUAUU | 3104 |
| 54790_1_11349 | − | chr4: 105155780-105155800 | AAGCCAAUAUACUUCCUUAU | 3105 |
| 54790_1_11359 | − | chr4: 105155909-105155929 | CUAACAUGAGCAUCUAUCUU | 3106 |
| 54790_1_11360 | − | chr4: 105155910-105155930 | UCUAACAUGAGCAUCUAUCU | 3107 |
| 54790_1_11365 | − | chr4: 105155933-105155953 | CACUACACCAACUUCUUAAU | 3108 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_11366 | - | chr4: 105155934-105155954 | UCACUACACCAACUUCUUAA | 3109 |
| 54790_1_11379 | - | chr4: 105155998-105156018 | AGCUAGUCAUUUCUCCAGUA | 3110 |
| 54790_1_11394 | - | chr4: 105156064-105156084 | AAAUUUAUAGUCAGCUGAGG | 3111 |
| 54790_1_11395 | - | chr4: 105156067-105156087 | CAAAAAUUUAUAGUCAGCUG | 3112 |
| 54790_1_11405 | - | chr4: 105156101-105156121 | GAACAACUUUUUUAAAAUUA | 3113 |
| 54790_1_11417 | - | chr4: 105156168-105156188 | GAGAACAGAUUUACAUUUUU | 3114 |
| 54790_1_11435 | - | chr4: 105156265-105156285 | CAUUUUUCUUCUUUUGAAUA | 3115 |
| 54790_1_11446 | - | chr4: 105156333-105156353 | GCAUUUCUAUGCCUGAACAU | 3116 |
| 54790_1_11449 | - | chr4: 105156379-105156399 | AAAAAUAUCAAUACUCUGUA | 3117 |
| 54790_1_11462 | - | chr4: 105156490-105156510 | GGUUUUAGCAAUGGCUAAUG | 3118 |
| 54790_1_11466 | - | chr4: 105156499-105156519 | GGUAAGGCAGGUUUUAGCAA | 3119 |
| 54790_1_11467 | - | chr4: 105156511-105156531 | AAUAAGUGAUUUGGUAAGGC | 3120 |
| 54790_1_11468 | - | chr4: 105156515-105156535 | AGAAAAUAAGUGAUUUGGUA | 3121 |
| 54790_1_11469 | - | chr4: 105156520-105156540 | CAUCAAGAAAAUAAGUGAUU | 3122 |
| 54790_1_11477 | - | chr4: 105156567-105156587 | GUUCUCAUUAAUGUAUAACC | 3123 |
| 54790_1_11482 | - | chr4: 105156595-105156615 | UAAUAACCCAUUUGAGAGAU | 3124 |
| 54790_1_11483 | - | chr4: 105156596-105156616 | AUAAUAACCCAUUUGAGAGA | 3125 |
| 54790_1_11497 | - | chr4: 105156629-105156649 | UUUUAUGCAUCAUCUAUUUC | 3126 |
| 54790_1_11511 | - | chr4: 105156686-105156706 | AUAUACCAUGCUAUGUUAUC | 3127 |
| 54790_1_11513 | - | chr4: 105156717-105156737 | AGACAGGUAAGAAAAACGGG | 3128 |
| 54790_1_11517 | - | chr4: 105156720-105156740 | UGCAGACAGGUAAGAAAAAC | 3129 |
| 54790_1_11519 | - | chr4: 105156721-105156741 | GUGCAGACAGGUAAGAAAAA | 3130 |
| 54790_1_11523 | - | chr4: 105156733-105156753 | GUGCCCUUCUUAGUGCAGAC | 3131 |
| 54790_1_11527 | - | chr4: 105156755-105156775 | UAAUAAUUAUGGUAUUUAAU | 3132 |
| 54790_1_11528 | - | chr4: 105156756-105156776 | CUAAUAAUUAUGGUAUUUAA | 3133 |
| 54790_1_11530 | - | chr4: 105156766-105156786 | GGCAGCACAACUAAUAAUUA | 3134 |
| 54790_1_11533 | - | chr4: 105156787-105156807 | AUUCUGGUGCUCUACUUCAG | 3135 |
| 54790_1_11537 | - | chr4: 105156803-105156823 | AUUGUAUUACUCUCACAUUC | 3136 |
| 54790_1_11539 | - | chr4: 105156830-105156850 | UUAUGGAUAGAAUCUGGGUG | 3137 |
| 54790_1_11540 | - | chr4: 105156835-105156855 | GUAUGUUAUGGAUAGAAUCU | 3138 |
| 54790_1_11541 | - | chr4: 105156836-105156856 | AGUAUGUUAUGGAUAGAAUC | 3139 |
| 54790_1_11545 | - | chr4: 105156847-105156867 | AAGACCAGGACAGUAUGUUA | 3140 |
| 54790_1_11548 | - | chr4: 105156861-105156881 | UUAAAAAAUUAAUAAGACC | 3141 |
| 54790_1_11550 | - | chr4: 105156884-105156904 | AAAGUGCUAAAAGAACAAAC | 3142 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_11554 | − | chr4: 105156908-105156928 | AAGAGACUUCAAACAAAAGC | 3143 |
| 54790_1_11562 | − | chr4: 105156960-105156980 | UGAGAUAACUUUACAGCCAA | 3144 |
| 54790_1_11572 | − | chr4: 105157034-105157054 | AAUCAUCUGAAUUAAUUACA | 3145 |
| 54790_1_11573 | − | chr4: 105157035-105157055 | UAAUCAUCUGAAUUAAUUAC | 3146 |
| 54790_1_11587 | − | chr4: 105157090-105157110 | UCUUCUGUUAUAAUGUAUAU | 3147 |
| 54790_1_11591 | − | chr4: 105157118-105157138 | AGACACUGUAUUUGUAGAAA | 3148 |
| 54790_1_11612 | − | chr4: 105157208-105157228 | UACAUUUGGUACAUUAAAAU | 3149 |
| 54790_1_11619 | − | chr4: 105157222-105157242 | UUCUUUUCAUCAGUUACAUU | 3150 |
| 54790_1_11627 | − | chr4: 105157250-105157270 | UUUUGAAAGGUACCCAUUUA | 3151 |
| 54790_1_11636 | − | chr4: 105157263-105157283 | UUUUUUCCUUCAUUUUUGAA | 3152 |
| 54790_1_11647 | − | chr4: 105157310-105157330 | ACUAAAAUAAAUAAUUUAUA | 3153 |
| 54790_1_11658 | − | chr4: 105157389-105157409 | AAGAUAAAAUCUAUAAAACA | 3154 |
| 54790_1_11663 | − | chr4: 105157416-105157436 | AACCAUUUCAGUGGCUAGAU | 3155 |
| 54790_1_11667 | − | chr4: 105157425-105157445 | UGGAGAAAAAACCAUUUCAG | 3156 |
| 54790_1_11670 | − | chr4: 105157445-105157465 | UGUAGAUAAUAUAACUUCAC | 3157 |
| 54790_1_11683 | − | chr4: 105157515-105157535 | GUUUUUCCACAAGCGUAAUG | 3158 |
| 54790_1_11693 | − | chr4: 105157581-105157601 | UUAAAUCUUAGCCAUUAAUA | 3159 |
| 54790_1_11713 | − | chr4: 105157719-105157739 | UACGGUGACGUGAGGUCGGA | 3160 |
| 54790_1_11714 | − | chr4: 105157720-105157740 | GUACGGUGACGUGAGGUCGG | 3161 |
| 54790_1_11718 | − | chr4: 105157760-105157780 | GCGAACUUGGGUCUUCCUCC | 3162 |
| 54790_1_11719 | − | chr4: 105157763-105157783 | UUAGCGAACUUGGGUCUUCC | 3163 |
| 54790_1_11723 | − | chr4: 105157766-105157786 | CUCUUAGCGAACUUGGGUCU | 3164 |
| 54790_1_11730 | − | chr4: 105157788-105157808 | CGAUGAGCCCUCCGACUCUG | 3165 |
| 54790_1_11733 | − | chr4: 105157798-105157818 | AUAUUAGGGUCGAUGAGCCC | 3166 |
| 54790_1_11735 | − | chr4: 105157801-105157821 | CGGAUAUUAGGGUCGAUGAG | 3167 |
| 54790_1_11737 | − | chr4: 105157802-105157822 | ACGGAUAUUAGGGUCGAUGA | 3168 |
| 54790_1_11740 | − | chr4: 105157825-105157845 | UUAAUCGGUCCGUACCACCG | 3169 |
| 54790_1_11741 | − | chr4: 105157829-105157849 | GUUUUAAUCGGUCCGUACC | 3170 |
| 54790_1_11742 | − | chr4: 105157832-105157852 | UACGUUUUAAUCGGUCCGU | 3171 |
| 54790_1_11743 | − | chr4: 105157837-105157857 | AUUUUACGUUUUAAUCGG | 3172 |
| 54790_1_11748 | − | chr4: 105157877-105157897 | GCUCGGUCGGAUCGGAUGU | 3173 |
| 54790_1_11750 | − | chr4: 105157904-105157924 | CCCCACCUAGUGAUCUCCAG | 3174 |
| 54790_1_11753 | − | chr4: 105157909-105157929 | UCUUCCCCACCUAGUGAUC | 3175 |
| 54790_1_11757 | − | chr4: 105157920-105157940 | GAAAUCCUUCGUCUUCCCCC | 3176 |
| 54790_1_11759 | − | chr4: 105157923-105157943 | CGUGAAAUCCUUCGUCUUCC | 3177 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_11760 | - | chr4: 105157924-105157944 | UCGUGAAAUCCUUCGUCUUC | 3178 |
| 54790_1_11761 | - | chr4: 105157925-105157945 | GUCGUGAAAUCCUUCGUCUU | 3179 |
| 54790_1_11763 | - | chr4: 105157926-105157946 | GGUCGUGAAAUCCUUCGUCU | 3180 |
| 54790_1_11768 | - | chr4: 105157936-105157956 | CGGACAUUAGGGUCGUGAAA | 3181 |
| 54790_1_11772 | - | chr4: 105157964-105157984 | AAAUAAGUUCCGGUCCGGCU | 3182 |
| 54790_1_11774 | - | chr4: 105157971-105157991 | UAACAGUAAAUAAGUUCCGG | 3183 |
| 54790_1_11775 | - | chr4: 105157976-105157996 | AGUUGUAACAGUAAAUAAGU | 3184 |
| 54790_1_11802 | - | chr4: 105158114-105158134 | CCCAUGCUCUUGAAAAAUGU | 3185 |
| 54790_1_11824 | - | chr4: 105158282-105158302 | CCCAAAAACCCCGAGGAUUA | 3186 |
| 54790_1_11825 | - | chr4: 105158289-105158309 | AUAGUUUCCCAAAAACCCCG | 3187 |
| 54790_1_11849 | - | chr4: 105158415-105158435 | UUCAUUAUAUCUUUUACAAU | 3188 |
| 54790_1_11850 | - | chr4: 105158416-105158436 | AUUCAUUAUAUCUUUUACAA | 3189 |
| 54790_1_11859 | - | chr4: 105158456-105158476 | UUUUACCUCUCUUCCUAUCU | 3190 |
| 54790_1_11865 | - | chr4: 105158493-105158513 | CAAUGGCUUUCCUUGGGUGA | 3191 |
| 54790_1_11870 | - | chr4: 105158499-105158519 | AGUAUUCAAUGGCUUUCCUU | 3192 |
| 54790_1_11871 | - | chr4: 105158500-105158520 | CAGUAUUCAAUGGCUUUCCU | 3193 |
| 54790_1_11873 | - | chr4: 105158510-105158530 | AUGACCCAUUCAGUAUUCAA | 3194 |
| 54790_1_11881 | - | chr4: 105158578-105158598 | ACCAGAGAUAUACACUAAGU | 3195 |
| 54790_1_11888 | - | chr4: 105158618-105158638 | AGUGUAAACUGAGAUAUUAU | 3196 |
| 54790_1_11889 | - | chr4: 105158619-105158639 | CAGUGUAAACUGAGAUAUUA | 3197 |
| 54790_1_11904 | - | chr4: 105158668-105158688 | UUUCUACUUCCUCUAUUUGC | 3198 |
| 54790_1_11917 | - | chr4: 105158729-105158749 | UGCUCUACCUAAUUCAAUUU | 3199 |
| 54790_1_11944 | - | chr4: 105158802-105158822 | AAAAAAAAAACCAAAAAAG | 3200 |
| 54790_1_11955 | - | chr4: 105158847-105158867 | AAGGAAUUAUCACUAACUAA | 3201 |
| 54790_1_11956 | - | chr4: 105158848-105158868 | CAAGGAAUUAUCACUAACUA | 3202 |
| 54790_1_11958 | - | chr4: 105158866-105158886 | AAAUGAGCAUACAGAUGUCA | 3203 |
| 54790_1_11969 | - | chr4: 105158895-105158915 | AAGAGAAGCCUACUAUUUUU | 3204 |
| 54790_1_11976 | - | chr4: 105158941-105158961 | UGUGACCGCGUGUAACUGGA | 3205 |
| 54790_1_11979 | - | chr4: 105158945-105158965 | UUGAUGUGACCGCGUGUAAC | 3206 |
| 54790_1_11984 | - | chr4: 105158985-105159005 | AAAUACUGCUGCCACGUGCA | 3207 |
| 54790_1_11985 | - | chr4: 105159015-105159035 | GAGUCUCUGGAAUCCUAGGA | 3208 |
| 54790_1_11987 | - | chr4: 105159019-105159039 | AUAAGAGUCUCUGGAAUCCU | 3209 |
| 54790_1_11989 | - | chr4: 105159028-105159048 | CACUGUUACAUAAGAGUCUC | 3210 |
| 54790_1_11998 | - | chr4: 105159109-105159129 | CAGAGCCAGACAAGGGCUCC | 3211 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_12000 | - | chr4: 105159116-105159136 | ACCCUAUCAGAGCCAGACAA | 3212 |
| 54790_1_12002 | - | chr4: 105159117-105159137 | GACCCUAUCAGAGCCAGACA | 3213 |
| 54790_1_12008 | - | chr4: 105159145-105159165 | GACCUAAACACCUUGAUCUU | 3214 |
| 54790_1_12013 | - | chr4: 105159176-105159196 | GGUAGGAAAACCAUGCGUUA | 3215 |
| 54790_1_12014 | - | chr4: 105159177-105159197 | UGGUAGGAAAACCAUGCGUU | 3216 |
| 54790_1_12020 | - | chr4: 105159193-105159213 | ACAGCUUUUGAGGCUUUGGU | 3217 |
| 54790_1_12025 | - | chr4: 105159197-105159217 | AGGCACAGCUUUUGAGGCUU | 3218 |
| 54790_1_12027 | - | chr4: 105159203-105159223 | GUAUUUAGGCACAGCUUUUG | 3219 |
| 54790_1_12030 | - | chr4: 105159217-105159237 | AAAAGAUUAAUCUUGUAUUU | 3220 |
| 54790_1_12038 | - | chr4: 105159295-105159315 | CGCGGUGACGUGAGGUUGGA | 3221 |
| 54790_1_12040 | - | chr4: 105159317-105159337 | CAACGUCACUCGGCUCUAGC | 3222 |
| 54790_1_12044 | - | chr4: 105159339-105159359 | GCGAACUUGGCCACUCCGCC | 3223 |
| 54790_1_12046 | - | chr4: 105159342-105159362 | UUAGCGAACUUGGCCACUCC | 3224 |
| 54790_1_12048 | - | chr4: 105159345-105159365 | CUCUUAGCGAACUUGGCCAC | 3225 |
| 54790_1_12050 | - | chr4: 105159350-105159370 | CCGACCUCUUAGCGAACUUG | 3226 |
| 54790_1_12054 | - | chr4: 105159367-105159387 | CGAUGAACCCACAGACUCCG | 3227 |
| 54790_1_12057 | - | chr4: 105159371-105159391 | GGGUCGAUGAACCCACAGAC | 3228 |
| 54790_1_12059 | - | chr4: 105159380-105159400 | CGGAUAUUAGGGUCGAUGAA | 3229 |
| 54790_1_12060 | - | chr4: 105159381-105159401 | ACGGAUAUUAGGGUCGAUGA | 3230 |
| 54790_1_12063 | - | chr4: 105159408-105159428 | UGUUUUAAUCGGCCCGCACC | 3231 |
| 54790_1_12064 | - | chr4: 105159411-105159431 | UUAUGUUUUAAUCGGCCCGC | 3232 |
| 54790_1_12065 | - | chr4: 105159416-105159436 | GAUUUUUAUGUUUUAAUCGG | 3233 |
| 54790_1_12066 | - | chr4: 105159417-105159437 | UGAUUUUUAUGUUUUAAUCG | 3234 |
| 54790_1_12070 | - | chr4: 105159455-105159475 | GUUGUGGUCCGACUGGUUGU | 3235 |
| 54790_1_12074 | - | chr4: 105159468-105159488 | AUUCAGCCCUCAAGUUGUGG | 3236 |
| 54790_1_12076 | - | chr4: 105159482-105159502 | GUUCGCCUAGUGGAAUUCAG | 3237 |
| 54790_1_12077 | - | chr4: 105159483-105159503 | CGUUCGCCUAGUGGAAUUCA | 3238 |
| 54790_1_12082 | - | chr4: 105159498-105159518 | GAAACCCCCGGCUUCGUUC | 3239 |
| 54790_1_12085 | - | chr4: 105159511-105159531 | ACAUUAGGGUCGUGAAACCC | 3240 |
| 54790_1_12086 | - | chr4: 105159512-105159532 | GACAUUAGGGUCGUGAAACC | 3241 |
| 54790_1_12087 | - | chr4: 105159513-105159533 | GGACAUUAGGGUCGUGAAAC | 3242 |
| 54790_1_12090 | - | chr4: 105159514-105159534 | CGGACAUUAGGGUCGUGAAA | 3243 |
| 54790_1_12092 | - | chr4: 105159515-105159535 | UCGGACAUUAGGGUCGUGAA | 3244 |
| 54790_1_12096 | - | chr4: 105159542-105159562 | UUAAUCUUACGACCCGCGCC | 3245 |
| 54790_1_12097 | - | chr4: 105159545-105159565 | AGAUUAAUCUUACGACCCGC | 3246 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_12098 | − | chr4: 105159550-105159570 | UAAAAAGAUUAAUCUUACGA | 3247 |
| 54790_1_12099 | − | chr4: 105159551-105159571 | AUAAAAAGAUUAAUCUUACG | 3248 |
| 54790_1_12106 | − | chr4: 105159575-105159595 | AUGACUAGUUGUUUGCUGCA | 3249 |
| 54790_1_12107 | − | chr4: 105159576-105159596 | CAUGACUAGUUGUUUGCUGC | 3250 |
| 54790_1_12111 | − | chr4: 105159599-105159619 | CCCAAAUCACAAAAAUGGUU | 3251 |
| 54790_1_12112 | − | chr4: 105159604-105159624 | GUUUCCCAAAUCACAAAAA | 3252 |
| 54790_1_12120 | − | chr4: 105159696-105159716 | AUUUUGUGAGGCUGGGAGGC | 3253 |
| 54790_1_12123 | − | chr4: 105159700-105159720 | AGGCAUUUUGUGAGGCUGGG | 3254 |
| 54790_1_12127 | − | chr4: 105159703-105159723 | UAAAGGCAUUUUGUGAGGCU | 3255 |
| 54790_1_12130 | − | chr4: 105159704-105159724 | UUAAAGGCAUUUUGUGAGGC | 3256 |
| 54790_1_12132 | − | chr4: 105159708-105159728 | UUUUUAAAGGCAUUUUGUG | 3257 |
| 54790_1_12134 | − | chr4: 105159720-105159740 | CGGAAGAUGUAAUUUUUUAA | 3258 |
| 54790_1_12136 | − | chr4: 105159742-105159762 | UAAUGUCCGCACUCGGUAGG | 3259 |
| 54790_1_12138 | − | chr4: 105159757-105159777 | AGGGUUUUACGGCCCUAAUG | 3260 |
| 54790_1_12140 | − | chr4: 105159765-105159785 | GGAACCGGAGGGUUUUACGG | 3261 |
| 54790_1_12141 | − | chr4: 105159766-105159786 | CGGAACCGGAGGGUUUUACG | 3262 |
| 54790_1_12145 | − | chr4: 105159782-105159802 | GCUAGAGAACGGUGGGCGGA | 3263 |
| 54790_1_12150 | − | chr4: 105159812-105159832 | CCCAAAAGUGGCACAACCGG | 3264 |
| 54790_1_12153 | − | chr4: 105159817-105159837 | CUCUGCCCAAAAGUGGCACA | 3265 |
| 54790_1_12161 | − | chr4: 105159832-105159852 | AAACAUAAAAAUCGUCUCUG | 3266 |
| 54790_1_12162 | − | chr4: 105159833-105159853 | AAAACAUAAAAAUCGUCUCU | 3267 |
| 54790_1_12166 | − | chr4: 105159880-105159900 | AGGGUUCAUCGACCCUAAUG | 3268 |
| 54790_1_12167 | − | chr4: 105159888-105159908 | GGUGUCAGAGGGUUCAUCGA | 3269 |
| 54790_1_12169 | − | chr4: 105159889-105159909 | CGGUGUCAGAGGGUUCAUCG | 3270 |
| 54790_1_12172 | − | chr4: 105159927-105159947 | UGACGUUGGAGGCGGAGGGC | 3271 |
| 54790_1_12173 | − | chr4: 105159928-105159948 | GUGACGUUGGAGGCGGAGGG | 3272 |
| 54790_1_12174 | − | chr4: 105159929-105159949 | AGUGACGUUGGAGGCGGAGG | 3273 |
| 54790_1_12177 | − | chr4: 105159953-105159973 | CCUCACGUCACCGCGCUAGA | 3274 |
| 54790_1_12179 | − | chr4: 105159964-105159984 | CAGCGGUCCGACCUCACGUC | 3275 |
| 54790_1_12180 | − | chr4: 105159974-105159994 | CAGAGCAAGACAGCGGUCCG | 3276 |
| 54790_1_12183 | − | chr4: 105159978-105159998 | GCCUCAGAGCAAGACAGCGG | 3277 |
| 54790_1_12196 | − | chr4: 105159998-105160018 | GAAAAAAAAAAAAGACUCU | 3278 |
| 54790_1_12213 | − | chr4: 105160069-105160089 | CUGGUCAGACCGUUUAGUUU | 3279 |
| 54790_1_12215 | − | chr4: 105160070-105160090 | UCUGGUCAGACCGUUUAGUU | 3280 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_12222 | - | chr4: 105160088-105160108 | GAGUUUUCUUGAGUGUUUUC | 3281 |
| 54790_1_12226 | - | chr4: 105160126-105160146 | GCAGGUAUAAUGGUAUACUA | 3282 |
| 54790_1_12229 | - | chr4: 105160136-105160156 | AAGGGGAGAGGCAGGUAUAA | 3283 |
| 54790_1_12230 | - | chr4: 105160144-105160164 | GAUGGGGAAAGGGGAGAGGC | 3284 |
| 54790_1_12233 | - | chr4: 105160148-105160168 | AGAGGAUGGGGAAAGGGGAG | 3285 |
| 54790_1_12235 | - | chr4: 105160153-105160173 | UUUACAGAGGAUGGGGAAAG | 3286 |
| 54790_1_12237 | - | chr4: 105160154-105160174 | AUUUACAGAGGAUGGGGAAA | 3287 |
| 54790_1_12239 | - | chr4: 105160155-105160175 | AAUUUACAGAGGAUGGGGAA | 3288 |
| 54790_1_12243 | - | chr4: 105160160-105160180 | GAGAGAAUUUACAGAGGAUG | 3289 |
| 54790_1_12246 | - | chr4: 105160161-105160181 | UGAGAGAAUUUACAGAGGAU | 3290 |
| 54790_1_12247 | - | chr4: 105160162-105160182 | UUGAGAGAAUUUACAGAGGA | 3291 |
| 54790_1_12250 | - | chr4: 105160166-105160186 | AAGGUUGAGAGAAUUUACAG | 3292 |
| 54790_1_12258 | - | chr4: 105160185-105160205 | AUGAAAUUAAAAAUGAGAGA | 3293 |
| 54790_1_12270 | - | chr4: 105160209-105160229 | GUUGUUUUAGCUCUAGGUCU | 3294 |
| 54790_1_12273 | - | chr4: 105160215-105160235 | GUUGUUGUUGUUUUAGCUCU | 3295 |
| 54790_1_12279 | - | chr4: 105160270-105160290 | AAAAAUCAAUUUGGGAUAGG | 3296 |
| 54790_1_12281 | - | chr4: 105160273-105160293 | UCUAAAAAUCAAUUUGGGAU | 3297 |
| 54790_1_12283 | - | chr4: 105160278-105160298 | AAAGCUCUAAAAAUCAAUUU | 3298 |
| 54790_1_12285 | - | chr4: 105160279-105160299 | AAAAGCUCUAAAAAUCAAUU | 3299 |
| 54790_1_12309 | - | chr4: 105160369-105160389 | AUACAUAUACCAAAUAUACG | 3300 |
| 54790_1_12327 | - | chr4: 105160511-105160531 | AGGCAAGAAGGCUUCUAUUU | 3301 |
| 54790_1_12331 | - | chr4: 105160523-105160543 | CAAUUCUUUGUUAGGCAAGA | 3302 |
| 54790_1_12334 | - | chr4: 105160531-105160551 | UCUAAUUACAAUUCUUUGUU | 3303 |
| 54790_1_12354 | - | chr4: 105160638-105160658 | GAUUUUUCCUAUCUUUAGAA | 3304 |
| 54790_1_12374 | - | chr4: 105160722-105160742 | UGGUGCUUGGUUUAGCUCUU | 3305 |
| 54790_1_12377 | - | chr4: 105160723-105160743 | UUGGUGCUUGGUUUAGCUCU | 3306 |
| 54790_1_12379 | - | chr4: 105160735-105160755 | CAAAAACAGAUUUGGUGCU | 3307 |
| 54790_1_12380 | - | chr4: 105160742-105160762 | AAACCCCAAAAAACAGAUU | 3308 |
| 54790_1_12382 | - | chr4: 105160809-105160829 | UGAGGUCGGACCCGCUGUCU | 3309 |
| 54790_1_12385 | - | chr4: 105160810-105160830 | GUGAGGUCGGACCCGCUGUC | 3310 |
| 54790_1_12388 | - | chr4: 105160819-105160839 | CGAGGCGAAGUGAGGUCGGA | 3311 |
| 54790_1_12389 | - | chr4: 105160820-105160840 | GCGAGGCGAAGUGAGGUCGG | 3312 |
| 54790_1_12393 | - | chr4: 105160854-105160874 | UUGGGUCCUCCGCCUCCAAC | 3313 |
| 54790_1_12395 | - | chr4: 105160860-105160880 | ACGACCUUGGGUCCUCCGCC | 3314 |
| 54790_1_12396 | - | chr4: 105160863-105160883 | UUAACGACCUUGGGUCCUCC | 3315 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_12399 | - | chr4: 105160866-105160886 | CUCUUAACGACCUUGGGUCC | 3316 |
| 54790_1_12400 | - | chr4: 105160869-105160889 | CGUCUCUUAACGACCUUGGG | 3317 |
| 54790_1_12404 | - | chr4: 105160877-105160897 | UCGGACUCCGUCUCUUAACG | 3318 |
| 54790_1_12408 | - | chr4: 105160891-105160911 | GGGUCGAUGAGGCUUCGGAC | 3319 |
| 54790_1_12413 | - | chr4: 105160928-105160948 | GUUUUUAAUCGGCCCGCACC | 3320 |
| 54790_1_12414 | - | chr4: 105160931-105160951 | UAUGUUUUUAAUCGGCCCGC | 3321 |
| 54790_1_12415 | - | chr4: 105160936-105160956 | AUUUUUAUGUUUUUAAUCGG | 3322 |
| 54790_1_12416 | - | chr4: 105160937-105160957 | GAUUUUUAUGUUUUUAAUCG | 3323 |
| 54790_1_12419 | - | chr4: 105160976-105160996 | GUUUUGGUCGGACUGGUUCU | 3324 |
| 54790_1_12420 | - | chr4: 105161003-105161023 | CCGCUCACCUAGUGGUCCAG | 3325 |
| 54790_1_12423 | - | chr4: 105161008-105161028 | CGACUCCGCUCACCUAGUGG | 3326 |
| 54790_1_12426 | - | chr4: 105161017-105161037 | GAAACCCUCCGACUCCGCUC | 3327 |
| 54790_1_12429 | - | chr4: 105161024-105161044 | GGGUCGUGAAACCCUCCGAC | 3328 |
| 54790_1_12431 | - | chr4: 105161030-105161050 | ACAUUAGGGUCGUGAAACCC | 3329 |
| 54790_1_12433 | - | chr4: 105161033-105161053 | UGGACAUUAGGGUCGUGAAA | 3330 |
| 54790_1_12434 | - | chr4: 105161034-105161054 | GUGGACAUUAGGGUCGUGAA | 3331 |
| 54790_1_12449 | - | chr4: 105161122-105161142 | CUAUAUGUGAAUAAUAGAUU | 3332 |
| 54790_1_12455 | - | chr4: 105161160-105161180 | GAACAGCUUUAGAUGUUAAA | 3333 |
| 54790_1_12467 | - | chr4: 105161200-105161220 | AGUUAAAUAAGUCACUCUUU | 3334 |
| 54790_1_12480 | - | chr4: 105161277-105161297 | AAUAUCUUUUCAUAUCCAGA | 3335 |
| 54790_1_12505 | - | chr4: 105161462-105161482 | AGCUUUUACUAUUUAGGCCG | 3336 |
| 54790_1_12510 | - | chr4: 105161468-105161488 | CACCCAAGCUUUUACUAUUU | 3337 |
| 54790_1_12512 | - | chr4: 105161514-105161534 | GUAAUGGCUCUGCUCUGUGC | 3338 |
| 54790_1_12516 | - | chr4: 105161530-105161550 | AGCUCGAGAGUGUUCAGUAA | 3339 |
| 54790_1_12525 | - | chr4: 105161567-105161587 | UUAAUAUUCUAAUAUAAGAU | 3340 |
| 54790_1_12527 | - | chr4: 105161596-105161616 | AAACAAAGGUCCGAGAAAGA | 3341 |
| 54790_1_12529 | - | chr4: 105161597-105161617 | GAAACAAAGGUCCGAGAAAG | 3342 |
| 54790_1_12537 | - | chr4: 105161610-105161630 | UAUGAUUUACUGUGAAACAA | 3343 |
| 54790_1_12577 | - | chr4: 105161868-105161888 | AAAAUUUCCACAUUGCUCCU | 3344 |
| 54790_1_12589 | - | chr4: 105161974-105161994 | UUUAACCAUUUCUACCAAAG | 3345 |
| 54790_1_12611 | - | chr4: 105162061-105162081 | UGUGCACUUUCAACAUAUUA | 3346 |
| 54790_1_12612 | - | chr4: 105162062-105162082 | CUGUGCACUUUCAACAUAUU | 3347 |
| 54790_1_12617 | - | chr4: 105162088-105162108 | AGUUUAUACAAAAGACCCCA | 3348 |
| 54790_1_12623 | - | chr4: 105162125-105162145 | GUGCCUCAGCUGUCUUCUAC | 3349 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_12630 | − | chr4: 105162147-105162167 | GUUUGUUUUGUGUGUGUGUU | 3350 |
| 54790_1_12639 | − | chr4: 105162225-105162245 | GGAAGGCAUUAGGGUAACCU | 3351 |
| 54790_1_12640 | − | chr4: 105162226-105162246 | GGGAAGGCAUUAGGGUAACC | 3352 |
| 54790_1_12645 | − | chr4: 105162234-105162254 | GACCAUGUGGGAAGGCAUUA | 3353 |
| 54790_1_12646 | − | chr4: 105162235-105162255 | UGACCAUGUGGGAAGGCAUU | 3354 |
| 54790_1_12648 | − | chr4: 105162242-105162262 | AUGUGUUUGACCAUGUGGGA | 3355 |
| 54790_1_12650 | − | chr4: 105162246-105162266 | CUCCAUGUGUUUGACCAUGU | 3356 |
| 54790_1_12651 | − | chr4: 105162247-105162267 | GCUCCAUGUGUUUGACCAUG | 3357 |
| 54790_1_12657 | − | chr4: 105162290-105162310 | AACUGCAGGCUUCAGAAUUC | 3358 |
| 54790_1_12661 | − | chr4: 105162304-105162324 | UCCCACUGAUAAACAACUGC | 3359 |
| 54790_1_12669 | − | chr4: 105162371-105162391 | UGUAUCAGUAUUCAUGAUCC | 3360 |
| 54790_1_12674 | − | chr4: 105162411-105162431 | ACCAUGUUUCCCUGCAGUC | 3361 |
| 54790_1_12677 | − | chr4: 105162439-105162459 | GGCAGGGAAAAGCCUCCUUU | 3362 |
| 54790_1_12680 | − | chr4: 105162455-105162475 | AAAAUAAACAGUGUGGGCA | 3363 |
| 54790_1_12683 | − | chr4: 105162456-105162476 | UAAAAUAAACAGUGUGGGGC | 3364 |
| 54790_1_12685 | − | chr4: 105162460-105162480 | AGUUUAAAAUAAACAGUGUG | 3365 |
| 54790_1_12686 | − | chr4: 105162461-105162481 | UAGUUUAAAAUAAACAGUGU | 3366 |
| 54790_1_12687 | − | chr4: 105162462-105162482 | AUAGUUUAAAAUAAACAGUG | 3367 |
| 54790_1_12693 | − | chr4: 105162493-105162513 | CAAAGUGAAAAGCUCCUUUC | 3368 |
| 54790_1_12701 | − | chr4: 105162538-105162558 | AAGUGCCUACUUGCUUGUCA | 3369 |
| 54790_1_12702 | − | chr4: 105162539-105162559 | AAAGUGCCUACUUGCUUGUC | 3370 |
| 54790_1_12710 | − | chr4: 105162588-105162608 | AAAGAGAGUAACACUCCUCA | 3371 |
| 54790_1_12711 | − | chr4: 105162589-105162609 | GAAAGAGAGUAACACUCCUC | 3372 |
| 54790_1_12720 | − | chr4: 105162616-105162636 | UAAAAGAGUUUGAGUCAGCU | 3373 |
| 54790_1_12727 | − | chr4: 105162660-105162680 | UGCAGCAACAUUAUUAGAGA | 3374 |
| 54790_1_12732 | − | chr4: 105162685-105162705 | UGCUCCAACUGUUUCUAUGA | 3375 |
| 54790_1_12741 | − | chr4: 105162767-105162787 | AUUUCUAUAUGUAAUAGGAA | 3376 |
| 54790_1_12745 | − | chr4: 105162772-105162792 | GAAGUAUUUCUAUAUGUAAU | 3377 |
| 54790_1_12749 | − | chr4: 105162794-105162814 | UCUAUACAAACAGUGAUUUU | 3378 |
| 54790_1_12752 | − | chr4: 105162795-105162815 | UUCUAUACAAACAGUGAUUU | 3379 |
| 54790_1_12762 | − | chr4: 105162852-105162872 | CCCCGUAUUAUUGCAGAUAU | 3380 |
| 54790_1_12765 | − | chr4: 105162882-105162902 | AUUAAUCUAUCACACAAAAG | 3381 |
| 54790_1_12767 | − | chr4: 105162883-105162903 | CAUUAAUCUAUCACACAAAA | 3382 |
| 54790_1_12769 | − | chr4: 105162884-105162904 | UCAUUAAUCUAUCACACAAA | 3383 |
| 54790_1_12788 | − | chr4: 105162983-105163003 | UCCAUGCUAAGCACAGCUGC | 3384 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_12802 | - | chr4: 105163012-105163032 | CUUUUUUUCUCAUCCUUUU | 3385 |
| 54790_1_12822 | - | chr4: 105163124-105163144 | UCUGAUAAUUUGUUACAAGU | 3386 |
| 54790_1_12826 | - | chr4: 105163159-105163179 | AAAGAUGAAAGCUCAAAAA | 3387 |
| 54790_1_12831 | - | chr4: 105163184-105163204 | AGAAUUAAAUCUAUAAUUCA | 3388 |
| 54790_1_12832 | - | chr4: 105163185-105163205 | CAGAAUUAAAUCUAUAAUUC | 3389 |
| 54790_1_12842 | - | chr4: 105163296-105163316 | GAAAGUGGUGGCAAUCCAGG | 3390 |
| 54790_1_12843 | - | chr4: 105163299-105163319 | AGUGAAAGUGGUGGCAAUCC | 3391 |
| 54790_1_12845 | - | chr4: 105163308-105163328 | AAAUACUGGAGUGAAAGUGG | 3392 |
| 54790_1_12848 | - | chr4: 105163311-105163331 | UUGAAAUACUGGAGUGAAAG | 3393 |
| 54790_1_12854 | - | chr4: 105163322-105163342 | UGAAGUGUUUAUUGAAAUAC | 3394 |
| 54790_1_12869 | - | chr4: 105163419-105163439 | UAGACAUUUACGUUCCUUAC | 3395 |
| 54790_1_12872 | - | chr4: 105163420-105163440 | GUAGACAUUUACGUUCCUUA | 3396 |
| 54790_1_12874 | - | chr4: 105163421-105163441 | AGUAGACAUUUACGUUCCUU | 3397 |
| 54790_1_12877 | - | chr4: 105163426-105163446 | AAAAGAGUAGACAUUUACGU | 3398 |
| 54790_1_12887 | - | chr4: 105163477-105163497 | AAUCGAACAAUGCGAUAAAC | 3399 |
| 54790_1_12899 | - | chr4: 105163553-105163573 | AGAAACCUUUCACGAAUCGU | 3400 |
| 54790_1_12901 | - | chr4: 105163569-105163589 | GUAUUCUUAAUCUAUUAGAA | 3401 |
| 54790_1_12911 | - | chr4: 105163623-105163643 | CAAAGAAGGAAUCAUUUCAC | 3402 |
| 54790_1_12918 | - | chr4: 105163645-105163665 | UCAAUAAAUUGGGGUACAGA | 3403 |
| 54790_1_12923 | - | chr4: 105163669-105163689 | AAGAUAAUUCAAAAUUUAAU | 3404 |
| 54790_1_12925 | - | chr4: 105163670-105163690 | AAAGAUAAUUCAAAAUUUAA | 3405 |
| 54790_1_12929 | - | chr4: 105163703-105163723 | ACAAUGGAGAUUUGCAAAUA | 3406 |
| 54790_1_12931 | - | chr4: 105163704-105163724 | GACAAUGGAGAUUUGCAAAU | 3407 |
| 54790_1_12936 | - | chr4: 105163719-105163739 | GAUUACGAACAAAGAGACAA | 3408 |
| 54790_1_12949 | - | chr4: 105163772-105163792 | CCAAACACCAGACUGCUUGU | 3409 |
| 54790_1_12957 | - | chr4: 105163892-105163912 | GUUAAUAUGGAGUUGUUUCG | 3410 |
| 54790_1_12965 | - | chr4: 105163928-105163948 | GAAUUUACACAUGUCAAAAC | 3411 |
| 54790_1_12971 | - | chr4: 105164016-105164036 | UUUUUUACUGACUCUCCACU | 3412 |
| 54790_1_12973 | - | chr4: 105164022-105164042 | UUUGUGUUUUUACUGACUC | 3413 |
| 54790_1_12983 | - | chr4: 105164088-105164108 | ACUGAUGUCAAUCAUGACAU | 3414 |
| 54790_1_12985 | - | chr4: 105164111-105164131 | ACCUCUAGAUUACAUGUCGU | 3415 |
| 54790_1_12988 | - | chr4: 105164131-105164151 | CUACUUAUAAAUUAUGUAAG | 3416 |
| 54790_1_12997 | - | chr4: 105164176-105164196 | UCCCCUUUAUCCAAACAGUU | 3417 |
| 54790_1_12999 | - | chr4: 105164187-105164207 | CCGACCCAUCAUCCCCUUUA | 3418 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_13001 | - | chr4: 105164194-105164214 | ACGGUACCCGACCCAUCAUC | 3419 |
| 54790_1_13003 | - | chr4: 105164195-105164215 | AACGGUACCCGACCCAUCAU | 3420 |
| 54790_1_13005 | - | chr4: 105164196-105164216 | CAACGGUACCCGACCCAUCA | 3421 |
| 54790_1_13008 | - | chr4: 105164203-105164223 | GUACCACCAACGGUACCCGA | 3422 |
| 54790_1_13009 | - | chr4: 105164204-105164224 | UGUACCACCAACGGUACCCG | 3423 |
| 54790_1_13011 | - | chr4: 105164208-105164228 | UCAUUGUACCACCAACGGUA | 3424 |
| 54790_1_13012 | - | chr4: 105164209-105164229 | CUCAUUGUACCACCAACGGU | 3425 |
| 54790_1_13014 | - | chr4: 105164218-105164238 | UUUGCGUCUCUCAUUGUACC | 3426 |
| 54790_1_13015 | - | chr4: 105164221-105164241 | GUAUUUGCGUCUCUCAUUGU | 3427 |
| 54790_1_13024 | - | chr4: 105164263-105164283 | ACGUACUAGAGUGAAUAUAC | 3428 |
| 54790_1_13028 | - | chr4: 105164308-105164328 | UCGAUUAUUUUUCCUUUCAG | 3429 |
| 54790_1_13031 | - | chr4: 105164317-105164337 | CUGUAUGUGUCGAUUAUUUU | 3430 |
| 54790_1_13035 | - | chr4: 105164352-105164372 | UUCGUCUAAGUGUUUACGAU | 3431 |
| 54790_1_13046 | - | chr4: 105164380-105164400 | UAAUCAACAAGAGUAAAAUG | 3432 |
| 54790_1_13059 | - | chr4: 105164459-105164479 | UUAAAACGGUUCAUUGUACG | 3433 |
| 54790_1_13070 | - | chr4: 105164554-105164574 | UUCCAGAAGGGUAAAGAUGA | 3434 |
| 54790_1_13071 | - | chr4: 105164566-105164586 | UGAGCCUGUAUAUUCCAGAA | 3435 |
| 54790_1_13073 | - | chr4: 105164567-105164587 | AUGAGCCUGUAUAUUCCAGA | 3436 |
| 54790_1_13092 | - | chr4: 105164675-105164695 | CGUCUCCGACCUUCGUAGGA | 3437 |
| 54790_1_13094 | - | chr4: 105164676-105164696 | UCGUCUCCGACCUUCGUAGG | 3438 |
| 54790_1_13098 | - | chr4: 105164687-105164707 | GUGUGGAAAACUCGUCUCCG | 3439 |
| 54790_1_13101 | - | chr4: 105164691-105164711 | UUAAGUGUGGAAAACUCGUC | 3440 |
| 54790_1_13106 | - | chr4: 105164714-105164734 | ACCGCGGAUAAGUCCGUUGA | 3441 |
| 54790_1_13107 | - | chr4: 105164715-105164735 | GACCGCGGAUAAGUCCGUUG | 3442 |
| 54790_1_13110 | - | chr4: 105164722-105164742 | CGGUUGAGACCGCGGAUAAG | 3443 |
| 54790_1_13111 | - | chr4: 105164734-105164754 | ACUCUUUCGAUACGGUUGAG | 3444 |
| 54790_1_13116 | - | chr4: 105164766-105164786 | UGAACACGUUAGAGGGACAG | 3445 |
| 54790_1_13120 | - | chr4: 105164801-105164821 | GGGGAACUCGGUUAGAAGUC | 3446 |
| 54790_1_13126 | - | chr4: 105164844-105164864 | CUAACUUUGUUAUUUUCCCU | 3447 |
| 54790_1_13129 | - | chr4: 105164848-105164868 | AGAACUAACUUUGUUAUUUU | 3448 |
| 54790_1_13130 | - | chr4: 105164849-105164869 | UAGAACUAACUUUGUUAUUU | 3449 |
| 54790_1_13135 | - | chr4: 105164893-105164913 | UUUCCUACUAGUACUUUCCU | 3450 |
| 54790_1_13136 | - | chr4: 105164897-105164917 | GUUAUUUCCUACUAGUACUU | 3451 |
| 54790_1_13141 | - | chr4: 105164911-105164931 | CAUAGAUUAUUUCUGUUAUU | 3452 |
| 54790_1_13151 | - | chr4: 105164955-105164975 | CGAUAGUAAAUUAUAAAGAU | 3453 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_13159 | - | chr4: 105165024-105165044 | CUUUUAUACUAUGUUUUAUC | 3454 |
| 54790_1_13168 | - | chr4: 105165074-105165094 | GAUAGUAGAUAGAAAUUCGU | 3455 |
| 54790_1_13170 | - | chr4: 105165097-105165117 | GUCCAGACUCGGUGGUGUGG | 3456 |
| 54790_1_13172 | - | chr4: 105165116-105165136 | AGGGUUUCACGACCUUAAUG | 3457 |
| 54790_1_13174 | - | chr4: 105165125-105165145 | CGGAGCCGGAGGGUUUCACG | 3458 |
| 54790_1_13176 | - | chr4: 105165141-105165161 | GAGUCCACUAGACGGGCGGA | 3459 |
| 54790_1_13180 | - | chr4: 105165158-105165178 | CCAAAGUUUGAGGACUGGAG | 3460 |
| 54790_1_13184 | - | chr4: 105165179-105165199 | AAAGAGAUGCAACCGGUCCA | 3461 |
| 54790_1_13185 | - | chr4: 105165183-105165203 | CCCCAAAGAGAUGCAACCGG | 3462 |
| 54790_1_13187 | - | chr4: 105165188-105165208 | GUCUGCCCCAAAGAGAUGCA | 3463 |
| 54790_1_13196 | - | chr4: 105165202-105165222 | ACAUAAAAACCAUGUCUGC | 3464 |
| 54790_1_13197 | - | chr4: 105165203-105165223 | AACAUAAAAACCAUGUCUG | 3465 |
| 54790_1_13198 | - | chr4: 105165204-105165224 | AAACAUAAAAACCAUGUCU | 3466 |
| 54790_1_13201 | - | chr4: 105165213-105165233 | ACCGAUUAAAAACAUAAAAA | 3467 |
| 54790_1_13203 | - | chr4: 105165233-105165253 | GUCCGCGGGUGGUGGUGCGG | 3468 |
| 54790_1_13204 | - | chr4: 105165252-105165272 | AGGACUCACCGACCUUAAUG | 3469 |
| 54790_1_13205 | - | chr4: 105165261-105165281 | CGGAGUCAGAGGACUCACCG | 3470 |
| 54790_1_13209 | - | chr4: 105165265-105165285 | AGCACGGAGUCAGAGGACUC | 3471 |
| 54790_1_13212 | - | chr4: 105165300-105165320 | GUGACGUUGGAGACGGAGGA | 3472 |
| 54790_1_13213 | - | chr4: 105165301-105165321 | AGUGACGUUGGAGACGGAGG | 3473 |
| 54790_1_13215 | - | chr4: 105165336-105165356 | AGUGGGUCCGACCUCACGUU | 3474 |
| 54790_1_13217 | - | chr4: 105165346-105165366 | AGAGGGAGACAGUGGGUCCG | 3475 |
| 54790_1_13219 | - | chr4: 105165350-105165370 | CUUCAGAGGGAGACAGUGGG | 3476 |
| 54790_1_13236 | - | chr4: 105165377-105165397 | UAAAAAAUAAAAAUAAAAA | 3477 |
| 54790_1_13238 | - | chr4: 105165378-105165398 | AUAAAAAAUAAAAAUAAAAA | 3478 |
| 54790_1_13244 | - | chr4: 105165429-105165449 | AUUCCUUAAAGGUGAGAGUG | 3479 |
| 54790_1_13249 | - | chr4: 105165447-105165467 | AAAGUACUGUGACGGUACAU | 3480 |
| 54790_1_13254 | - | chr4: 105165477-105165497 | GAGUUUUGUAGAAAGUGUA | 3481 |
| 54790_1_13255 | - | chr4: 105165478-105165498 | UGAGUUUUGUAGAAAGUGU | 3482 |
| 54790_1_13281 | - | chr4: 105165615-105165635 | GCUUGCGUGAUAAUUGUUGU | 3483 |
| 54790_1_13283 | - | chr4: 105165616-105165636 | UGCUUGCGUGAUAAUUGUUG | 3484 |
| 54790_1_13288 | - | chr4: 105165652-105165672 | UCAUCAGUAAGUGUUAUUGA | 3485 |
| 54790_1_13289 | - | chr4: 105165653-105165673 | AUCAUCAGUAAGUGUUAUUG | 3486 |
| 54790_1_13293 | - | chr4: 105165681-105165701 | AGAGUAUCCCAACUUAUACA | 3487 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_13298 | - | chr4: 105165710-105165730 | CCCUAAAUGCAGACUUAGAA | 3488 |
| 54790_1_13310 | - | chr4: 105165777-105165797 | UACAUUUUGAAAAGUCACUG | 3489 |
| 54790_1_13323 | - | chr4: 105165848-105165868 | AUUGUGGGUAAGAAUAAUAA | 3490 |
| 54790_1_13330 | - | chr4: 105165863-105165883 | UUAAAGCAAUGCAUUAUUGU | 3491 |
| 54790_1_13331 | - | chr4: 105165864-105165884 | UUUAAAGCAAUGCAUUAUUG | 3492 |
| 54790_1_13333 | - | chr4: 105165908-105165928 | UCAUCUCUGAGUCUUUCCAU | 3493 |
| 54790_1_13335 | - | chr4: 105165913-105165933 | AUGUAUCAUCUCUGAGUCUU | 3494 |
| 54790_1_13344 | - | chr4: 105165963-105165983 | CCGUCCUUUUCUUUUCAUCG | 3495 |
| 54790_1_13349 | - | chr4: 105165980-105166000 | AUGUCCUCAACUGUCUUCCG | 3496 |
| 54790_1_13352 | - | chr4: 105165984-105166004 | CCUUAUGUCCUCAACUGUCU | 3497 |
| 54790_1_13355 | - | chr4: 105165997-105166017 | CUUCAUUACUAUACCUUAUG | 3498 |
| 54790_1_13361 | - | chr4: 105166005-105166025 | UCGUUAUUCUUCAUUACUAU | 3499 |
| 54790_1_13388 | - | chr4: 105166127-105166147 | UUAAAAUAAAUAAUGUUAGU | 3500 |
| 54790_1_13394 | - | chr4: 105166160-105166180 | UGUACAAGUUGGUAUGACGA | 3501 |
| 54790_1_13403 | - | chr4: 105166201-105166221 | UUCGAUUUAAAAUCACAGUG | 3502 |
| 54790_1_13415 | - | chr4: 105166265-105166285 | ACUGUUUCUUAAAUCGUUUU | 3503 |
| 54790_1_13418 | - | chr4: 105166266-105166286 | AACUGUUUCUUAAAUCGUUU | 3504 |
| 54790_1_13425 | - | chr4: 105166289-105166309 | AAAAAUGUGGCAUAAUUUUG | 3505 |
| 54790_1_13428 | - | chr4: 105166302-105166322 | AUGUGAAAGAAACAAAAAUG | 3506 |
| 54790_1_13436 | - | chr4: 105166340-105166360 | AAGAAAAAUUGAAUGCUUAC | 3507 |
| 54790_1_13454 | - | chr4: 105166450-105166470 | AGUGUAUUUCAUUCAUCAAA | 3508 |
| 54790_1_13468 | - | chr4: 105166528-105166548 | AAGCAAUAAUAGACAUAGCC | 3509 |
| 54790_1_13497 | - | chr4: 105166671-105166691 | UCCUUUUUAUAUUCCGUAAA | 3510 |
| 54790_1_13499 | - | chr4: 105166679-105166699 | CAUGAUAUUCCUUUUUAUAU | 3511 |
| 54790_1_13502 | - | chr4: 105166691-105166711 | AUUAAAUACUUACAUGAUAU | 3512 |
| 54790_1_13512 | - | chr4: 105166726-105166746 | UCUUUUAAUGAAACUUAAAU | 3513 |
| 54790_1_13519 | - | chr4: 105166781-105166801 | GUAUUCGUUAGGAUCUACUU | 3514 |
| 54790_1_13520 | - | chr4: 105166782-105166802 | AGUAUUCGUUAGGAUCUACU | 3515 |
| 54790_1_13524 | - | chr4: 105166820-105166840 | AUUUUUCUGUCUUAGUCUG | 3516 |
| 54790_1_13526 | - | chr4: 105166855-105166875 | AGGAUUAUUUGUAUACUUAU | 3517 |
| 54790_1_13529 | - | chr4: 105166856-105166876 | UAGGAUUAUUUGUAUACUUA | 3518 |
| 54790_1_13540 | - | chr4: 105166903-105166923 | AAAUUGUCUCGGUAUAGACC | 3519 |
| 54790_1_13543 | - | chr4: 105166906-105166926 | GUAAAUUGUCUCGGUAUAG | 3520 |
| 54790_1_13557 | - | chr4: 105166975-105166995 | UUCAUGGAAUUCGAUUUAUU | 3521 |
| 54790_1_13559 | - | chr4: 105167003-105167023 | UCUUUAUUAGUUUCCAUGUU | 3522 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_13562 | - | chr4: 105167011-105167031 | UUCUUCCUUCUUUAUUAGUU | 3523 |
| 54790_1_13564 | - | chr4: 105167027-105167047 | UUCUAUCCCACUUUUUUUCU | 3524 |
| 54790_1_13573 | - | chr4: 105167041-105167061 | UGUACUCAAAGUAUUUCUAU | 3525 |
| 54790_1_13574 | - | chr4: 105167042-105167062 | UUGUACUCAAAGUAUUUCUA | 3526 |
| 54790_1_13582 | - | chr4: 105167112-105167132 | UUGUCUACUUUUUAUACACU | 3527 |
| 54790_1_13597 | - | chr4: 105167194-105167214 | UCUUAUCUUUUACCUGAAGA | 3528 |
| 54790_1_13599 | - | chr4: 105167203-105167223 | UAGUUAGUCUCUUAUCUUUU | 3529 |
| 54790_1_13611 | - | chr4: 105167241-105167261 | UAUGAUUUGAGCCACGAUUA | 3530 |
| 54790_1_13635 | - | chr4: 105167319-105167339 | UAUUGUUUUUAGAUAUAGUU | 3531 |
| 54790_1_13657 | - | chr4: 105167551-105167571 | AGCACUGUUAUUUUUAAAAG | 3532 |
| 54790_1_13658 | - | chr4: 105167552-105167572 | UAGCACUGUUAUUUUUAAAA | 3533 |
| 54790_1_13660 | - | chr4: 105167553-105167573 | CUAGCACUGUUAUUUUUAAA | 3534 |
| 54790_1_13671 | - | chr4: 105167628-105167648 | UACUAAAGCAUUAUUAUUGA | 3535 |
| 54790_1_13672 | - | chr4: 105167629-105167649 | AUACUAAAGCAUUAUUAUUG | 3536 |
| 54790_1_13676 | - | chr4: 105167659-105167679 | CACAGUCACUGACUAUGCCU | 3537 |
| 54790_1_13677 | - | chr4: 105167660-105167680 | GCACAGUCACUGACUAUGCC | 3538 |
| 54790_1_13679 | - | chr4: 105167690-105167710 | CAGGAUGAACUGCUACUGCU | 3539 |
| 54790_1_13684 | - | chr4: 105167709-105167729 | GUUACACCUUAGAUCUGUAC | 3540 |
| 54790_1_13688 | - | chr4: 105167748-105167768 | GACAACCAAAGAAUCUCCAA | 3541 |
| 54790_1_13689 | - | chr4: 105167749-105167769 | AGACAACCAAAGAAUCUCCA | 3542 |
| 54790_1_13696 | - | chr4: 105167784-105167804 | CUGUUAUUGAACAGCAAGAU | 3543 |
| 54790_1_13712 | - | chr4: 105167845-105167865 | UUUAAAGACUGUUAAGCAGU | 3544 |
| 54790_1_13716 | - | chr4: 105167846-105167866 | UUUUAAAGACUGUUAAGCAG | 3545 |
| 54790_1_13722 | - | chr4: 105167881-105167901 | AGGCAAGAUUACGUCCUUAC | 3546 |
| 54790_1_13723 | - | chr4: 105167882-105167902 | UAGGCAAGAUUACGUCCUUA | 3547 |
| 54790_1_13730 | - | chr4: 105167901-105167921 | UUCCUUCAUUCCUUAAAGCU | 3548 |
| 54790_1_13740 | - | chr4: 105167960-105167980 | CUCAGUUGUCUUGUACAACC | 3549 |
| 54790_1_13743 | - | chr4: 105167963-105167983 | CAUCUCAGUUGUCUUGUACA | 3550 |
| 54790_1_13750 | - | chr4: 105167985-105168005 | UCUAGGACUUAUAUGAAAUG | 3551 |
| 54790_1_13755 | - | chr4: 105168020-105168040 | CCUCUACCUUUAACCACUUU | 3552 |
| 54790_1_13758 | - | chr4: 105168028-105168048 | CAAACUUACCUCUACCUUUA | 3553 |
| 54790_1_13760 | - | chr4: 105168035-105168055 | CUUCCACCAAACUUACCUCU | 3554 |
| 54790_1_13762 | - | chr4: 105168041-105168061 | UGUGUACUUCCACCAAACUU | 3555 |
| 54790_1_13769 | - | chr4: 105168050-105168070 | AAGUUUCAUUGUGUACUUCC | 3556 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_13770 | − | chr4: 105168053-105168073 | GAAAAGUUUCAUUGUGUACU | 3557 |
| 54790_1_13773 | − | chr4: 105168084-105168104 | UUUGUCCCUUUGGGUACUGU | 3558 |
| 54790_1_13774 | − | chr4: 105168085-105168105 | CUUUGUCCCUUUGGGUACUG | 3559 |
| 54790_1_13777 | − | chr4: 105168099-105168119 | CCCCUCGUUUCGAUCUUUGU | 3560 |
| 54790_1_13779 | − | chr4: 105168100-105168120 | CCCCCUCGUUUCGAUCUUUG | 3561 |
| 54790_1_13783 | − | chr4: 105168118-105168138 | GGGUGCCACUCCAUUCUUCC | 3562 |
| 54790_1_13786 | − | chr4: 105168119-105168139 | UGGGUGCCACUCCAUUCUUC | 3563 |
| 54790_1_13787 | − | chr4: 105168120-105168140 | UUGGGUGCCACUCCAUUCUU | 3564 |
| 54790_1_13789 | − | chr4: 105168121-105168141 | UUUGGGUGCCACUCCAUUCU | 3565 |
| 54790_1_13799 | − | chr4: 105168129-105168149 | AACCCAUUUUUGGGUGCCAC | 3566 |
| 54790_1_13802 | − | chr4: 105168134-105168154 | AAACAAACCCAUUUUUGGGU | 3567 |
| 54790_1_13804 | − | chr4: 105168147-105168167 | CUAGUGAACUUAAAAACAAA | 3568 |
| 54790_1_13807 | − | chr4: 105168148-105168168 | ACUAGUGAACUUAAAAACAA | 3569 |
| 54790_1_13817 | − | chr4: 105168194-105168214 | UUACCAAAAUUCGUCUCCUC | 3570 |
| 54790_1_13819 | − | chr4: 105168199-105168219 | GGUAAUUACCAAAAUUCGUC | 3571 |
| 54790_1_13823 | − | chr4: 105168212-105168232 | CACUUUGUCUCUGGGUAAUU | 3572 |
| 54790_1_13831 | − | chr4: 105168247-105168267 | CACCCAGUACUUUUCCCGAA | 3573 |
| 54790_1_13833 | − | chr4: 105168253-105168273 | CCUGACCACCCAGUACUUUU | 3574 |
| 54790_1_13834 | − | chr4: 105168254-105168274 | UCCUGACCACCCAGUACUUU | 3575 |
| 54790_1_13838 | − | chr4: 105168265-105168285 | GUUAAGUGAACUCCUGACCA | 3576 |
| 54790_1_13839 | − | chr4: 105168266-105168286 | GGUUAAGUGAACUCCUGACC | 3577 |
| 54790_1_13841 | − | chr4: 105168269-105168289 | GUCGGUUAAGUGAACUCCUG | 3578 |
| 54790_1_13842 | − | chr4: 105168274-105168294 | UUAUCGUCGGUUAAGUGAAC | 3579 |
| 54790_1_13847 | − | chr4: 105168310-105168330 | CCCUCUUAUCACCGUUCUUU | 3580 |
| 54790_1_13851 | − | chr4: 105168320-105168340 | UUAUCUUACUCCCUCUUAUC | 3581 |
| 54790_1_13853 | − | chr4: 105168330-105168350 | UCCUUUAAUCUUAUCUUACU | 3582 |
| 54790_1_13855 | − | chr4: 105168331-105168351 | UUCCUUUAAUCUUAUCUUAC | 3583 |
| 54790_1_13863 | − | chr4: 105168350-105168370 | GGUCCUGUCGUUCUUUUGGU | 3584 |
| 54790_1_13868 | − | chr4: 105168368-105168388 | UCCUACGAGAAGAACAACGG | 3585 |
| 54790_1_13870 | − | chr4: 105168388-105168408 | ACGUUCCGGACCUCCUUUU | 3586 |
| 54790_1_13872 | − | chr4: 105168395-105168415 | GUCGUUCACGUUUCCGGACC | 3587 |
| 54790_1_13875 | − | chr4: 105168398-105168418 | CUUGUCGUUCACGUUUCCGG | 3588 |
| 54790_1_13878 | − | chr4: 105168403-105168423 | UCUCCCUUGUCGUUCACGUU | 3589 |
| 54790_1_13880 | − | chr4: 105168420-105168440 | CCUUCCCACGAGGUCCUUCU | 3590 |
| 54790_1_13881 | − | chr4: 105168421-105168441 | UCCUUCCCACGAGGUCCUUC | 3591 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_13885 | - | chr4: 105168427-105168447 | GAGACUUCCUUCCCACGAGG | 3592 |
| 54790_1_13888 | - | chr4: 105168436-105168456 | GGACACCGAGAGACUUCCUU | 3593 |
| 54790_1_13889 | - | chr4: 105168437-105168457 | UGGACACCGAGAGACUUCCU | 3594 |
| 54790_1_13891 | - | chr4: 105168441-105168461 | GUUAUGGACACCGAGAGACU | 3595 |
| 54790_1_13895 | - | chr4: 105168452-105168472 | UUUCUAUCUUUGUUAUGGAC | 3596 |
| 54790_1_13898 | - | chr4: 105168475-105168495 | UGUGAGUUCCUCUCUAAUCU | 3597 |
| 54790_1_13906 | - | chr4: 105168488-105168508 | GAGACUUUUCAUUGUGAGU | 3598 |
| 54790_1_13913 | - | chr4: 105168518-105168538 | UCUGAAUCUAUCUUACCAAU | 3599 |
| 54790_1_13915 | - | chr4: 105168519-105168539 | UUCUGAAUCUAUCUUACCAA | 3600 |
| 54790_1_13918 | - | chr4: 105168524-105168544 | CAGAGUUCUGAAUCUAUCUU | 3601 |
| 54790_1_13921 | - | chr4: 105168555-105168575 | AAAAGAGAGAAAAUAAAGCA | 3602 |
| 54790_1_13930 | - | chr4: 105168602-105168622 | GGACAAGGGGUUAUUGGAUA | 3603 |
| 54790_1_13932 | - | chr4: 105168603-105168623 | UGGACAAGGGGUUAUUGGAU | 3604 |
| 54790_1_13937 | - | chr4: 105168681-105168701 | CACAUAUGACGAGCCCACUA | 3605 |
| 54790_1_13938 | - | chr4: 105168688-105168708 | CCCACUUCACAUAUGACGAG | 3606 |
| 54790_1_13939 | - | chr4: 105168689-105168709 | UCCCACUUCACAUAUGACGA | 3607 |
| 54790_1_13942 | - | chr4: 105168708-105168728 | CCUUAUUUUCUGAUGCUUAU | 3608 |
| 54790_1_13943 | - | chr4: 105168709-105168729 | UCCUUAUUUUCUGAUGCUUA | 3609 |
| 54790_1_13946 | - | chr4: 105168729-105168749 | UUUUCCCACCCUUCCCCAC | 3610 |
| 54790_1_13950 | - | chr4: 105168734-105168754 | UCCCCUUUUCCCACCCUUCC | 3611 |
| 54790_1_13951 | - | chr4: 105168735-105168755 | GUCCCCUUUUCCCACCCUUC | 3612 |
| 54790_1_13952 | - | chr4: 105168736-105168756 | AGUCCCCUUUUCCCACCCUU | 3613 |
| 54790_1_13955 | - | chr4: 105168737-105168757 | GAGUCCCCUUUUCCCACCCU | 3614 |
| 54790_1_13957 | - | chr4: 105168741-105168761 | CCCUGAGUCCCCUUUUCCCA | 3615 |
| 54790_1_13960 | - | chr4: 105168742-105168762 | UCCCUGAGUCCCCUUUUCCC | 3616 |
| 54790_1_13962 | - | chr4: 105168745-105168765 | AGAUCCCUGAGUCCCCUUUU | 3617 |
| 54790_1_13963 | - | chr4: 105168746-105168766 | GAGAUCCCUGAGUCCCCUUU | 3618 |
| 54790_1_13965 | - | chr4: 105168752-105168772 | UUACCUGAGAUCCCUGAGUC | 3619 |
| 54790_1_13968 | - | chr4: 105168753-105168773 | GUUACCUGAGAUCCCUGAGU | 3620 |
| 54790_1_13970 | - | chr4: 105168754-105168774 | UGUUACCUGAGAUCCCUGAG | 3621 |
| 54790_1_13972 | - | chr4: 105168761-105168781 | CUUACUGUGUUACCUGAGAU | 3622 |
| 54790_1_13974 | - | chr4: 105168762-105168782 | UCUUACUGUGUUACCUGAGA | 3623 |
| 54790_1_13976 | - | chr4: 105168770-105168790 | UUCCGUAUUCUUACUGUGUU | 3624 |
| 54790_1_13979 | - | chr4: 105168789-105168809 | CGAUGCGAUACUCCUACGUU | 3625 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_13980 | − | chr4: 105168798-105168818 | AUUCACCCUCGAUGCGAUAC | 3626 |
| 54790_1_13984 | − | chr4: 105168813-105168833 | UAUACAAGAGUGAGUAUUCA | 3627 |
| 54790_1_13987 | − | chr4: 105168814-105168834 | GUAUACAAGAGUGAGUAUUC | 3628 |
| 54790_1_13992 | − | chr4: 105168849-105168869 | AUUCACUUCAUUGAGUCCCU | 3629 |
| 54790_1_13994 | − | chr4: 105168853-105168873 | UAAGAUUCACUUCAUUGAGU | 3630 |
| 54790_1_13995 | − | chr4: 105168854-105168874 | AUAAGAUUCACUUCAUUGAG | 3631 |
| 54790_1_14001 | − | chr4: 105168884-105168904 | ACGUCACUGGACCUAUUCUG | 3632 |
| 54790_1_14005 | − | chr4: 105168894-105168914 | AUUACCGUAAACGUCACUGG | 3633 |
| 54790_1_14007 | − | chr4: 105168911-105168931 | GUAUUUUCCUUACUUAAUU | 3634 |
| 54790_1_14010 | − | chr4: 105168924-105168944 | UUAUGAUGAGUCGGUAUUUU | 3635 |
| 54790_1_14014 | − | chr4: 105168947-105168967 | UGACACCAUAUAAAUAUUCU | 3636 |
| 54790_1_14018 | − | chr4: 105168963-105168983 | CACUCAUCAAUUUCUUUGAC | 3637 |
| 54790_1_14021 | − | chr4: 105168985-105169005 | GUUGGGUUUACGAGCAGUUA | 3638 |
| 54790_1_14026 | − | chr4: 105169011-105169031 | UUAAACGUUAACGUUUUUAC | 3639 |
| 54790_1_14034 | − | chr4: 105169085-105169105 | UGAUGACCCAUAGAUGGGUC | 3640 |
| 54790_1_14039 | − | chr4: 105169099-105169119 | CUAGGUCGUUAGGGUGAUGA | 3641 |
| 54790_1_14040 | − | chr4: 105169100-105169120 | ACUAGGUCGUUAGGGUGAUG | 3642 |
| 54790_1_14044 | − | chr4: 105169158-105169178 | UCGGUGAUACCUUUUGUCAC | 3643 |
| 54790_1_14048 | − | chr4: 105169170-105169190 | CAUUUGAUCAUGUCGGUGAU | 3644 |
| 54790_1_14051 | − | chr4: 105169196-105169216 | UUGUGAAGAUGUGACGACCA | 3645 |
| 54790_1_14054 | − | chr4: 105169197-105169217 | CUUGUGAAGAUGUGACGACC | 3646 |
| 54790_1_14056 | − | chr4: 105169200-105169220 | UCUCUUGUGAAGAUGUGACG | 3647 |
| 54790_1_14062 | − | chr4: 105169228-105169248 | UCAUCUGCAACCGUACCUAU | 3648 |
| 54790_1_14063 | − | chr4: 105169234-105169254 | UUUUUAUCAUCUGCAACCGU | 3649 |
| 54790_1_14065 | − | chr4: 105169239-105169259 | UUAGUUUUUAUCAUCUGCA | 3650 |
| 54790_1_14068 | − | chr4: 105169270-105169290 | UAUGAAAUGAGGACGUUCUU | 3651 |
| 54790_1_14072 | − | chr4: 105169318-105169338 | AAGUUAUAGUGAUUACUAGU | 3652 |
| 54790_1_14075 | − | chr4: 105169319-105169339 | CAAGUUAUAGUGAUUACUAG | 3653 |
| 54790_1_14085 | − | chr4: 105169402-105169422 | AGGAUAGUUUUCACCCGAU | 3654 |
| 54790_1_14087 | − | chr4: 105169408-105169428 | UUUGUUAGGAUAGUUUUUCA | 3655 |
| 54790_1_14088 | − | chr4: 105169409-105169429 | GUUUGUUAGGAUAGUUUUUC | 3656 |
| 54790_1_14092 | − | chr4: 105169439-105169459 | CCUUGAGGUUGUUUAAUCGU | 3657 |
| 54790_1_14095 | − | chr4: 105169460-105169480 | UGAUUAUAGAUCUUAGAUGU | 3658 |
| 54790_1_14099 | − | chr4: 105169483-105169503 | UGUUAGAUACGUAGGCCGUU | 3659 |
| 54790_1_14101 | − | chr4: 105169489-105169509 | UAGAAGUGUUAGAUACGUAG | 3660 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_14104 | - | chr4: 105169517-105169537 | UUUGUCUGUUGGGUGUCUCA | 3661 |
| 54790_1_14105 | - | chr4: 105169518-105169538 | AUUUGUCUGUUGGGUGUCUC | 3662 |
| 54790_1_14109 | - | chr4: 105169555-105169575 | UUCUCGGAGACGUGUCGUUA | 3663 |
| 54790_1_14116 | - | chr4: 105169596-105169616 | GUUGUUUUGUUUCUAUUUA | 3664 |
| 54790_1_14123 | - | chr4: 105169654-105169674 | UGGGAAGAUCUGUAACCGAA | 3665 |
| 54790_1_14124 | - | chr4: 105169660-105169680 | UCUUUUGGGAAGAUCUGUA | 3666 |
| 54790_1_14132 | - | chr4: 105169737-105169757 | UAUAUUUUAGUUGAGUUCU | 3667 |
| 54790_1_14139 | - | chr4: 105169806-105169826 | UGUUUACCACGACCCUAUCG | 3668 |
| 54790_1_14140 | - | chr4: 105169814-105169834 | GGAUAAGUUGUUUACCACGA | 3669 |
| 54790_1_14142 | - | chr4: 105169815-105169835 | GGGAUAAGUUGUUUACCACG | 3670 |
| 54790_1_14144 | - | chr4: 105169821-105169841 | UCCUGUGGGAUAAGUUGUUU | 3671 |
| 54790_1_14146 | - | chr4: 105169841-105169861 | UUUGUAUUUAAUCAUCCAUU | 3672 |
| 54790_1_14148 | - | chr4: 105169847-105169867 | UUUGUUUUGUAUUUAAUCA | 3673 |
| 54790_1_14157 | - | chr4: 105169926-105169946 | AUCCAUGUCUCUGGUUACCC | 3674 |
| 54790_1_14158 | - | chr4: 105169927-105169947 | UAUCCAUGUCUCUGGUUACC | 3675 |
| 54790_1_14161 | - | chr4: 105169928-105169948 | UUAUCCAUGUCUCUGGUUAC | 3676 |
| 54790_1_14163 | - | chr4: 105169929-105169949 | UUUAUCCAUGUCUCUGGUUA | 3677 |
| 54790_1_14165 | - | chr4: 105169930-105169950 | UUUUAUCCAUGUCUCUGGUU | 3678 |
| 54790_1_14168 | - | chr4: 105169945-105169965 | GUACCAUGACCAUAUUUUA | 3679 |
| 54790_1_14169 | - | chr4: 105169957-105169977 | UGUGGUUUUGUCGUACCAUG | 3680 |
| 54790_1_14170 | - | chr4: 105169963-105169983 | GGUAUCUGUGGUUUUGUCGU | 3681 |
| 54790_1_14174 | - | chr4: 105169986-105170006 | AAUGGACUGAAAUAUGAUCU | 3682 |
| 54790_1_14179 | - | chr4: 105170019-105170039 | GAUUCGUGUUUCUUGUUUAA | 3683 |
| 54790_1_14180 | - | chr4: 105170020-105170040 | UGAUUCGUGUUUCUUGUUUA | 3684 |
| 54790_1_14195 | - | chr4: 105170100-105170120 | GGUAGUAAGAAGUGUCUUAA | 3685 |
| 54790_1_14203 | - | chr4: 105170156-105170176 | AAGCAGAAACACUUUGCCAA | 3686 |
| 54790_1_14204 | - | chr4: 105170157-105170177 | AAAGCAGAAACACUUUGCCA | 3687 |
| 54790_1_14212 | - | chr4: 105170209-105170229 | GAGUAUCUUGAGUGUAGAUG | 3688 |
| 54790_1_14220 | - | chr4: 105170275-105170295 | UGGUACACGAUCGGUGACAA | 3689 |
| 54790_1_14238 | - | chr4: 105170369-105170389 | GGAGUCGGAAGUCUCAUCGA | 3690 |
| 54790_1_14240 | - | chr4: 105170370-105170390 | CGGAGUCGGAAGUCUCAUCG | 3691 |
| 54790_1_14246 | - | chr4: 105170403-105170423 | UGGGGUUUGAAAACUCUGAG | 3692 |
| 54790_1_14249 | - | chr4: 105170446-105170466 | UGUUACGUCGUCGAUAAGUG | 3693 |
| 54790_1_14252 | - | chr4: 105170471-105170491 | CCCAAGAGUGACACAACUGG | 3694 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_14261 | - | chr4: 105170491-105170511 | UGCCAAAAAAAUUUCUCUA | 3695 |
| 54790_1_14263 | - | chr4: 105170492-105170512 | UUGCCAAAAAAAUUUCUCU | 3696 |
| 54790_1_14270 | - | chr4: 105170555-105170575 | CAGCAGAGAAAAGACAACAC | 3697 |
| 54790_1_14279 | - | chr4: 105170584-105170604 | UCUAUCUUCAAUUUCCAAUG | 3698 |
| 54790_1_14284 | - | chr4: 105170615-105170635 | UUUCACCUAUAAAUAAUCAA | 3699 |
| 54790_1_14288 | - | chr4: 105170652-105170672 | AUUGUCUCAGCUAUUCCUCA | 3700 |
| 54790_1_14293 | - | chr4: 105170678-105170698 | UCCUCGGCUCCAGAAGCUCC | 3701 |
| 54790_1_14300 | - | chr4: 105170694-105170714 | UUUAGUGACCAAUGUUUCCU | 3702 |
| 54790_1_14302 | - | chr4: 105170720-105170740 | AGUACAGUUGCCAAUAUAAA | 3703 |
| 54790_1_14306 | - | chr4: 105170748-105170768 | UGUAAUUGAAACACUAGCAU | 3704 |
| 54790_1_14317 | - | chr4: 105170799-105170819 | CACAUCAUGUUUAUAUUUUG | 3705 |
| 54790_1_14326 | - | chr4: 105170879-105170899 | GGCAGUGCUCAUCUUGCAGG | 3706 |
| 54790_1_14327 | - | chr4: 105170882-105170902 | ACAGGCAGUGCUCAUCUUGC | 3707 |
| 54790_1_14330 | - | chr4: 105170900-105170920 | GGAAGCAGAAGGAAGAACAC | 3708 |
| 54790_1_14334 | - | chr4: 105170911-105170931 | GCUGAAAUAAAGGAAGCAGA | 3709 |
| 54790_1_14339 | - | chr4: 105170921-105170941 | UAGACACACAGCUGAAAUAA | 3710 |
| 54790_1_14343 | - | chr4: 105170944-105170964 | GUGUAGAAGGAGGAGGAAGU | 3711 |
| 54790_1_14346 | - | chr4: 105170951-105170971 | UCUCCUAGUGUAGAAGGAGG | 3712 |
| 54790_1_14350 | - | chr4: 105170954-105170974 | AUUUCUCCUAGUGUAGAAGG | 3713 |
| 54790_1_14353 | - | chr4: 105170957-105170977 | GCAAUUUCUCCUAGUGUAGA | 3714 |
| 54790_1_14359 | - | chr4: 105170987-105171007 | AUAGCAGAUGUUAAAGAUAU | 3715 |
| 54790_1_14370 | - | chr4: 105171045-105171065 | UUAAAAAAAAGAAUGAAGA | 3716 |
| 54790_1_14385 | - | chr4: 105171110-105171130 | UUUGAGCCAGCAAUAACAGC | 3717 |
| 54790_1_14388 | - | chr4: 105171135-105171155 | AAAUAACACUGAAAUGCUCC | 3718 |
| 54790_1_14393 | - | chr4: 105171165-105171185 | GUCUUUACCUUGAGGGUAGU | 3719 |
| 54790_1_14398 | - | chr4: 105171179-105171199 | GUGAAACUUAUUUUGUCUUU | 3720 |
| 54790_1_14402 | - | chr4: 105171208-105171228 | GGUCCGUGACACGAUCUGUG | 3721 |
| 54790_1_14407 | - | chr4: 105171226-105171246 | AAUACCGAAUAUUACACGG | 3722 |
| 54790_1_14408 | - | chr4: 105171242-105171262 | UAGGUGAUCUAUUUGUAAUA | 3723 |
| 54790_1_14414 | - | chr4: 105171270-105171290 | UGAUAAUUCUUUAAUAGUAU | 3724 |
| 54790_1_14431 | - | chr4: 105171342-105171362 | UGCACUUCAUUUCCUUAGCA | 3725 |
| 54790_1_14441 | - | chr4: 105171385-105171405 | UUCAGAAAGUUCUCUAUACU | 3726 |
| 54790_1_14458 | - | chr4: 105171475-105171495 | AUGGCCUGUGUUAUCUUAUU | 3727 |
| 54790_1_14464 | - | chr4: 105171494-105171514 | AUUUUUUAAAGAACAAAGA | 3728 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_14483 | - | chr4: 105171572-105171592 | AUCUCAGUAAGUUACACUAC | 3729 |
| 54790_1_14490 | - | chr4: 105171607-105171627 | UAGCAUCAAUACAGAAUUUA | 3730 |
| 54790_1_14495 | - | chr4: 105171630-105171650 | GUAGCUCAAGAGUUGCAUCU | 3731 |
| 54790_1_14499 | - | chr4: 105171658-105171678 | GACCAGCAUCCUUUAUCAAG | 3732 |
| 54790_1_14502 | - | chr4: 105171680-105171700 | CAAACAUUACACUGGCAGCA | 3733 |
| 54790_1_14503 | - | chr4: 105171681-105171701 | GCAAACAUUACACUGGCAGC | 3734 |
| 54790_1_14506 | - | chr4: 105171688-105171708 | UAAAUGAGCAAACAUUACAC | 3735 |
| 54790_1_14514 | - | chr4: 105171733-105171753 | UUCACCUUCUUCACCAUCCC | 3736 |
| 54790_1_14524 | - | chr4: 105171785-105171805 | AGAGAAUAGUCUGUUUCUGU | 3737 |
| 54790_1_14529 | - | chr4: 105171813-105171833 | UGAAAAUGAAUAAUGCAAUC | 3738 |
| 54790_1_14534 | - | chr4: 105171840-105171860 | CUUCCAAAGCAGAUAAAGGC | 3739 |
| 54790_1_14535 | - | chr4: 105171844-105171864 | UAGGCUUCCAAAGCAGAUAA | 3740 |
| 54790_1_14538 | - | chr4: 105171863-105171883 | AUCUUGGAAGAUUAGGAAAU | 3741 |
| 54790_1_14540 | - | chr4: 105171870-105171890 | AUGAUAAAUCUUGGAAGAUU | 3742 |
| 54790_1_14543 | - | chr4: 105171879-105171899 | AUGAAGGUGAUGAUAAAUCU | 3743 |
| 54790_1_14545 | - | chr4: 105171895-105171915 | UGCAUGCUAUGGACAUAUGA | 3744 |
| 54790_1_14548 | - | chr4: 105171906-105171926 | UGUCUGAGAAAUGCAUGCUA | 3745 |
| 54790_1_14558 | - | chr4: 105171991-105172011 | CAGUACCACAUGAAAAACCA | 3746 |
| 54790_1_14567 | - | chr4: 105172023-105172043 | AAAUAUCUACUUCUUUGUCA | 3747 |
| 54790_1_14574 | - | chr4: 105172054-105172074 | CACAGAAUGAAUAGAACGGG | 3748 |
| 54790_1_14587 | - | chr4: 105172149-105172169 | CCCAGUUGACUAUUUAUUUA | 3749 |
| 54790_1_14590 | - | chr4: 105172169-105172189 | AAUUGGAGGUACAAUAAGUU | 3750 |
| 54790_1_14591 | - | chr4: 105172170-105172190 | GAAUUGGAGGUACAAUAAGU | 3751 |
| 54790_1_14598 | - | chr4: 105172197-105172217 | AAAAACUGUCACGUCCCCCA | 3752 |
| 54790_1_14599 | - | chr4: 105172201-105172221 | ACCUAAAAACUGUCACGUCC | 3753 |
| 54790_1_14601 | - | chr4: 105172202-105172222 | CACCUAAAAACUGUCACGUC | 3754 |
| 54790_1_14603 | - | chr4: 105172203-105172223 | ACACCUAAAAACUGUCACGU | 3755 |
| 54790_1_14604 | - | chr4: 105172204-105172224 | UACACCUAAAAACUGUCACG | 3756 |
| 54790_1_14611 | - | chr4: 105172221-105172241 | CCCCUCAGUUUUUAAUGUAC | 3757 |
| 54790_1_14616 | - | chr4: 105172240-105172260 | AUAAUCAUCAAUUCAAAAAC | 3758 |
| 54790_1_14617 | - | chr4: 105172241-105172261 | GAUAAUCAUCAAUUCAAAAA | 3759 |
| 54790_1_14619 | - | chr4: 105172242-105172262 | CGAUAAUCAUCAAUUCAAAA | 3760 |
| 54790_1_14622 | - | chr4: 105172264-105172284 | GUCCCGGAGGUCUGUUGUCG | 3761 |
| 54790_1_14624 | - | chr4: 105172282-105172302 | UUGACACACACAAUAGUCGU | 3762 |
| 54790_1_14626 | - | chr4: 105172283-105172303 | GUUGACACACACAAUAGUCG | 3763 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_14655 | - | chr4: 105172458-105172478 | UGAGUUCCACUUCUGUUGUU | 3764 |
| 54790_1_14662 | - | chr4: 105172473-105172493 | GGAGAAGAAGUCGUAUGAGU | 3765 |
| 54790_1_14669 | - | chr4: 105172524-105172544 | AGAAGGUGAAGACGGUGGGG | 3766 |
| 54790_1_14677 | - | chr4: 105172566-105172586 | UUUAUGUCCAAACUUGACGU | 3767 |
| 54790_1_14681 | - | chr4: 105172580-105172600 | UACCCAACUGGAAUUUUAUG | 3768 |
| 54790_1_14691 | - | chr4: 105172629-105172649 | UUCAUUGAAAAAAAUUAACA | 3769 |
| 54790_1_14697 | - | chr4: 105172664-105172684 | UAAACAUACAGGCAUUUGAA | 3770 |
| 54790_1_14702 | - | chr4: 105172675-105172695 | AAUGUUUCUCAUAAACAUAC | 3771 |
| 54790_1_14742 | - | chr4: 105172934-105172954 | GAGUAGCAGCAUAGCCAACU | 3772 |
| 54790_1_14760 | - | chr4: 105173018-105173038 | CUAAAGGGAUAUUUAAAAUU | 3773 |
| 54790_1_14768 | - | chr4: 105173033-105173053 | CAUAUUUUCUAUUCUCUAAA | 3774 |
| 54790_1_14769 | - | chr4: 105173034-105173054 | UCAUAUUUUCUAUUCUCUAA | 3775 |
| 54790_1_14780 | - | chr4: 105173077-105173097 | AGAAAAUUUAUAUUGUUGAG | 3776 |
| 54790_1_14796 | - | chr4: 105173127-105173147 | AAACUUUUUAUCCUUUGUGU | 3777 |
| 54790_1_14801 | - | chr4: 105173151-105173171 | UCCUCUUAGAAACUAAGGAU | 3778 |
| 54790_1_14802 | - | chr4: 105173156-105173176 | CAUUUUCCUCUUAGAAACUA | 3779 |
| 54790_1_14811 | - | chr4: 105173191-105173211 | GGUAACUGGCACACAGCAGA | 3780 |
| 54790_1_14816 | - | chr4: 105173205-105173225 | GAACUUAUCGUUUUGGUAAC | 3781 |
| 54790_1_14818 | - | chr4: 105173212-105173232 | UGAGUUGGAACUUAUCGUUU | 3782 |
| 54790_1_14819 | - | chr4: 105173227-105173247 | UGUGGGUUGGAAGAUUGAGU | 3783 |
| 54790_1_14824 | - | chr4: 105173261-105173281 | AGGGUUUCACGGCCCUAGUG | 3784 |
| 54790_1_14825 | - | chr4: 105173269-105173289 | GGAGCCGGAGGGUUUCACGG | 3785 |
| 54790_1_14826 | - | chr4: 105173270-105173290 | UGGAGCCGGAGGGUUUCACG | 3786 |
| 54790_1_14829 | - | chr4: 105173286-105173306 | UCGAGCACUAGACGGGUGGA | 3787 |
| 54790_1_14835 | - | chr4: 105173322-105173342 | AAAGUGGUAUAACCGGUCCG | 3788 |
| 54790_1_14836 | - | chr4: 105173326-105173346 | CCCAAAAGUGGUAUAACCGG | 3789 |
| 54790_1_14838 | - | chr4: 105173331-105173351 | CUCUGCCCAAAAGUGGUAUA | 3790 |
| 54790_1_14849 | - | chr4: 105173346-105173366 | AAACAUAAAAAUCAUCUCUG | 3791 |
| 54790_1_14852 | - | chr4: 105173347-105173367 | AAAACAUAAAAAUCAUCUCU | 3792 |
| 54790_1_14863 | - | chr4: 105173390-105173410 | GCCCUCGUGUGGUGGUACGG | 3793 |
| 54790_1_14864 | - | chr4: 105173391-105173411 | UGCCCUCGUGUGGUGGUACG | 3794 |
| 54790_1_14867 | - | chr4: 105173409-105173429 | AGGGUUCAUCGACCCUGAUG | 3795 |
| 54790_1_14869 | - | chr4: 105173410-105173430 | GAGGGUUCAUCGACCCUGAU | 3796 |
| 54790_1_14871 | - | chr4: 105173417-105173437 | GGAGUCGGAGGGUUCAUCGA | 3797 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_14872 | - | chr4: 105173418-105173438 | CGGAGUCGGAGGGUUCAUCG | 3798 |
| 54790_1_14878 | - | chr4: 105173457-105173477 | GUGACGUUGGAGGUGGAGGA | 3799 |
| 54790_1_14879 | - | chr4: 105173458-105173478 | AGUGACGUUGGAGGUGGAGG | 3800 |
| 54790_1_14881 | - | chr4: 105173482-105173502 | CCUCACGUCACCACGUUAGA | 3801 |
| 54790_1_14885 | - | chr4: 105173493-105173513 | AACGGGUCCGACCUCACGUC | 3802 |
| 54790_1_14886 | - | chr4: 105173503-105173523 | AGAGGGAGAAAACGGGUCCG | 3803 |
| 54790_1_14889 | - | chr4: 105173507-105173527 | UCUCAGAGGGAGAAAACGGG | 3804 |
| 54790_1_14943 | - | chr4: 105173722-105173742 | UAUUUGAAUAAAUGGGUUCC | 3805 |
| 54790_1_14944 | - | chr4: 105173729-105173749 | UAAUAAAUAUUUGAAUAAAU | 3806 |
| 54790_1_14945 | - | chr4: 105173730-105173750 | GUAAUAAAUAUUUGAAUAAA | 3807 |
| 54790_1_14966 | - | chr4: 105173800-105173820 | UUAUAUGUCACUUUGUUAAC | 3808 |
| 54790_1_14989 | - | chr4: 105173942-105173962 | UACAUCAUUUUUGCAUGCAU | 3809 |
| 54790_1_14990 | - | chr4: 105173943-105173963 | AUACAUCAUUUUUGCAUGCA | 3810 |
| 54790_1_15001 | - | chr4: 105174005-105174025 | UAUGUUGAUAGGGACAGCUA | 3811 |
| 54790_1_15006 | - | chr4: 105174015-105174035 | UGUUAAUAUAUAUGUUGAUA | 3812 |
| 54790_1_15009 | - | chr4: 105174016-105174036 | UUGUUAAUAUAUAUGUUGAU | 3813 |
| 54790_1_15018 | - | chr4: 105174081-105174101 | AUAGAACAAAUUGAGGCUUU | 3814 |
| 54790_1_15019 | - | chr4: 105174082-105174102 | UAUAGAACAAAUUGAGGCUU | 3815 |
| 54790_1_15021 | - | chr4: 105174088-105174108 | UAUAGCUAUAGAACAAAUUG | 3816 |
| 54790_1_15040 | - | chr4: 105174188-105174208 | GAUCUAUCAAAUUAAGGGAU | 3817 |
| 54790_1_15042 | - | chr4: 105174193-105174213 | UUUAAGAUCUAUCAAAUUAA | 3818 |
| 54790_1_15044 | - | chr4: 105174194-105174214 | UUUUAAGAUCUAUCAAAUUA | 3819 |
| 54790_1_15058 | - | chr4: 105174271-105174291 | CAUAGUCUACUUCUCAAAAA | 3820 |
| 54790_1_15059 | - | chr4: 105174272-105174292 | UCAUAGUCUACUUCUCAAAA | 3821 |
| 54790_1_15063 | - | chr4: 105174310-105174330 | UAAAUCUUAGGAAAUACUAG | 3822 |
| 54790_1_15067 | - | chr4: 105174322-105174342 | UUCUAUUCCAAAUAAAUCUU | 3823 |
| 54790_1_15119 | - | chr4: 105174498-105174518 | AAGAGAUUAUAAACUACGUC | 3824 |
| 54790_1_15133 | - | chr4: 105174565-105174585 | GGGUGUUUUUAAAAGGAACA | 3825 |
| 54790_1_15138 | - | chr4: 105174590-105174610 | GUACAAAAGGAUGGACCGUG | 3826 |
| 54790_1_15140 | - | chr4: 105174596-105174616 | UGUCAAGUACAAAAGGAUGG | 3827 |
| 54790_1_15154 | - | chr4: 105174680-105174700 | GAAGGCAUUCACUCAGGAGG | 3828 |
| 54790_1_15158 | - | chr4: 105174705-105174725 | CCAAUUUGAGUGUUUUCAUG | 3829 |
| 54790_1_15159 | - | chr4: 105174726-105174746 | CAGUGACACUUGUGAGGACC | 3830 |
| 54790_1_15160 | - | chr4: 105174729-105174749 | CAUCAGUGACACUUGUGAGG | 3831 |
| 54790_1_15174 | - | chr4: 105174763-105174783 | AAGGAAAAGAAGAGGGGAAU | 3832 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_15176 | − | chr4: 105174764-105174784 | CAAGGAAAAGAAGAGGGGAA | 3833 |
| 54790_1_15180 | − | chr4: 105174786-105174806 | ACGAGACUGUAUAAAGUUCU | 3834 |
| 54790_1_15186 | − | chr4: 105174825-105174845 | UUUAUCAAAGUGAACUCUCG | 3835 |
| 54790_1_15192 | − | chr4: 105174850-105174870 | UUAGGGUUUUCAAAUCCGAG | 3836 |
| 54790_1_15193 | − | chr4: 105174856-105174876 | AAUAUUUAGGGUUUUCAAA | 3837 |
| 54790_1_15201 | − | chr4: 105174887-105174907 | CAUAAAGGGAAGGGAAACCC | 3838 |
| 54790_1_15202 | − | chr4: 105174890-105174910 | AUCCAUAAAGGGAAGGGAAA | 3839 |
| 54790_1_15204 | − | chr4: 105174891-105174911 | AAUCCAUAAAGGGAAGGGAA | 3840 |
| 54790_1_15207 | − | chr4: 105174909-105174929 | CGAUUUCCCCCGACUUGAA | 3841 |
| 54790_1_15211 | − | chr4: 105174920-105174940 | GAUACACCUUUCGAUUUCC | 3842 |
| 54790_1_15212 | − | chr4: 105174921-105174941 | GGAUACACCUUUCGAUUUC | 3843 |
| 54790_1_15213 | − | chr4: 105174922-105174942 | GGGAUACACCUUUCGAUUUU | 3844 |
| 54790_1_15216 | − | chr4: 105174923-105174943 | AGGGAUACACCUUUCGAUUU | 3845 |
| 54790_1_15223 | − | chr4: 105174935-105174955 | AUAUAAAGGAAAGGGAUAC | 3846 |
| 54790_1_15230 | − | chr4: 105174977-105174997 | CGGGGGAUUGCACCUGUCCU | 3847 |
| 54790_1_15232 | − | chr4: 105174981-105175001 | GAUCCGGGGAUUGCACCUG | 3848 |
| 54790_1_15234 | − | chr4: 105174986-105175006 | AAGGGGAUCCGGGGAUUGC | 3849 |
| 54790_1_15240 | − | chr4: 105174999-105175019 | GGUCAAAAGAGUCAAGGGGA | 3850 |
| 54790_1_15244 | − | chr4: 105175035-105175055 | GAAACCACUUUGACAUGGGU | 3851 |
| 54790_1_15250 | − | chr4: 105175052-105175072 | AUAUUAAACCAGAGGGAGAA | 3852 |
| 54790_1_15252 | − | chr4: 105175065-105175085 | GUAAGACAUCGGAAUAUUAA | 3853 |
| 54790_1_15254 | − | chr4: 105175091-105175111 | UAUCAUUUUCCACACCCUUU | 3854 |
| 54790_1_15255 | − | chr4: 105175092-105175112 | CUAUCAUUUUCCACACCCUU | 3855 |
| 54790_1_15261 | − | chr4: 105175097-105175117 | UUAUACUAUCAUUUUCCACA | 3856 |
| 54790_1_15263 | − | chr4: 105175098-105175118 | AUUAUACUAUCAUUUUCCAC | 3857 |
| 54790_1_15266 | − | chr4: 105175103-105175123 | AAAUCAUUAUACUAUCAUUU | 3858 |
| 54790_1_15267 | − | chr4: 105175128-105175148 | AUUUCUUUGACGACGUUUA | 3859 |
| 54790_1_15280 | − | chr4: 105175177-105175197 | AUCGUACGGAAUAUUAAAAA | 3860 |
| 54790_1_15297 | − | chr4: 105175282-105175302 | UAUCAAAAAUAUUUCAAAG | 3861 |
| 54790_1_15321 | − | chr4: 105175389-105175409 | ACUAUGAACCGUAAAGAGAA | 3862 |
| 54790_1_15324 | − | chr4: 105175402-105175422 | ACAUGUGAUACGAACUAUGA | 3863 |
| 54790_1_15338 | − | chr4: 105175473-105175493 | UUGAAGUUUCUAAAAAGGA | 3864 |
| 54790_1_15390 | − | chr4: 105175681-105175701 | ACCACAGACUGUAAUUACC | 3865 |
| 54790_1_15392 | − | chr4: 105175682-105175702 | AACCACAGACUGUAAUUAAC | 3866 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_15394 | - | chr4: 105175683-105175703 | AAACCACAGACUGUAAUUAA | 3867 |
| 54790_1_15396 | - | chr4: 105175684-105175704 | CAAACCACAGACUGUAAUUA | 3868 |
| 54790_1_15401 | - | chr4: 105175701-105175721 | UCGAGAGACCUCUUCAUCAA | 3869 |
| 54790_1_15407 | - | chr4: 105175714-105175734 | AACCACAAGAAACUCGAGAG | 3870 |
| 54790_1_15415 | - | chr4: 105175733-105175753 | AAACCCUGUAAAUAGGACGA | 3871 |
| 54790_1_15416 | - | chr4: 105175750-105175770 | UAUACGGGUACUCAUCAAAA | 3872 |
| 54790_1_15418 | - | chr4: 105175751-105175771 | UUAUACGGGUACUCAUCAAA | 3873 |
| 54790_1_15445 | - | chr4: 105175821-105175841 | GAUAUCCACAAAAAGGAAG | 3874 |
| 54790_1_15454 | - | chr4: 105175837-105175857 | AUAAUAAAACGAGGAGAUA | 3875 |
| 54790_1_15460 | - | chr4: 105175877-105175897 | AGAAUAAACAUACCAAAUAC | 3876 |
| 54790_1_15463 | - | chr4: 105175886-105175906 | UGAGAUGAGAAUAAACAU | 3877 |
| 54790_1_15472 | - | chr4: 105175937-105175957 | CCAGGUCUUAGCAUGUGACG | 3878 |
| 54790_1_15479 | - | chr4: 105175958-105175978 | AAGACUUCCUGUUAAAACGU | 3879 |
| 54790_1_15484 | - | chr4: 105175972-105175992 | GAAAUAAAGAAUUGAAGACU | 3880 |
| 54790_1_15502 | - | chr4: 105176032-105176052 | AAAAACGUUCCCACCAGGUG | 3881 |
| 54790_1_15505 | - | chr4: 105176040-105176060 | AAUUUGUAAAAAACGUUCCC | 3882 |
| 54790_1_15506 | - | chr4: 105176043-105176063 | UGAAAUUUGUAAAAACGUU | 3883 |
| 54790_1_15507 | - | chr4: 105176044-105176064 | UUGAAAUUUGUAAAAACGU | 3884 |
| 54790_1_15524 | - | chr4: 105176108-105176128 | GAUUAAAUAAAAGGAAUAC | 3885 |
| 54790_1_15536 | - | chr4: 105176146-105176166 | CAUAAAAGAAAUAGUUCAAC | 3886 |
| 54790_1_15537 | - | chr4: 105176147-105176167 | ACAUAAAAGAAAUAGUUCAA | 3887 |
| 54790_1_15540 | - | chr4: 105176148-105176168 | CACAUAAAAGAAAUAGUUCA | 3888 |
| 54790_1_15545 | - | chr4: 105176177-105176197 | AAUUCAUACUACAUUUGACA | 3889 |
| 54790_1_15557 | - | chr4: 105176221-105176241 | CAGAACAAGAACUAGAAUCG | 3890 |
| 54790_1_15561 | - | chr4: 105176254-105176274 | CAUCCUUUGUUUCACCAUUC | 3891 |
| 54790_1_15565 | - | chr4: 105176261-105176281 | UGAAGGUCAUCCUUUGUUUC | 3892 |
| 54790_1_15568 | - | chr4: 105176272-105176292 | GUAAUCCAUCGUGAAGGUCA | 3893 |
| 54790_1_15579 | - | chr4: 105176288-105176308 | AAGGAAACAGAAUAACGUAA | 3894 |
| 54790_1_15589 | - | chr4: 105176334-105176354 | CUGUCAAACUAAAGAAGGAG | 3895 |
| 54790_1_15604 | - | chr4: 105176392-105176412 | AAAAGAAAAAGACUAGGAA | 3896 |
| 54790_1_15621 | - | chr4: 105176473-105176493 | GACCAUAUGUCCUUUCACUA | 3897 |
| 54790_1_15625 | - | chr4: 105176484-105176504 | GAACAAAUAACGACCAUAUG | 3898 |
| 54790_1_15629 | - | chr4: 105176492-105176512 | UUUAAUGUGAACAAAUAACG | 3899 |
| 54790_1_15638 | - | chr4: 105176532-105176552 | AGAACCCCACGAUUACAUUU | 3900 |
| 54790_1_15642 | - | chr4: 105176547-105176567 | GUUUUCAUAAAGUAAAGAAC | 3901 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_15643 | - | chr4: 105176548-105176568 | UGUUUUCAUAAAGUAAAGAA | 3902 |
| 54790_1_15645 | - | chr4: 105176549-105176569 | AUGUUUUCAUAAAGUAAAGA | 3903 |
| 54790_1_15666 | - | chr4: 105176635-105176655 | GAGAAGUAAUAAAUCAAGUG | 3904 |
| 54790_1_15673 | - | chr4: 105176692-105176712 | GACUUAGAUAUCUAGUUCAA | 3905 |
| 54790_1_15676 | - | chr4: 105176693-105176713 | UGACUUAGAUAUCUAGUUCA | 3906 |
| 54790_1_15684 | - | chr4: 105176722-105176742 | AUAGCACGACACAAAAAAUU | 3907 |
| 54790_1_15700 | - | chr4: 105176806-105176826 | CAAGAGGAGUUUAUGACUCA | 3908 |
| 54790_1_15707 | - | chr4: 105176853-105176873 | AAUAUCAUUCGAAAUUUCGG | 3909 |
| 54790_1_15724 | - | chr4: 105176926-105176946 | CCGAGAAAUAAGAUAAGGUA | 3910 |
| 54790_1_15731 | - | chr4: 105176947-105176967 | UAUAAAUGUACCCAAACAAA | 3911 |
| 54790_1_15733 | - | chr4: 105176948-105176968 | AUAUAAAUGUACCCAAACAA | 3912 |
| 54790_1_15735 | - | chr4: 105176957-105176977 | AGUAAACUAAUAUAAAUGUA | 3913 |
| 54790_1_15736 | - | chr4: 105176958-105176978 | UAGUAAACUAAUAUAAAUGU | 3914 |
| 54790_1_15767 | - | chr4: 105177087-105177107 | UAGACACAAAUGUGAGUUAA | 3915 |
| 54790_1_15775 | - | chr4: 105177116-105177136 | AAGUUCAAUUAAAAACGUUU | 3916 |
| 54790_1_15776 | - | chr4: 105177117-105177137 | UAAGUUCAAUUAAAAACGUU | 3917 |
| 54790_1_15787 | - | chr4: 105177146-105177166 | AUCAAGACGUAAAAUGUAAA | 3918 |
| 54790_1_15794 | - | chr4: 105177176-105177196 | AAAAAGGACACAAUAGAAGA | 3919 |
| 54790_1_15797 | - | chr4: 105177177-105177197 | UAAAAAGGACACAAUAGAAG | 3920 |
| 54790_1_15799 | - | chr4: 105177200-105177220 | GACGGUAUGGUUUCAGUAGA | 3921 |
| 54790_1_15806 | - | chr4: 105177244-105177264 | AGGAAGUACAUAGCACGGAA | 3922 |
| 54790_1_15834 | - | chr4: 105177347-105177367 | CGUUUAUUAAAAAGGUAGAC | 3923 |
| 54790_1_15871 | - | chr4: 105177473-105177493 | GAAACCACUCAACAGACAAG | 3924 |
| 54790_1_15877 | - | chr4: 105177490-105177510 | ACUGUGAACACAUAGAAGAA | 3925 |
| 54790_1_15893 | - | chr4: 105177583-105177603 | GGUAAGAUUGUCCAUACAUC | 3926 |
| 54790_1_15895 | - | chr4: 105177593-105177613 | GACUGAAGUCGGUAAGAUUG | 3927 |
| 54790_1_15901 | - | chr4: 105177629-105177649 | AGGUGUAAGAGUGGUCGUGA | 3928 |
| 54790_1_15906 | - | chr4: 105177662-105177682 | AAGAAUGGUCGUUACUUACU | 3929 |
| 54790_1_15921 | - | chr4: 105177749-105177769 | CGCGAUAACGACUUAGUAUA | 3930 |
| 54790_1_15923 | - | chr4: 105177750-105177770 | UCGCGAUAACGACUUAGUAU | 3931 |
| 54790_1_15930 | - | chr4: 105177773-105177793 | UUCAAAGUUCAGGUAUGGU | 3932 |
| 54790_1_15933 | - | chr4: 105177800-105177820 | CACUCGAUGACACGGGCCGG | 3933 |
| 54790_1_15936 | - | chr4: 105177805-105177825 | GUCCGCACUCGAUGACACGG | 3934 |
| 54790_1_15938 | - | chr4: 105177824-105177844 | AGGGUUUCACGACGUUAAUG | 3935 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_15939 | - | chr4: 105177849-105177869 | GAGUUUACUAGGUGGACGGA | 3936 |
| 54790_1_15940 | - | chr4: 105177850-105177870 | GGAGUUUACUAGGUGGACGG | 3937 |
| 54790_1_15948 | - | chr4: 105177887-105177907 | UGGUACCCUAAAGUGGUCCG | 3938 |
| 54790_1_15949 | - | chr4: 105177891-105177911 | AAAGUGGUACCCUAAAGUGG | 3939 |
| 54790_1_15952 | - | chr4: 105177902-105177922 | AUCUCGACCCCAAAGUGGUA | 3940 |
| 54790_1_15954 | - | chr4: 105177903-105177923 | CAUCUCGACCCCAAAGUGGU | 3941 |
| 54790_1_15961 | - | chr4: 105177914-105177934 | AACAUAGAAAUCAUCUCGAC | 3942 |
| 54790_1_15962 | - | chr4: 105177915-105177935 | AAACAUAGAAAUCAUCUCGA | 3943 |
| 54790_1_15964 | - | chr4: 105177916-105177936 | AAAACAUAGAAAUCAUCUCG | 3944 |
| 54790_1_15968 | - | chr4: 105177964-105177984 | AGGGAUCAUCGACUCUAAUG | 3945 |
| 54790_1_15971 | - | chr4: 105178012-105178032 | GUGACGUUGGAGGCGGAGGA | 3946 |
| 54790_1_15972 | - | chr4: 105178013-105178033 | AGUGACGUUGGAGGCGGAGG | 3947 |
| 54790_1_15974 | - | chr4: 105178048-105178068 | AGUGAGUCCGACCUCACGUU | 3948 |
| 54790_1_15979 | - | chr4: 105178058-105178078 | AAAACGAGACAGUGAGUCCG | 3949 |
| 54790_1_15981 | - | chr4: 105178062-105178082 | CCUCAAAACGAGACAGUGAG | 3950 |
| 54790_1_15998 | - | chr4: 105178083-105178103 | AAAACGAAAAAAAAAACUCU | 3951 |
| 54790_1_16016 | - | chr4: 105178133-105178153 | UUACACACGUCCAAAAAUAC | 3952 |
| 54790_1_16018 | - | chr4: 105178144-105178164 | UCGACAAUUUGUUACACACG | 3953 |
| 54790_1_16025 | - | chr4: 105178178-105178198 | AGAACUAACGUGGGUUCAAA | 3954 |
| 54790_1_16029 | - | chr4: 105178204-105178224 | AAAUAGGUGAGUUUAUAAUU | 3955 |
| 54790_1_16033 | - | chr4: 105178238-105178258 | GACUUAUUAUAAGAAUGUAG | 3956 |
| 54790_1_16057 | - | chr4: 105178339-105178359 | GUAUGUCAUAAAUCGGAAAA | 3957 |
| 54790_1_16063 | - | chr4: 105178365-105178385 | AAAGGCCUUACAGUAUAUCA | 3958 |
| 54790_1_16070 | - | chr4: 105178381-105178401 | GAGGUAUUAAAACCGAAAAG | 3959 |
| 54790_1_16076 | - | chr4: 105178390-105178410 | AAAAUGACAGAGGUAUUAAA | 3960 |
| 54790_1_16081 | - | chr4: 105178426-105178446 | ACGGAUAUGUAAGGAGGGAG | 3961 |
| 54790_1_16089 | - | chr4: 105178497-105178517 | ACCUGUUUACAUAUUACUGU | 3962 |
| 54790_1_16093 | - | chr4: 105178517-105178537 | CACCAAUGUAGGAUGCACAA | 3963 |
| 54790_1_16099 | - | chr4: 105178536-105178556 | UGUAAUCCCAAGUGAUAACC | 3964 |
| 54790_1_16100 | - | chr4: 105178539-105178559 | AAAUGUAAUCCCAAGUGAUA | 3965 |
| 54790_1_16101 | - | chr4: 105178550-105178570 | UUUGGGGUAUCAAAUGUAAU | 3966 |
| 54790_1_16102 | - | chr4: 105178551-105178571 | GUUUGGGGUAUCAAAUGUAA | 3967 |
| 54790_1_16112 | - | chr4: 105178620-105178640 | UAGUUGUAGGGUAUGGUCUC | 3968 |
| 54790_1_16136 | - | chr4: 105178759-105178779 | AAUAAUAUGAAAUUCAAAAU | 3969 |
| 54790_1_16138 | - | chr4: 105178760-105178780 | UAAUAAUAUGAAAUUCAAAA | 3970 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_16171 | - | chr4: 105178880-105178900 | AAAUAUUAAUGAGUCAGAG | 3971 |
| 54790_1_16192 | - | chr4: 105179022-105179042 | GACUACCAAAAUAUUCACAA | 3972 |
| 54790_1_16194 | - | chr4: 105179038-105179058 | ACUCAAGAGUACUCUAGACU | 3973 |
| 54790_1_16200 | - | chr4: 105179063-105179083 | GGGUACGACAAGAGUAGUAU | 3974 |
| 54790_1_16202 | - | chr4: 105179064-105179084 | GGGGUACGACAAGAGUAGUA | 3975 |
| 54790_1_16205 | - | chr4: 105179094-105179114 | ACCUUCAUUAACCUAGUACC | 3976 |
| 54790_1_16206 | - | chr4: 105179095-105179115 | CACCUUCAUUAACCUAGUAC | 3977 |
| 54790_1_16208 | - | chr4: 105179096-105179116 | CCACCUUCAUUAACCUAGUA | 3978 |
| 54790_1_16210 | - | chr4: 105179097-105179117 | UCCACCUUCAUUAACCUAGU | 3979 |
| 54790_1_16212 | - | chr4: 105179104-105179124 | UCUCUGGUCCACCUUCAUUA | 3980 |
| 54790_1_16214 | - | chr4: 105179114-105179134 | CACAGUUCCGUCUCUGGUCC | 3981 |
| 54790_1_16217 | - | chr4: 105179117-105179137 | GUACACAGUUCCGUCUCUGG | 3982 |
| 54790_1_16219 | - | chr4: 105179128-105179148 | AGGUAUUAUGGGUACACAGU | 3983 |
| 54790_1_16229 | - | chr4: 105179199-105179219 | GUUUUAUCACACUAUACCAA | 3984 |
| 54790_1_16230 | - | chr4: 105179204-105179224 | ACAUAGUUUUAUCACACUAU | 3985 |
| 54790_1_16238 | - | chr4: 105179277-105179297 | AACCAGAAAUUGGAAAAUGG | 3986 |
| 54790_1_16241 | - | chr4: 105179280-105179300 | CCUAACCAGAAAUUGGAAAA | 3987 |
| 54790_1_16246 | - | chr4: 105179287-105179307 | UAUUUUCCUAACCAGAAAU | 3988 |
| 54790_1_16252 | - | chr4: 105179319-105179339 | AGGUUGUGGGUCAAUUAAGG | 3989 |
| 54790_1_16254 | - | chr4: 105179322-105179342 | ACAAGGUUGUGGGUCAAUUA | 3990 |
| 54790_1_16260 | - | chr4: 105179332-105179352 | UUCAUUGCAAACAAGGUUGU | 3991 |
| 54790_1_16262 | - | chr4: 105179333-105179353 | CUUCAUUGCAAACAAGGUUG | 3992 |
| 54790_1_16265 | - | chr4: 105179339-105179359 | UUGAUUCUUCAUUGCAAACA | 3993 |
| 54790_1_16274 | - | chr4: 105179407-105179427 | AUUAUGCCCAUGGACACUCA | 3994 |
| 54790_1_16276 | - | chr4: 105179417-105179437 | AGGCAACUGAAUUAUGCCCA | 3995 |
| 54790_1_16282 | - | chr4: 105179437-105179457 | GUAUCAUGGCAUUGAAUGA | 3996 |
| 54790_1_16288 | - | chr4: 105179450-105179470 | UGUAGGCUUUGCAGUAUCAU | 3997 |
| 54790_1_16290 | - | chr4: 105179467-105179487 | GGUACAUGAAUUUGCCUUGU | 3998 |
| 54790_1_16292 | - | chr4: 105179488-105179508 | AAAGGAUGGAGUCUGUCUGU | 3999 |
| 54790_1_16296 | - | chr4: 105179502-105179522 | GAAUAGUUUGAGAAAAGGA | 4000 |
| 54790_1_16302 | - | chr4: 105179506-105179526 | UCUUGAAUAGUUUGAGAAAA | 4001 |
| 54790_1_16320 | - | chr4: 105179568-105179588 | UUUCAUUUUUGAGGAUAGA | 4002 |
| 54790_1_16321 | - | chr4: 105179576-105179596 | AGGAUAUUUUCAUUUUUUG | 4003 |
| 54790_1_16326 | - | chr4: 105179596-105179616 | CACUCAUUUCCCAAAUGAAG | 4004 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_16335 | - | chr4: 105179673-105179693 | AUUAUCAGAAAGCAGGUCAG | 4005 |
| 54790_1_16337 | - | chr4: 105179680-105179700 | GUCAUGCAUUAUCAGAAAGC | 4006 |
| 54790_1_16345 | - | chr4: 105179726-105179746 | AUACGGUCCAGUCCCAUGUG | 4007 |
| 54790_1_16346 | - | chr4: 105179734-105179754 | AUCACCAAAUACGGUCCAGU | 4008 |
| 54790_1_16347 | - | chr4: 105179735-105179755 | GAUCACCAAAUACGGUCCAG | 4009 |
| 54790_1_16350 | - | chr4: 105179740-105179760 | UAUGAGAUCACCAAAUACGG | 4010 |
| 54790_1_16351 | - | chr4: 105179751-105179771 | CUUUACUGAAUUAUGAGAUC | 4011 |
| 54790_1_16355 | - | chr4: 105179804-105179824 | UGACAUCUAUCAGAAGGUCA | 4012 |
| 54790_1_16357 | - | chr4: 105179805-105179825 | GUGACAUCUAUCAGAAGGUC | 4013 |
| 54790_1_16361 | - | chr4: 105179832-105179852 | UAGGAAUGCAGCUGCUUUAG | 4014 |
| 54790_1_16366 | - | chr4: 105179851-105179871 | AAACUUAAUCAUGCCUCACU | 4015 |
| 54790_1_16368 | - | chr4: 105179876-105179896 | AUACUCCAGAACCUAAUAGU | 4016 |
| 54790_1_16370 | - | chr4: 105179877-105179897 | AAUACUCCAGAACCUAAUAG | 4017 |
| 54790_1_16377 | - | chr4: 105179910-105179930 | GCUAGAAAAACUUUCCUCUU | 4018 |
| 54790_1_16378 | - | chr4: 105179911-105179931 | UGCUAGAAAAACUUUCCUCU | 4019 |
| 54790_1_16388 | - | chr4: 105179981-105180001 | ACAAAUGAACAACCCUUAGU | 4020 |
| 54790_1_16390 | - | chr4: 105180010-105180030 | GAAAAAAAACAGUGAAAGAA | 4021 |
| 54790_1_16393 | - | chr4: 105180011-105180031 | AGAAAAAAAACAGUGAAAGA | 4022 |
| 54790_1_16399 | - | chr4: 105180054-105180074 | CAACAGCCAGCUGACCAGAA | 4023 |
| 54790_1_16403 | - | chr4: 105180078-105180098 | GAAAGUGUCAUUUCUAUGAU | 4024 |
| 54790_1_16411 | - | chr4: 105180130-105180150 | AUGAGAAACAAAGUGAAGGC | 4025 |
| 54790_1_16415 | - | chr4: 105180134-105180154 | UUGGAUGAGAAACAAAGUGA | 4026 |
| 54790_1_16423 | - | chr4: 105180153-105180173 | GAAAGUUUGUCAUUGAUUU | 4027 |
| 54790_1_16431 | - | chr4: 105180194-105180214 | CCAAGUUGACUCAGGUUCAU | 4028 |
| 54790_1_16433 | - | chr4: 105180202-105180222 | CCUUUAUGCCAAGUUGACUC | 4029 |
| 54790_1_16446 | - | chr4: 105180273-105180293 | UCACUGAGCAAAGUGGAGUU | 4030 |
| 54790_1_16450 | - | chr4: 105180280-105180300 | AAUGUUAUCACUGAGCAAAG | 4031 |
| 54790_1_16460 | - | chr4: 105180324-105180344 | UGAGGAAGUAUUUUUAGACU | 4032 |
| 54790_1_16467 | - | chr4: 105180342-105180362 | GACUGAGAUUUUGGAAUAUG | 4033 |
| 54790_1_16471 | - | chr4: 105180351-105180371 | UGUAUUAAUGACUGAGAUUU | 4034 |
| 54790_1_16479 | - | chr4: 105180400-105180420 | CUACAACAGCCGAGAAGCAC | 4035 |
| 54790_1_16497 | - | chr4: 105180493-105180513 | AUAAACAUAAUUUUGCUUCC | 4036 |
| 54790_1_16511 | - | chr4: 105180562-105180582 | AGAAUAUUUACGUUUUAGAA | 4037 |
| 54790_1_16516 | - | chr4: 105180585-105180605 | GUUUGUGACCAUGGAGAUCA | 4038 |
| 54790_1_16520 | - | chr4: 105180594-105180614 | UGAAAUACUGUUUGUGACCA | 4039 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_16526 | - | chr4: 105180634-105180654 | UUUUUUUUUUUUUGAUAAAA | 4040 |
| 54790_1_16531 | - | chr4: 105180682-105180702 | CACGAAGACGUAGGGUCGGA | 4041 |
| 54790_1_16532 | - | chr4: 105180683-105180703 | GCACGAAGACGUAGGGUCGG | 4042 |
| 54790_1_16535 | - | chr4: 105180712-105180732 | UCCUCCACCUCCAACGUCAC | 4043 |
| 54790_1_16538 | - | chr4: 105180723-105180743 | GCGAACUUGAGUCCUCCACC | 4044 |
| 54790_1_16539 | - | chr4: 105180726-105180746 | UUAGCGAACUUGAGUCCUCC | 4045 |
| 54790_1_16542 | - | chr4: 105180729-105180749 | CUCUUAGCGAACUUGAGUCC | 4046 |
| 54790_1_16544 | - | chr4: 105180732-105180752 | GUCCUCUUAGCGAACUUGAG | 4047 |
| 54790_1_16549 | - | chr4: 105180751-105180771 | CGAUGGGCCGUCCGACUCCG | 4048 |
| 54790_1_16552 | - | chr4: 105180755-105180775 | AGAUCGAUGGGCCGUCCGAC | 4049 |
| 54790_1_16554 | - | chr4: 105180761-105180781 | ACAUUAAGAUCGAUGGGCCG | 4050 |
| 54790_1_16555 | - | chr4: 105180765-105180785 | ACGGACAUUAAGAUCGAUGG | 4051 |
| 54790_1_16557 | - | chr4: 105180792-105180812 | UGUCUUAAUCGGUCCACACC | 4052 |
| 54790_1_16558 | - | chr4: 105180795-105180815 | UUAUGUCUUAAUCGGUCCAC | 4053 |
| 54790_1_16559 | - | chr4: 105180800-105180820 | GAUUUUAUGUCUUAAUCGG | 4054 |
| 54790_1_16563 | - | chr4: 105180848-105180868 | AGUCCUCAAGUUCUGGUCAG | 4055 |
| 54790_1_16565 | - | chr4: 105180866-105180886 | ACCCACCUAGUGGACUCCAG | 4056 |
| 54790_1_16567 | - | chr4: 105180871-105180891 | ACGCCACCCACCUAGUGGAC | 4057 |
| 54790_1_16571 | - | chr4: 105180882-105180902 | GAAACCCUCCGACGCCACCC | 4058 |
| 54790_1_16574 | - | chr4: 105180885-105180905 | CGUGAAACCCUCCGACGCCA | 4059 |
| 54790_1_16575 | - | chr4: 105180886-105180906 | UCGUGAAACCCUCCGACGCC | 4060 |
| 54790_1_16577 | - | chr4: 105180889-105180909 | AGGUCGUGAAACCCUCCGAC | 4061 |
| 54790_1_16578 | - | chr4: 105180895-105180915 | ACAUUAAGGUCGUGAAACCC | 4062 |
| 54790_1_16580 | - | chr4: 105180898-105180918 | CGGACAUUAAGGUCGUGAAA | 4063 |
| 54790_1_16581 | - | chr4: 105180899-105180919 | GCGGACAUUAAGGUCGUGAA | 4064 |
| 54790_1_16587 | - | chr4: 105180939-105180959 | GAGUUAAAAGAAAGAUAAAA | 4065 |
| 54790_1_16588 | - | chr4: 105180940-105180960 | UGAGUUAAAAGAAAGAUAAA | 4066 |
| 54790_1_16595 | - | chr4: 105180966-105180986 | CACAUGGAGGGAUAUAUUUG | 4067 |
| 54790_1_16599 | - | chr4: 105180978-105180998 | GGAAGGCAACUUCACAUGGA | 4068 |
| 54790_1_16601 | - | chr4: 105180979-105180999 | GGGAAGGCAACUUCACAUGG | 4069 |
| 54790_1_16604 | - | chr4: 105180982-105181002 | UUAGGGAAGGCAACUUCACA | 4070 |
| 54790_1_16606 | - | chr4: 105180995-105181015 | GGACAGUACAUAAUUAGGGA | 4071 |
| 54790_1_16608 | - | chr4: 105180999-105181019 | ACUAGGACAGUACAUAAUUA | 4072 |
| 54790_1_16610 | - | chr4: 105181000-105181020 | AACUAGGACAGUACAUAAUU | 4073 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_16613 | - | chr4: 105181016-105181036 | CAAGGAAUGAAGAUUAAACU | 4074 |
| 54790_1_16621 | - | chr4: 105181034-105181054 | UGGUUUUAUAGAGGCAAACA | 4075 |
| 54790_1_16627 | - | chr4: 105181043-105181063 | UUUUAAACUUGGUUUUAUAG | 4076 |
| 54790_1_16629 | - | chr4: 105181054-105181074 | UCAGAGACUAUUUUUAAACU | 4077 |
| 54790_1_16643 | - | chr4: 105181133-105181153 | UAGUAGAAACUUUGUUACAA | 4078 |
| 54790_1_16646 | - | chr4: 105181165-105181185 | AUAUAGAUCGUAGCUGAGAA | 4079 |
| 54790_1_16649 | - | chr4: 105181191-105181211 | UAUAACAAAAGACAUGGCCA | 4080 |
| 54790_1_16652 | - | chr4: 105181197-105181217 | UGUGUGUAUAACAAAAGACA | 4081 |
| 54790_1_16658 | - | chr4: 105181264-105181284 | AAAAGCAUAUUGUGACUAAA | 4082 |
| 54790_1_16661 | - | chr4: 105181297-105181317 | AUCAAGAAAUUCCCAGGAAA | 4083 |
| 54790_1_16665 | - | chr4: 105181303-105181323 | AAAAUCAUCAAGAAAUUCCC | 4084 |
| 54790_1_16674 | - | chr4: 105181362-105181382 | GAAAAGCACUAUUUCUGCAG | 4085 |
| 54790_1_16679 | - | chr4: 105181402-105181422 | UAUCACCAGCUCUUCUAAGA | 4086 |
| 54790_1_16682 | - | chr4: 105181430-105181450 | AACCAAGAUAAAAGAAGAGU | 4087 |
| 54790_1_16694 | - | chr4: 105181486-105181506 | UUGAUUGUCCUGUGUUAAAA | 4088 |
| 54790_1_16697 | - | chr4: 105181487-105181507 | GUUGAUUGUCCUGUGUUAAA | 4089 |
| 54790_1_16701 | - | chr4: 105181518-105181538 | UAUCUGAAUCUAAAGAAAGA | 4090 |
| 54790_1_16733 | - | chr4: 105181612-105181632 | GGGGCAGGGGUUACAGAUGU | 4091 |
| 54790_1_16735 | - | chr4: 105181625-105181645 | GUAAAAAAUAUUUGGGGCAG | 4092 |
| 54790_1_16736 | - | chr4: 105181626-105181646 | AGUAAAAAAUAUUUGGGGCA | 4093 |
| 54790_1_16737 | - | chr4: 105181627-105181647 | AAGUAAAAAAUAUUUGGGGC | 4094 |
| 54790_1_16740 | - | chr4: 105181631-105181651 | GCAUAAGUAAAAAAUAUUUG | 4095 |
| 54790_1_16741 | - | chr4: 105181632-105181652 | AGCAUAAGUAAAAAAUAUUU | 4096 |
| 54790_1_16743 | - | chr4: 105181633-105181653 | UAGCAUAAGUAAAAAAUAUU | 4097 |
| 54790_1_16756 | - | chr4: 105181718-105181738 | CAUCUUCGAUUUCCUAGAAG | 4098 |
| 54790_1_16758 | - | chr4: 105181719-105181739 | ACAUCUUCGAUUUCCUAGAA | 4099 |
| 54790_1_16760 | - | chr4: 105181720-105181740 | CACAUCUUCGAUUUCCUAGA | 4100 |
| 54790_1_16766 | - | chr4: 105181748-105181768 | AACUCAUUAUCACAUUAAAC | 4101 |
| 54790_1_16783 | - | chr4: 105181843-105181863 | CAAUCAUACUUAAGGUUGGA | 4102 |
| 54790_1_16784 | - | chr4: 105181844-105181864 | UCAAUCAUACUUAAGGUUGG | 4103 |
| 54790_1_16787 | - | chr4: 105181847-105181867 | AAUUCAAUCAUACUUAAGGU | 4104 |
| 54790_1_16789 | - | chr4: 105181851-105181871 | UAUAAAUUCAAUCAUACUUA | 4105 |
| 54790_1_16800 | - | chr4: 105181951-105181971 | UAUAUAAAAAUGAAAGUAUG | 4106 |
| 54790_1_16821 | - | chr4: 105182073-105182093 | UAGCCAGAGAACAAAUGAUA | 4107 |
| 54790_1_16824 | - | chr4: 105182074-105182094 | GUAGCCAGAGAACAAAUGAU | 4108 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_16832 | - | chr4: 105182099-105182119 | AAAAAUGUAACUAUUAACUU | 4109 |
| 54790_1_16838 | - | chr4: 105182124-105182144 | UGCAAAUUACCAUUUGUCAC | 4110 |
| 54790_1_16848 | - | chr4: 105182180-105182200 | UUUGCAUGAUUCUUAAAUAA | 4111 |
| 54790_1_16849 | - | chr4: 105182181-105182201 | GUUUGCAUGAUUCUUAAAUA | 4112 |
| 54790_1_16852 | - | chr4: 105182206-105182226 | CACCUGCUGCCUAUCAGCUC | 4113 |
| 54790_1_16858 | - | chr4: 105182268-105182288 | AGCAGAAUUACUAGCUACCU | 4114 |
| 54790_1_16862 | - | chr4: 105182292-105182312 | GAAGGAGCUAUAGUGGCUUA | 4115 |
| 54790_1_16863 | - | chr4: 105182293-105182313 | GGAAGGAGCUAUAGUGGCUU | 4116 |
| 54790_1_16865 | - | chr4: 105182299-105182319 | UAAUGGGGAAGGAGCUAUAG | 4117 |
| 54790_1_16867 | - | chr4: 105182310-105182330 | GACCCAGGGAGUAAUGGGGA | 4118 |
| 54790_1_16870 | - | chr4: 105182314-105182334 | GGUAGACCCAGGGAGUAAUG | 4119 |
| 54790_1_16872 | - | chr4: 105182315-105182335 | GGGUAGACCCAGGGAGUAAU | 4120 |
| 54790_1_16874 | - | chr4: 105182316-105182336 | UGGGUAGACCCAGGGAGUAA | 4121 |
| 54790_1_16876 | - | chr4: 105182324-105182344 | CAGGAUGGUGGGUAGACCCA | 4122 |
| 54790_1_16878 | - | chr4: 105182325-105182345 | GCAGGAUGGUGGGUAGACCC | 4123 |
| 54790_1_16885 | - | chr4: 105182335-105182355 | UAUUCUAGCUGCAGGAUGGU | 4124 |
| 54790_1_16886 | - | chr4: 105182336-105182356 | UUAUUCUAGCUGCAGGAUGG | 4125 |
| 54790_1_16888 | - | chr4: 105182339-105182359 | UUAUUAUUCUAGCUGCAGGA | 4126 |
| 54790_1_16889 | - | chr4: 105182343-105182363 | CCAUUUAUUAUUCUAGCUGC | 4127 |
| 54790_1_16891 | - | chr4: 105182376-105182396 | GUGCUGGAGGAGGAUCCUAG | 4128 |
| 54790_1_16895 | - | chr4: 105182386-105182406 | UUGAGACAUAGUGCUGGAGG | 4129 |
| 54790_1_16898 | - | chr4: 105182389-105182409 | CCGUUGAGACAUAGUGCUGG | 4130 |
| 54790_1_16900 | - | chr4: 105182392-105182412 | GGUCCGUUGAGACAUAGUGC | 4131 |
| 54790_1_16906 | - | chr4: 105182410-105182430 | UAAAUUGUCGAGUAUACAGG | 4132 |
| 54790_1_16909 | - | chr4: 105182448-105182468 | AGACGUCUCCCUUACCACAG | 4133 |
| 54790_1_16919 | - | chr4: 105182513-105182533 | AAGUGUCUACUUUUAUCAUA | 4134 |
| 54790_1_16927 | - | chr4: 105182572-105182592 | ACUCUGCAGUUAUGUUUACC | 4135 |
| 54790_1_16936 | - | chr4: 105182598-105182618 | UUAAAGAUUUCAAAACGUAU | 4136 |
| 54790_1_16943 | - | chr4: 105182639-105182659 | CUAAUCUAUUUCUAAUAGAA | 4137 |
| 54790_1_16949 | - | chr4: 105182672-105182692 | UCAUUCUAAAAAUUGAAACA | 4138 |
| 54790_1_16967 | - | chr4: 105182796-105182816 | AAUUCUAAUGCUUAAUGGGA | 4139 |
| 54790_1_16969 | - | chr4: 105182800-105182820 | UAAAAUUCUAAUGCUUAAU | 4140 |
| 54790_1_16971 | - | chr4: 105182801-105182821 | AUAAAAUUCUAAUGCUUAA | 4141 |
| 54790_1_16974 | - | chr4: 105182831-105182851 | AUCAUGAAUAUAAACAUCAA | 4142 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_16980 | − | chr4: 105182874-105182894 | CAUAUGACCUAUAUGAGCUA | 4143 |
| 54790_1_16987 | − | chr4: 105182908-105182928 | AGCCCAAAUAUCUUCAUCUA | 4144 |
| 54790_1_17002 | − | chr4: 105182973-105182993 | UACAAUUUCUUCAAAAUGGA | 4145 |
| 54790_1_17004 | − | chr4: 105182977-105182997 | ACCUUACAAUUUCUUCAAAA | 4146 |
| 54790_1_17013 | − | chr4: 105183014-105183034 | AUUUUGGGGGAUAAGUAUU | 4147 |
| 54790_1_17019 | − | chr4: 105183026-105183046 | UUUAUUUUCGUAUUUUGGG | 4148 |
| 54790_1_17021 | − | chr4: 105183027-105183047 | UUUUAUUUUCGUAUUUUGG | 4149 |
| 54790_1_17023 | − | chr4: 105183028-105183048 | AUUUUAUUUUCGUAUUUUG | 4150 |
| 54790_1_17024 | − | chr4: 105183029-105183049 | GAUUUUAUUUUCGUAUUUU | 4151 |
| 54790_1_17026 | − | chr4: 105183030-105183050 | UGAUUUUAUUUUCGUAUUU | 4152 |
| 54790_1_17041 | − | chr4: 105183117-105183137 | CAGAUUGAGGAUCAAUAAAC | 4153 |
| 54790_1_17044 | − | chr4: 105183130-105183150 | UUUAAAACAGCCACAGAUUG | 4154 |
| 54790_1_17051 | − | chr4: 105183184-105183204 | GAGUAAUGAGUCUACUACCA | 4155 |
| 54790_1_17056 | − | chr4: 105183206-105183226 | AAAUGAUGUAAUGGUUUCUG | 4156 |
| 54790_1_17059 | − | chr4: 105183207-105183227 | AAAAUGAUGUAAUGGUUUCU | 4157 |
| 54790_1_17060 | − | chr4: 105183208-105183228 | CAAAAUGAUGUAAUGGUUUC | 4158 |
| 54790_1_17065 | − | chr4: 105183215-105183235 | AAUAUUACAAAAUGAUGUAA | 4159 |
| 54790_1_17086 | − | chr4: 105183346-105183366 | UGUGAUAUUAAGUUUAUAAA | 4160 |
| 54790_1_17093 | − | chr4: 105183389-105183409 | CACAAGCAAAAUUAUAUUAA | 4161 |
| 54790_1_17097 | − | chr4: 105183420-105183440 | AAAGAGUUAUUGAAAUGAAU | 4162 |
| 54790_1_17104 | − | chr4: 105183445-105183465 | UUGAGAUAAAAAAUAUAUAU | 4163 |
| 54790_1_17120 | − | chr4: 105183501-105183521 | AGACAAGGUUGGGUCGAAAU | 4164 |
| 54790_1_17127 | − | chr4: 105183559-105183579 | GGCUAGUGAAUCCCUUUGAC | 4165 |
| 54790_1_17131 | − | chr4: 105183568-105183588 | CUAGAACUCGGCUAGUGAAU | 4166 |
| 54790_1_17134 | − | chr4: 105183569-105183589 | ACUAGAACUCGGCUAGUGAA | 4167 |
| 54790_1_17141 | − | chr4: 105183625-105183645 | UGUUUCAUAUUUAAUUAGAA | 4168 |
| 54790_1_17142 | − | chr4: 105183626-105183646 | UUGUUUCAUAUUUAAUUAGA | 4169 |
| 54790_1_17147 | − | chr4: 105183662-105183682 | CACAGGCAAACUAAGGGGGU | 4170 |
| 54790_1_17148 | − | chr4: 105183666-105183686 | AACCCACAGGCAAACUAAGG | 4171 |
| 54790_1_17149 | − | chr4: 105183667-105183687 | AAACCCACAGGCAAACUAAG | 4172 |
| 54790_1_17151 | − | chr4: 105183668-105183688 | UAAACCCACAGGCAAACUAA | 4173 |
| 54790_1_17153 | − | chr4: 105183669-105183689 | AUAAACCCACAGGCAAACUA | 4174 |
| 54790_1_17156 | − | chr4: 105183679-105183699 | UGUAACUUCCAUAAACCCAC | 4175 |
| 54790_1_17165 | − | chr4: 105183731-105183751 | CAAUAAUUCUAUUGGGAGCU | 4176 |
| 54790_1_17167 | − | chr4: 105183738-105183758 | UACAGGGCAAUAAUUCUAUU | 4177 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_17168 | − | chr4: 105183739-105183759 | CUACAGGGCAAUAAUUCUAU | 4178 |
| 54790_1_17174 | − | chr4: 105183754-105183774 | UAUUUGCGCGGCUGACUACA | 4179 |
| 54790_1_17175 | − | chr4: 105183755-105183775 | GUAUUUGCGCGGCUGACUAC | 4180 |
| 54790_1_17179 | − | chr4: 105183766-105183786 | UAUUUGUGAUUGUAUUUGCG | 4181 |
| 54790_1_17187 | − | chr4: 105183789-105183809 | UUCUUCACACAAGGAACUUC | 4182 |
| 54790_1_17190 | − | chr4: 105183798-105183818 | AUUUCUUUUCUUCACACA | 4183 |
| 54790_1_17200 | − | chr4: 105183853-105183873 | GGGAAGAAAGGGGCAAAGAA | 4184 |
| 54790_1_17202 | − | chr4: 105183863-105183883 | GGAGUGAAAGGGGAAGAAAG | 4185 |
| 54790_1_17203 | − | chr4: 105183864-105183884 | AGGAGUGAAAGGGGAAGAAA | 4186 |
| 54790_1_17204 | − | chr4: 105183865-105183885 | AAGGAGUGAAAGGGGAAGAA | 4187 |
| 54790_1_17208 | − | chr4: 105183873-105183893 | GGAGAAGAAAGGAGUGAAAG | 4188 |
| 54790_1_17210 | − | chr4: 105183874-105183894 | AGGAGAAGAAAGGAGUGAAA | 4189 |
| 54790_1_17213 | − | chr4: 105183875-105183895 | UAGGAGAAGAAAGGAGUGAA | 4190 |
| 54790_1_17218 | − | chr4: 105183884-105183904 | CAAGUAGUAUAGGAGAAGAA | 4191 |
| 54790_1_17225 | − | chr4: 105183894-105183914 | CUAGAAAUUUCAAGUAGUAU | 4192 |
| 54790_1_17234 | − | chr4: 105183934-105183954 | ACUUACCAUUCCUAACAUCC | 4193 |
| 54790_1_17246 | − | chr4: 105184003-105184023 | UGAAAAGCCUCUUAAGGGUA | 4194 |
| 54790_1_17248 | − | chr4: 105184008-105184028 | AACUUUGAAAAGCCUCUUAA | 4195 |
| 54790_1_17249 | − | chr4: 105184009-105184029 | UAACUUUGAAAAGCCUCUUA | 4196 |
| 54790_1_17252 | − | chr4: 105184047-105184067 | GUCAGAGACUGGGCCAAUGA | 4197 |
| 54790_1_17256 | − | chr4: 105184057-105184077 | GACCUCACUGGUCAGAGACU | 4198 |
| 54790_1_17257 | − | chr4: 105184058-105184078 | UGACCUCACUGGUCAGAGAC | 4199 |
| 54790_1_17260 | − | chr4: 105184069-105184089 | UGGCUAAUACUUGACCUCAC | 4200 |
| 54790_1_17265 | − | chr4: 105184089-105184109 | UUUUCACGACAUUCUGACAC | 4201 |
| 54790_1_17279 | − | chr4: 105184189-105184209 | GAUAUUUUAAAAACCAAGA | 4202 |
| 54790_1_17289 | − | chr4: 105184231-105184251 | AAAAUAAAAAGAAGUUAUGA | 4203 |
| 54790_1_17291 | − | chr4: 105184232-105184252 | GAAAAUAAAAAGAAGUUAUG | 4204 |
| 54790_1_17303 | − | chr4: 105184294-105184314 | GGUACAGGUAUAAAUUCACA | 4205 |
| 54790_1_17304 | − | chr4: 105184309-105184329 | CACUGGAACAUGAGAGGUAC | 4206 |
| 54790_1_17305 | − | chr4: 105184315-105184335 | ACCAAACACUGGAACAUGAG | 4207 |
| 54790_1_17312 | − | chr4: 105184326-105184346 | AUUAUUUAAGAACCAAACAC | 4208 |
| 54790_1_17325 | − | chr4: 105184408-105184428 | AUAACUACGAUAGCCAAACA | 4209 |
| 54790_1_17330 | − | chr4: 105184455-105184475 | AAACAAGCAUACACCAUAUG | 4210 |
| 54790_1_17340 | − | chr4: 105184529-105184549 | UCCUCCUAACAUAGACAAAG | 4211 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_17356 | - | chr4: 105184641-105184661 | UGUCAGCUACUUGGCAGUGA | 4212 |
| 54790_1_17359 | - | chr4: 105184650-105184670 | AUUUCAGAAUGUCAGCUACU | 4213 |
| 54790_1_17362 | - | chr4: 105184680-105184700 | CCAACUGUACAGUGCCUAAA | 4214 |
| 54790_1_17365 | - | chr4: 105184681-105184701 | UCCAACUGUACAGUGCCUAA | 4215 |
| 54790_1_17373 | - | chr4: 105184797-105184817 | AGCACGUUACUCACCUCAGC | 4216 |
| 54790_1_17378 | - | chr4: 105184832-105184852 | AGGUUUAAAUGGGAUGAGAC | 4217 |
| 54790_1_17383 | - | chr4: 105184842-105184862 | GUUCUCCUCCAGGUUUAAAU | 4218 |
| 54790_1_17385 | - | chr4: 105184843-105184863 | GGUUCUCCUCCAGGUUUAAA | 4219 |
| 54790_1_17389 | - | chr4: 105184852-105184872 | GCUUGAUGUGGUUCUCCUCC | 4220 |
| 54790_1_17392 | - | chr4: 105184864-105184884 | GGCUGCUUCUGUGCUUGAUG | 4221 |
| 54790_1_17397 | - | chr4: 105184885-105184905 | UUCCUGUUGAAAUGCUGCUU | 4222 |
| 54790_1_17406 | - | chr4: 105184943-105184963 | GUGAUAUUAGUACACCUUCA | 4223 |
| 54790_1_17418 | - | chr4: 105185007-105185027 | AACACUUCCGUUACAAAAAA | 4224 |
| 54790_1_17419 | - | chr4: 105185008-105185028 | AAACACUUCCGUUACAAAAA | 4225 |
| 54790_1_17434 | - | chr4: 105185084-105185104 | AUAUAAGAAUCCUCCAUUUG | 4226 |
| 54790_1_17435 | - | chr4: 105185085-105185105 | UAUAUAAGAAUCCUCCAUUU | 4227 |
| 54790_1_17437 | - | chr4: 105185086-105185106 | UUAUAUAAGAAUCCUCCAUU | 4228 |
| 54790_1_17441 | - | chr4: 105185113-105185133 | UGAAUAUAUCAUUACAAGCU | 4229 |
| 54790_1_17448 | - | chr4: 105185184-105185204 | AAGUUUUCGUUCAAAAAUGA | 4230 |
| 54790_1_17461 | - | chr4: 105185242-105185262 | AAACAUUUCAUUUGGGGAA | 4231 |
| 54790_1_17464 | - | chr4: 105185247-105185267 | CAGUGAAACAUUUCAUUUUG | 4232 |
| 54790_1_17465 | - | chr4: 105185248-105185268 | UCAGUGAAACAUUUCAUUUU | 4233 |
| 54790_1_17467 | - | chr4: 105185249-105185269 | UUCAGUGAAACAUUUCAUUU | 4234 |
| 54790_1_17473 | - | chr4: 105185275-105185295 | CAUGGCCUCCACAAGCUUGU | 4235 |
| 54790_1_17478 | - | chr4: 105185293-105185313 | CUCUUAUUCAACAUGCUUCA | 4236 |
| 54790_1_17483 | - | chr4: 105185331-105185351 | CACACCCUUUGUGGGUGGCA | 4237 |
| 54790_1_17484 | - | chr4: 105185332-105185352 | GCACACCCUUUGUGGGUGGC | 4238 |
| 54790_1_17488 | - | chr4: 105185336-105185356 | CUUAGCACACCCUUUGUGGG | 4239 |
| 54790_1_17490 | - | chr4: 105185339-105185359 | UACCUUAGCACACCCUUUGU | 4240 |
| 54790_1_17491 | - | chr4: 105185340-105185360 | UUACCUUAGCACACCCUUUG | 4241 |
| 54790_1_17500 | - | chr4: 105185401-105185421 | AAUAGCUAAAAUUUAUUGAA | 4242 |
| 54790_1_17515 | - | chr4: 105185482-105185502 | CCAGUCACUGUGUUUUAGAA | 4243 |
| 54790_1_17518 | - | chr4: 105185503-105185523 | GUCCGUACUCGGUGACGCGG | 4244 |
| 54790_1_17520 | - | chr4: 105185522-105185542 | AGGCUUUCACGACCCUAAUG | 4245 |
| 54790_1_17521 | - | chr4: 105185530-105185550 | GGAGCCGGAGGCUUUCACGA | 4246 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_17522 | - | chr4: 105185531-105185551 | UGGAGCCGGAGGCUUUCACG | 4247 |
| 54790_1_17526 | - | chr4: 105185547-105185567 | UGGAGCACUAGGCGUAUGGA | 4248 |
| 54790_1_17530 | - | chr4: 105185583-105185603 | AAAGUGGCACAAUCGGUCCU | 4249 |
| 54790_1_17531 | - | chr4: 105185587-105185607 | CCCUAAAGUGGCACAAUCGG | 4250 |
| 54790_1_17541 | - | chr4: 105185607-105185627 | AAACAUAAAAAUCAUCUCUG | 4251 |
| 54790_1_17542 | - | chr4: 105185608-105185628 | AAAACAUAAAAAUCAUCUCU | 4252 |
| 54790_1_17547 | - | chr4: 105185636-105185656 | GUCCGCGUACGGGGUGCGG | 4253 |
| 54790_1_17548 | - | chr4: 105185655-105185675 | AGGACUCAUCGACCCUAAUG | 4254 |
| 54790_1_17549 | - | chr4: 105185663-105185683 | GGAGUCGGAGGACUCAUCGA | 4255 |
| 54790_1_17550 | - | chr4: 105185664-105185684 | CGGAGUCGGAGGACUCAUCG | 4256 |
| 54790_1_17556 | - | chr4: 105185703-105185723 | GUGACGUUCGAGGCGGAGGG | 4257 |
| 54790_1_17558 | - | chr4: 105185728-105185748 | CCUCACGUCACCACGCUAGA | 4258 |
| 54790_1_17559 | - | chr4: 105185739-105185759 | AUCGGGUCCGACCUCACGUC | 4259 |
| 54790_1_17562 | - | chr4: 105185749-105185769 | AGAACGAGACAUCGGGUCCG | 4260 |
| 54790_1_17564 | - | chr4: 105185753-105185773 | UCUCAGAACGAGACAUCGGG | 4261 |
| 54790_1_17613 | - | chr4: 105185968-105185988 | AAGGUUUCACGACCCUAAUG | 4262 |
| 54790_1_17614 | - | chr4: 105185976-105185996 | GCAGUUGGAAGGUUUCACGA | 4263 |
| 54790_1_17616 | - | chr4: 105185977-105185997 | CGCAGUUGGAAGGUUUCACG | 4264 |
| 54790_1_17619 | - | chr4: 105186031-105186051 | AGAGUGAUACAACGGGUCCG | 4265 |
| 54790_1_17620 | - | chr4: 105186035-105186055 | CUCCAGAGUGAUACAACGGG | 4266 |
| 54790_1_17632 | - | chr4: 105186054-105186074 | CAAAUAAAAAACAUCUCUAC | 4267 |
| 54790_1_17636 | - | chr4: 105186106-105186126 | AGGGUUCACCGAUCCUGAUG | 4268 |
| 54790_1_17638 | - | chr4: 105186114-105186134 | AGAGUCAGAGGGUUCACCGA | 4269 |
| 54790_1_17640 | - | chr4: 105186119-105186139 | AAGGUAGAGUCAGAGGGUUC | 4270 |
| 54790_1_17641 | - | chr4: 105186179-105186199 | GUUCACGUCACCGUGCUAGA | 4271 |
| 54790_1_17642 | - | chr4: 105186190-105186210 | AGUGGGUCCGAGUUCACGUC | 4272 |
| 54790_1_17644 | - | chr4: 105186204-105186224 | UCCCAGAACGAGACAGUGGG | 4273 |
| 54790_1_17657 | - | chr4: 105186223-105186243 | AACAAACAAAAGAACUCUGU | 4274 |
| 54790_1_17658 | - | chr4: 105186224-105186244 | AAACAAACAAAAGAACUCUG | 4275 |
| 54790_1_17674 | - | chr4: 105186324-105186344 | UAAGAUAAGGGCCAUGAAGG | 4276 |
| 54790_1_17675 | - | chr4: 105186325-105186345 | UUAAGAUAAGGGCCAUGAAG | 4277 |
| 54790_1_17676 | - | chr4: 105186326-105186346 | GUUAAGAUAAGGGCCAUGAA | 4278 |
| 54790_1_17679 | - | chr4: 105186327-105186347 | GGUUAAGAUAAGGGCCAUGA | 4279 |
| 54790_1_17682 | - | chr4: 105186336-105186356 | GAAGACAGAGGUUAAGAUAA | 4280 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_17683 | − | chr4: 105186337-105186357 | UGAAGACAGAGGUUAAGAUA | 4281 |
| 54790_1_17685 | − | chr4: 105186348-105186368 | AAGGGUAGUGCUGAAGACAG | 4282 |
| 54790_1_17688 | − | chr4: 105186366-105186386 | AAACGGAACAAACAUAUGAA | 4283 |
| 54790_1_17689 | − | chr4: 105186367-105186387 | AAAACGGAACAAACAUAUGA | 4284 |
| 54790_1_17694 | − | chr4: 105186383-105186403 | AAAUCACUUAGAAGAUAAAA | 4285 |
| 54790_1_17711 | − | chr4: 105186518-105186538 | CGUGGUGACGUGAGGUCGGA | 4286 |
| 54790_1_17712 | − | chr4: 105186519-105186539 | GCGUGGUGACGUGAGGUCGG | 4287 |
| 54790_1_17716 | − | chr4: 105186559-105186579 | CUUAGCGGAGGUCCUCCGCC | 4288 |
| 54790_1_17717 | − | chr4: 105186562-105186582 | CCUCUUAGCGGAGGUCCUCC | 4289 |
| 54790_1_17720 | − | chr4: 105186565-105186585 | CGCCCUCUUAGCGGAGGUCC | 4290 |
| 54790_1_17721 | − | chr4: 105186568-105186588 | CUCCGCCCUCUUAGCGGAGG | 4291 |
| 54790_1_17725 | − | chr4: 105186583-105186603 | CGAUGACCCCUCCGACUCCG | 4292 |
| 54790_1_17728 | − | chr4: 105186584-105186604 | UCGAUGACCCCUCCGACUCC | 4293 |
| 54790_1_17730 | − | chr4: 105186587-105186607 | GGGUCGAUGACCCCUCCGAC | 4294 |
| 54790_1_17732 | − | chr4: 105186593-105186613 | ACAUCAGGGUCGAUGACCCC | 4295 |
| 54790_1_17733 | − | chr4: 105186596-105186616 | CGGACAUCAGGGUCGAUGAC | 4296 |
| 54790_1_17735 | − | chr4: 105186597-105186617 | UCGGACAUCAGGGUCGAUGA | 4297 |
| 54790_1_17737 | − | chr4: 105186598-105186618 | UUCGGACAUCAGGGUCGAUG | 4298 |
| 54790_1_17741 | − | chr4: 105186624-105186644 | AUUUUUAAUAGGUCCGUACC | 4299 |
| 54790_1_17742 | − | chr4: 105186627-105186647 | UAUAUUUUUAAUAGGUCCGU | 4300 |
| 54790_1_17743 | − | chr4: 105186632-105186652 | AUUUUUAUAUUUUUAAUAGG | 4301 |
| 54790_1_17749 | − | chr4: 105186699-105186719 | ACCCACCUAGUGAACUCCAG | 4302 |
| 54790_1_17752 | − | chr4: 105186704-105186724 | GUUCCACCCACCUAGUGAAC | 4303 |
| 54790_1_17756 | − | chr4: 105186715-105186735 | GAAACCCUCCGGUUCCACCC | 4304 |
| 54790_1_17758 | − | chr4: 105186718-105186738 | CGUGAAACCCUCCGGUUCCA | 4305 |
| 54790_1_17759 | − | chr4: 105186719-105186739 | UCGUGAAACCCUCCGGUUCC | 4306 |
| 54790_1_17761 | − | chr4: 105186722-105186742 | GGGUCGUGAAACCCUCCGGU | 4307 |
| 54790_1_17762 | − | chr4: 105186728-105186748 | ACGUUAGGGUCGUGAAACCC | 4308 |
| 54790_1_17763 | − | chr4: 105186731-105186751 | CGGACGUUAGGGUCGUGAAA | 4309 |
| 54790_1_17765 | − | chr4: 105186732-105186752 | ACGGACGUUAGGGUCGUGAA | 4310 |
| 54790_1_17770 | − | chr4: 105186759-105186779 | AUCAUGAACGGUCCGGCGCC | 4311 |
| 54790_1_17772 | − | chr4: 105186762-105186782 | UGGAUCAUGAACGGUCCGGC | 4312 |
| 54790_1_17773 | − | chr4: 105186768-105186788 | CUAUUUUGGAUCAUGAACGG | 4313 |
| 54790_1_17776 | − | chr4: 105186782-105186802 | GAAGCUUAAUGAUGCUAUUU | 4314 |
| 54790_1_17786 | − | chr4: 105186827-105186847 | UAAAUACAGUGAUGACUCAC | 4315 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_17795 | - | chr4: 105186893-105186913 | UCCUCAGUAGCCAAUAAUUC | 4316 |
| 54790_1_17801 | - | chr4: 105186957-105186977 | CAGUCCCUUUAGUAAAAAG | 4317 |
| 54790_1_17809 | - | chr4: 105187014-105187034 | AUCAAGCUGGCAAACUAUCA | 4318 |
| 54790_1_17814 | - | chr4: 105187027-105187047 | UGGUUGACUGGGAAUCAAGC | 4319 |
| 54790_1_17816 | - | chr4: 105187038-105187058 | CAGCAGUUAUCUGGUUGACU | 4320 |
| 54790_1_17817 | - | chr4: 105187039-105187059 | CCAGCAGUUAUCUGGUUGAC | 4321 |
| 54790_1_17820 | - | chr4: 105187047-105187067 | UGUCACUACCAGCAGUUAUC | 4322 |
| 54790_1_17823 | - | chr4: 105187077-105187097 | CACAAGAUUGGGAGUCCUGG | 4323 |
| 54790_1_17825 | - | chr4: 105187080-105187100 | UGGCACAAGAUUGGGAGUCC | 4324 |
| 54790_1_17829 | - | chr4: 105187088-105187108 | CUCUGAGCUGGCACAAGAUU | 4325 |
| 54790_1_17832 | - | chr4: 105187089-105187109 | UCUCUGAGCUGGCACAAGAU | 4326 |
| 54790_1_17835 | - | chr4: 105187100-105187120 | GGGGAUUUCCCUCUCUGAGC | 4327 |
| 54790_1_17839 | - | chr4: 105187119-105187139 | AUGGUGUGAGCAGUUCUAGG | 4328 |
| 54790_1_17840 | - | chr4: 105187120-105187140 | AAUGGUGUGAGCAGUUCUAG | 4329 |
| 54790_1_17842 | - | chr4: 105187121-105187141 | GAAUGGUGUGAGCAGUUCUA | 4330 |
| 54790_1_17845 | - | chr4: 105187122-105187142 | GGAAUGGUGUGAGCAGUUCU | 4331 |
| 54790_1_17850 | - | chr4: 105187138-105187158 | GGUGCUUGUGGUUCUUGGAA | 4332 |
| 54790_1_17851 | - | chr4: 105187143-105187163 | AAGGUGGUGCUUGUGGUUCU | 4333 |
| 54790_1_17856 | - | chr4: 105187150-105187170 | CUAUACCAAGGUGGUGCUUG | 4334 |
| 54790_1_17859 | - | chr4: 105187159-105187179 | CAUUUUUAACUAUACCAAGG | 4335 |
| 54790_1_17861 | - | chr4: 105187162-105187182 | UCACAUUUUUAACUAUACCA | 4336 |
| 54790_1_17869 | - | chr4: 105187187-105187207 | GUUUUUAUCAGAAUUUGAGU | 4337 |
| 54790_1_17891 | - | chr4: 105187296-105187316 | CCAAAUACUGAGGAAGGCAG | 4338 |
| 54790_1_17894 | - | chr4: 105187302-105187322 | GACAAACCAAAUACUGAGGA | 4339 |
| 54790_1_17897 | - | chr4: 105187306-105187326 | AACUGACAAACCAAAUACUG | 4340 |
| 54790_1_17908 | - | chr4: 105187371-105187391 | ACAUUAUUAAGAUUAGAAGA | 4341 |
| 54790_1_17909 | - | chr4: 105187372-105187392 | AACAUUAUUAAGAUUAGAAG | 4342 |
| 54790_1_17927 | - | chr4: 105187431-105187451 | AGGUCAGGGUUGGAGUCAAU | 4343 |
| 54790_1_17928 | - | chr4: 105187441-105187461 | GAAGUACAGGAGGUCAGGGU | 4344 |
| 54790_1_17931 | - | chr4: 105187445-105187465 | AGGUGAAGUACAGGAGGUCA | 4345 |
| 54790_1_17932 | - | chr4: 105187446-105187466 | CAGGUGAAGUACAGGAGGUC | 4346 |
| 54790_1_17935 | - | chr4: 105187451-105187471 | UCAGGCAGGUGAAGUACAGG | 4347 |
| 54790_1_17937 | - | chr4: 105187454-105187474 | UCAUCAGGCAGGUGAAGUAC | 4348 |
| 54790_1_17941 | - | chr4: 105187465-105187485 | CAAAUAAAUAUUCAUCAGGC | 4349 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_17943 | - | chr4: 105187469-105187489 | AUUCCAAUAAAUAUUCAUC | 4350 |
| 54790_1_17951 | - | chr4: 105187541-105187561 | AUAAAUAGAUAAUUCUAGAA | 4351 |
| 54790_1_17965 | - | chr4: 105187593-105187613 | AGUGAUAAAGCUUUUGAGUU | 4352 |
| 54790_1_17978 | - | chr4: 105187663-105187683 | AUUACUGAUAAAGAAAUGAA | 4353 |
| 54790_1_17985 | - | chr4: 105187720-105187740 | CAAUAGUUGGAAUGAGAGGG | 4354 |
| 54790_1_17986 | - | chr4: 105187723-105187743 | AAGCAAUAGUUGGAAUGAGA | 4355 |
| 54790_1_17987 | - | chr4: 105187724-105187744 | UAAGCAAUAGUUGGAAUGAG | 4356 |
| 54790_1_17992 | - | chr4: 105187733-105187753 | ACUCAAGUAUAAGCAAUAGU | 4357 |
| 54790_1_17998 | - | chr4: 105187767-105187787 | AAUAAUCAUAUGCAAGAUAU | 4358 |
| 54790_1_18001 | - | chr4: 105187797-105187817 | ACACUUCACCAUGAAGAUUU | 4359 |
| 54790_1_18004 | - | chr4: 105187810-105187830 | GGUAGGGUCACUCACACUUC | 4360 |
| 54790_1_18022 | - | chr4: 105187890-105187910 | UAAGGUGAUCGUUACACAGU | 4361 |
| 54790_1_18024 | - | chr4: 105187891-105187911 | GUAAGGUGAUCGUUACACAG | 4362 |
| 54790_1_18029 | - | chr4: 105187927-105187947 | ACGGUUUGACAAAACGUUUC | 4363 |
| 54790_1_18037 | - | chr4: 105187978-105187998 | UCGCUUUGAUGACCCAGAAU | 4364 |
| 54790_1_18038 | - | chr4: 105187986-105188006 | AGGGAUUCUCGCUUUGAUGA | 4365 |
| 54790_1_18039 | - | chr4: 105187987-105188007 | UAGGGAUUCUCGCUUUGAUG | 4366 |
| 54790_1_18049 | - | chr4: 105188011-105188031 | CAAAGUUAAGAGAACUCUC | 4367 |
| 54790_1_18059 | - | chr4: 105188039-105188059 | UACAAAUAUUCAAAAACAUA | 4368 |
| 54790_1_18060 | - | chr4: 105188040-105188060 | UUACAAAUAUUCAAAAACAU | 4369 |
| 54790_1_18063 | - | chr4: 105188069-105188089 | CUUAUUACGACGUUGUUUGU | 4370 |
| 54790_1_18072 | - | chr4: 105188099-105188119 | AAACCCAACGAAGAUGGAAA | 4371 |
| 54790_1_18074 | - | chr4: 105188116-105188136 | AGUAGGUAGACAUCCGUAAA | 4372 |
| 54790_1_18075 | - | chr4: 105188117-105188137 | AAGUAGGUAGACAUCCGUAA | 4373 |
| 54790_1_18079 | - | chr4: 105188124-105188144 | AAUAGGUAAGUAGGUAGACA | 4374 |
| 54790_1_18090 | - | chr4: 105188186-105188206 | GUCUUAAAGAAGGAGAAAU | 4375 |
| 54790_1_18108 | - | chr4: 105188262-105188282 | UUAUAAAAGAAACACACUA | 4376 |
| 54790_1_18111 | - | chr4: 105188291-105188311 | AAGAUUCAUGGAGUACAUUC | 4377 |
| 54790_1_18120 | - | chr4: 105188353-105188373 | AACGAGGAGGAGGGUCGGGG | 4378 |
| 54790_1_18138 | - | chr4: 105188483-105188503 | AUAAAUUCAUAUGAUAAGAC | 4379 |
| 54790_1_18155 | - | chr4: 105188569-105188589 | GGAGUAUUUAUUACGAAGAA | 4380 |
| 54790_1_18165 | - | chr4: 105188608-105188628 | CGAUAGUUACUACUUGAAAA | 4381 |
| 54790_1_18166 | - | chr4: 105188609-105188629 | UCGAUAGUUACUACUUGAAA | 4382 |
| 54790_1_18189 | - | chr4: 105188715-105188735 | GUGAAUCACAUUACAAAAAU | 4383 |
| 54790_1_18196 | - | chr4: 105188745-105188765 | UUUUAAACCGGAAAAUGCAG | 4384 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_18198 | - | chr4: 105188759-105188779 | UAUAUUUUGGUAUGUUUUAA | 4385 |
| 54790_1_18211 | - | chr4: 105188808-105188828 | UUAGUUGAAAGUCAGAAAUA | 4386 |
| 54790_1_18212 | - | chr4: 105188809-105188829 | AUUAGUUGAAAGUCAGAAAU | 4387 |
| 54790_1_18220 | - | chr4: 105188839-105188859 | AAGUAAGGAGGGGCCCGGA | 4388 |
| 54790_1_18221 | - | chr4: 105188845-105188865 | AAAAGUAAGUAAGGAGGGGG | 4389 |
| 54790_1_18222 | - | chr4: 105188846-105188866 | CAAAAGUAAGUAAGGAGGGG | 4390 |
| 54790_1_18225 | - | chr4: 105188874-105188894 | GUUUUUGGGUCAUGGGUAA | 4391 |
| 54790_1_18239 | - | chr4: 105188985-105189005 | ACAUUUCAUAUACUCAGUCA | 4392 |
| 54790_1_18240 | - | chr4: 105188986-105189006 | AACAUUUCAUAUACUCAGUC | 4393 |
| 54790_1_18251 | - | chr4: 105189047-105189067 | GCCAUACGUUAAAAUUUAAG | 4394 |
| 54790_1_18252 | - | chr4: 105189048-105189068 | AGCCAUACGUUAAAAUUUAA | 4395 |
| 54790_1_18253 | - | chr4: 105189049-105189069 | AAGCCAUACGUUAAAAUUUA | 4396 |
| 54790_1_18260 | - | chr4: 105189080-105189100 | ACGUUGCUUCUUUAGAAACA | 4397 |
| 54790_1_18262 | - | chr4: 105189105-105189125 | UCUUUAUCAUUCGACUCUGA | 4398 |
| 54790_1_18263 | - | chr4: 105189106-105189126 | AUCUUUAUCAUUCGACUCUG | 4399 |
| 54790_1_18278 | - | chr4: 105189159-105189179 | UAAAAUGUCUCAUUCUUCCC | 4400 |
| 54790_1_18281 | - | chr4: 105189162-105189182 | GGGUAAAAUGUCUCAUUCUU | 4401 |
| 54790_1_18283 | - | chr4: 105189163-105189183 | AGGGUAAAAUGUCUCAUUCU | 4402 |
| 54790_1_18296 | - | chr4: 105189225-105189245 | UAAAUUGUGAGUUUUUUUAG | 4403 |
| 54790_1_18302 | - | chr4: 105189291-105189311 | GCUCAGGUUCCCGGGGUUGA | 4404 |
| 54790_1_18303 | - | chr4: 105189298-105189318 | AGUUGAAGCUCAGGUUCCCG | 4405 |
| 54790_1_18304 | - | chr4: 105189299-105189319 | CAGUUGAAGCUCAGGUUCCC | 4406 |
| 54790_1_18305 | - | chr4: 105189300-105189320 | GCAGUUGAAGCUCAGGUUCC | 4407 |
| 54790_1_18308 | - | chr4: 105189307-105189327 | AUCAGAAGCAGUUGAAGCUC | 4408 |
| 54790_1_18313 | - | chr4: 105189336-105189356 | GAAUAUCCUGAAAUAGUAUC | 4409 |
| 54790_1_18319 | - | chr4: 105189358-105189378 | UGAAUAUAUGGAAACAGUAU | 4410 |
| 54790_1_18322 | - | chr4: 105189370-105189390 | GGUCCAUUGUCCUGAAUAUA | 4411 |
| 54790_1_18329 | - | chr4: 105189391-105189411 | GAUAAAUGGCUAAAGGAGU | 4412 |
| 54790_1_18331 | - | chr4: 105189397-105189417 | AGUUUUGAUAAAAUGGCUAA | 4413 |
| 54790_1_18333 | - | chr4: 105189404-105189424 | UCUAAAGAGUUUUGAUAAAA | 4414 |
| 54790_1_18342 | - | chr4: 105189448-105189468 | AAAGGAGCACAAGAAGACUU | 4415 |
| 54790_1_18347 | - | chr4: 105189466-105189486 | UGACUGAAGAGUGUCUACAA | 4416 |
| 54790_1_18353 | - | chr4: 105189507-105189527 | AUACAGCUGCAGCAAAUUGG | 4417 |
| 54790_1_18356 | - | chr4: 105189510-105189530 | CAGAUACAGCUGCAGCAAAU | 4418 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_1_18363 | - | chr4: 105189535-105189555 | GGGGAGAAAGCGUUGUUUUG | 4419 |
| 54790_1_18367 | - | chr4: 105189554-105189574 | GCAGAGAGAAAAGAGGAAUG | 4420 |
| 54790_1_18368 | - | chr4: 105189555-105189575 | GGCAGAGAGAAAAGAGGAAU | 4421 |
| 54790_1_18372 | - | chr4: 105189556-105189576 | GGGCAGAGAGAAAAGAGGAA | 4422 |
| 54790_1_18375 | - | chr4: 105189561-105189581 | UCCAAGGGCAGAGAGAAAAG | 4423 |
| 54790_1_18381 | - | chr4: 105189576-105189596 | AGAAGUCCACAGAGUUCCAA | 4424 |
| 54790_1_18382 | - | chr4: 105189577-105189597 | GAGAAGUCCACAGAGUUCCA | 4425 |
| 54790_1_18390 | - | chr4: 105189612-105189632 | AUGCACUGAUAAAAGGGAGU | 4426 |
| 54790_1_18392 | - | chr4: 105189618-105189638 | GAUGACAUGCACUGAUAAAA | 4427 |
| 54790_1_18393 | - | chr4: 105189619-105189639 | AGAUGACAUGCACUGAUAAA | 4428 |
| 54790_1_18398 | - | chr4: 105189642-105189662 | UAUUGGGUGCUACAAAUAAG | 4429 |
| 54790_1_18400 | - | chr4: 105189658-105189678 | AAAGAUGUAGUAAAAAUAUU | 4430 |
| 54790_1_18402 | - | chr4: 105189659-105189679 | CAAAGAUGUAGUAAAAAUAU | 4431 |
| 54790_1_18405 | - | chr4: 105189683-105189703 | UAACCCAAGUAAGACUUAAU | 4432 |
| 54790_1_18410 | - | chr4: 105189737-105189757 | CUGACCUGUAUAUCUUUAAA | 4433 |
| 54790_1_18417 | - | chr4: 105189754-105189774 | AAAUUAAAUCGACCUCUCUG | 4434 |
| 54790_1_18421 | - | chr4: 105189763-105189783 | GAGUUCCCAAAAUUAAAUCG | 4435 |
| 54790_1_18423 | - | chr4: 105189778-105189798 | GUACACCAGAGACACGAGUU | 4436 |
| 54790_1_18425 | - | chr4: 105189779-105189799 | UGUACACCAGAGACACGAGU | 4437 |
| 54790_1_18427 | - | chr4: 105189794-105189814 | UCCAUUUUGUAAUAUUGUAC | 4438 |
| 54790_1_18428 | - | chr4: 105189814-105189834 | GUACGAUUCACGAUACCUUU | 4439 |
| 54790_1_18429 | - | chr4: 105189820-105189840 | UCCAUUGUACGAUUCACGAU | 4440 |
| 54790_1_18434 | - | chr4: 105189840-105189860 | UAAGUCAUAUACGGUACAGU | 4441 |
| 54790_1_18437 | - | chr4: 105189894-105189914 | UCCCUGUACUUCAUGAGAUG | 4442 |
| 54790_1_18442 | - | chr4: 105189933-105189953 | CCACUGACAUUCUACUUCAG | 4443 |
| 54790_1_18448 | - | chr4: 105189954-105189974 | UUCUCCUUUGAAAUAAGAGG | 4444 |
| 54790_1_18453 | - | chr4: 105189971-105189991 | AAGACUGAACAACUCGAUUC | 4445 |
| 54790_1_18462 | - | chr4: 105190008-105190028 | UAGUGGAUCCAUUCUUCAAC | 4446 |
| 54790_1_18468 | - | chr4: 105190021-105190041 | CCGAAUGUUCUCAUAGUGGA | 4447 |
| 54790_1_18472 | - | chr4: 105190042-105190062 | GAAUCGUCACCAAGUGUCAC | 4448 |
| 54790_1_18475 | - | chr4: 105190054-105190074 | ACUUCAUCUGUUGAAUCGUC | 4449 |
| 54790_1_18479 | - | chr4: 105190085-105190105 | CAAUGAGGCUUAAGAGCCAG | 4450 |
| 54790_1_18482 | - | chr4: 105190100-105190120 | CUUCACCGCAAUAAUCAAUG | 4451 |
| 54790_1_18502 | - | chr4: 105190241-105190261 | UGGAUAUUCCAUUCAGUG | 4452 |
| 54790_1_18507 | - | chr4: 105190261-105190281 | AGGUUUUGGAUACCUAUAAU | 4453 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_1_18510 | − | chr4: 105190275-105190295 | AUAAAGAGUUUAAAAGGUUU | 4454 |
| 54790_1_18512 | − | chr4: 105190281-105190301 | CCUGAUAUAAAGAGUUUAAA | 4455 |
| 54790_1_18519 | − | chr4: 105190312-105190332 | UAAGUUAGCAAAAGGAACA | 4456 |
| 54790_1_18520 | − | chr4: 105190313-105190333 | UUAAGUUAGCAAAAGGAAC | 4457 |
| 54790_1_18525 | − | chr4: 105190319-105190339 | ACAUUUUAAGUUAGCAAAA | 4458 |
| 54790_2_2 | − | chr4: 105190494-105190514 | CUGAGCUGCUGGUAAGACAG | 4459 |
| 54790_2_9 | − | chr4: 105190544-105190564 | UGAAUUUAUUCCUAAUGUAA | 4460 |
| 54790_2_17 | + | chr4: 105190620-105190640 | UUUCUUUAUUGUCUAUGCUU | 4461 |
| 54790_2_23 | + | chr4: 105190628-105190648 | UUGUCUAUGCUUAGGACACA | 4462 |
| 54790_2_37 | + | chr4: 105190697-105190717 | UAUGUAUAGCUGUAUUUUUC | 4463 |
| 54790_2_48 | + | chr4: 105190734-105190754 | UUAUCAAUUCUCAAUGUCUA | 4464 |
| 54790_2_55 | + | chr4: 105190750-105190770 | UCUAUGGAGUUUUUAAAAAG | 4465 |
| 54790_2_57 | + | chr4: 105190755-105190775 | GGAGUUUUUAAAAAGAGGUA | 4466 |
| 54790_2_77 | + | chr4: 105190871-105190891 | ACUUCGUCUCAAUCUUGUUA | 4467 |
| 54790_2_79 | + | chr4: 105190884-105190904 | CUUGUUAAGGACCAAAUAAA | 4468 |
| 54790_2_82 | + | chr4: 105190893-105190913 | GACCAAAUAAAUGGUAUUUG | 4469 |
| 54790_2_89 | + | chr4: 105190933-105190953 | AAGUGAGUACCUCCUGCACC | 4470 |
| 54790_2_90 | + | chr4: 105190957-105190977 | UAGUCAGUCUUGUGACAAUU | 4471 |
| 54790_2_98 | + | chr4: 105190989-105191009 | ACUAGCAGAGAACUAAAUUA | 4472 |
| 54790_2_100 | + | chr4: 105190994-105191014 | CAGAGAACUAAAUUAUGGAA | 4473 |
| 54790_2_103 | + | chr4: 105191005-105191025 | AUUAUGGAAUGGCAGAUCUC | 4474 |
| 54790_2_105 | + | chr4: 105191030-105191050 | CAGCUAUGUGAUUUUACAUA | 4475 |
| 54790_2_107 | + | chr4: 105191044-105191064 | UACAUACGGUUUGUUUUUAA | 4476 |
| 54790_2_116 | + | chr4: 105191061-105191081 | UAAUGGAUAGAGACAGAGUC | 4477 |
| 54790_2_120 | + | chr4: 105191075-105191095 | AGAGUCUGGCUAUGUUGCCC | 4478 |
| 54790_2_124 | + | chr4: 105191093-105191113 | CCAGGCUGCUCUGAAACUCC | 4479 |
| 54790_2_125 | + | chr4: 105191094-105191114 | CAGGCUGCUCUGAAACUCCU | 4480 |
| 54790_2_129 | + | chr4: 105191127-105191147 | CAUCCUGCCUUAGCCUCUUA | 4481 |
| 54790_2_132 | + | chr4: 105191133-105191153 | GCCUUAGCCUCUUAAGGAGC | 4482 |
| 54790_2_133 | + | chr4: 105191134-105191154 | CCUUAGCCUCUUAAGGAGCU | 4483 |
| 54790_2_135 | + | chr4: 105191142-105191162 | UCUUAAGGAGCUGGGAUUAC | 4484 |
| 54790_2_137 | + | chr4: 105191156-105191176 | GAUUACAGGUGCAUGCCCCC | 4485 |
| 54790_2_147 | + | chr4: 105191196-105191216 | UCUGAAAAUACAAAAGAAAG | 4486 |
| 54790_2_149 | + | chr4: 105191197-105191217 | CUGAAAAUACAAAAGAAAGA | 4487 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_166 | + | chr4: 105191294-105191314 | CUGCUGAGUGUCCCAACCUA | 4488 |
| 54790_2_167 | + | chr4: 105191295-105191315 | UGCUGAGUGUCCCAACCUAA | 4489 |
| 54790_2_174 | + | chr4: 105191336-105191356 | AUAUAUGCAUGUAUAGAAGU | 4490 |
| 54790_2_177 | + | chr4: 105191337-105191357 | UAUAUGCAUGUAUAGAAGUA | 4491 |
| 54790_2_196 | + | chr4: 105191448-105191468 | UAAAAUUAUAGAGACAUUGC | 4492 |
| 54790_2_202 | + | chr4: 105191459-105191479 | AGACAUUGCAGGAGAGACUC | 4493 |
| 54790_2_208 | + | chr4: 105191476-105191496 | CUCUGGAUUAGAUAGAAAAA | 4494 |
| 54790_2_212 | + | chr4: 105191486-105191506 | GAUAGAAAAAGGAAGAAUU | 4495 |
| 54790_2_219 | + | chr4: 105191517-105191537 | UUGUCUAUAAUCCUUUUAGU | 4496 |
| 54790_2_237 | + | chr4: 105191622-105191642 | UGCCUUACUGCAGACACCUG | 4497 |
| 54790_2_241 | + | chr4: 105191670-105191690 | AUACUUCUCAGAGACUGUUC | 4498 |
| 54790_2_251 | + | chr4: 105191722-105191742 | AGUUGAACUCCCAUGAUUCC | 4499 |
| 54790_2_255 | + | chr4: 105191746-105191766 | UGUUGCCAUUUCAAGACAC | 4500 |
| 54790_2_256 | + | chr4: 105191747-105191767 | GUUGCCAUUUCAAGACACA | 4501 |
| 54790_2_262 | + | chr4: 105191782-105191802 | UCUAGAUUACCUCUCUACCU | 4502 |
| 54790_2_265 | + | chr4: 105191783-105191803 | CUAGAUUACCUCUCUACCUU | 4503 |
| 54790_2_270 | + | chr4: 105191805-105191825 | GAAUUUUAAGUCACUCUGUG | 4504 |
| 54790_2_273 | + | chr4: 105191806-105191826 | AAUUUUAAGUCACUCUGUGA | 4505 |
| 54790_2_295 | + | chr4: 105191923-105191943 | UCCUCUUUCCCCUCUCAUGC | 4506 |
| 54790_2_300 | + | chr4: 105191934-105191954 | CUCUCAUGCUGGAAAAUCUU | 4507 |
| 54790_2_327 | + | chr4: 105192067-105192087 | CUGAGAGCGCAUUUUUAAGA | 4508 |
| 54790_2_342 | + | chr4: 105192134-105192154 | CUCUUCUUGAACGUUAAGCC | 4509 |
| 54790_2_345 | + | chr4: 105192135-105192155 | UCUUCUUGAACGUUAAGCCU | 4510 |
| 54790_2_349 | + | chr4: 105192140-105192160 | UUGAACGUUAAGCCUGGGUA | 4511 |
| 54790_2_354 | + | chr4: 105192162-105192182 | GAAUAAAGUGCAGAAGUUUA | 4512 |
| 54790_2_364 | + | chr4: 105192224-105192244 | AAUUAAAAUAUUAGCCAUUG | 4513 |
| 54790_2_366 | + | chr4: 105192225-105192245 | AUUAAAAUAUUAGCCAUUGA | 4514 |
| 54790_2_368 | + | chr4: 105192231-105192251 | AUAUUAGCCAUUGAGGGAAA | 4515 |
| 54790_2_370 | + | chr4: 105192240-105192260 | AUUGAGGGAAAAGGUUUUAC | 4516 |
| 54790_2_374 | + | chr4: 105192253-105192273 | GUUUUACAGGUAGCUCUCUG | 4517 |
| 54790_2_384 | + | chr4: 105192311-105192331 | UGCAUUUAAUUUUUUACAGU | 4518 |
| 54790_2_401 | + | chr4: 105192381-105192401 | UUAUUUUUAGUACAUUUAUU | 4519 |
| 54790_2_411 | + | chr4: 105192394-105192414 | AUUUAUUAGGAAUGUGUUCU | 4520 |
| 54790_2_412 | + | chr4: 105192395-105192415 | UUUAUUAGGAAUGUGUUCUU | 4521 |
| 54790_2_422 | + | chr4: 105192432-105192452 | UCUGUAAGCCCUGCUUUAAA | 4522 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_426 | + | chr4: 105192448-105192468 | UAAAUGGCAAAGAAGAAAGU | 4523 |
| 54790_2_430 | + | chr4: 105192468-105192488 | AGGUAAUAAUAGAUAAUAAC | 4524 |
| 54790_2_437 | + | chr4: 105192529-105192549 | GUAAGUUCUCAAUUUUAUAU | 4525 |
| 54790_2_468 | + | chr4: 105192628-105192648 | UUGAGCACCUGCCAAAUACC | 4526 |
| 54790_2_473 | + | chr4: 105192640-105192660 | CAAAUACCAGGCACUCUUCU | 4527 |
| 54790_2_475 | + | chr4: 105192651-105192671 | CACUCUUCUAGGAACUAGAG | 4528 |
| 54790_2_479 | + | chr4: 105192668-105192688 | GAGUGGCAUUAAUGAGUAAG | 4529 |
| 54790_2_495 | + | chr4: 105192794-105192814 | UAAAAAUGUAAAGCAGAAAA | 4530 |
| 54790_2_501 | + | chr4: 105192805-105192825 | AGCAGAAAAGGAAAUUGAG | 4531 |
| 54790_2_503 | + | chr4: 105192809-105192829 | GAAAAGGAAAUUGAGUGGC | 4532 |
| 54790_2_504 | + | chr4: 105192810-105192830 | AAAAGGAAAUUGAGUGGCA | 4533 |
| 54790_2_505 | + | chr4: 105192815-105192835 | GGAAAUUGAGUGGCAGGGUU | 4534 |
| 54790_2_509 | + | chr4: 105192846-105192866 | GAAGAUAUAGUAGUCAAGUA | 4535 |
| 54790_2_519 | + | chr4: 105192922-105192942 | CAAGCCAUGAAGUUAUCUGA | 4536 |
| 54790_2_521 | + | chr4: 105192931-105192951 | AAGUUAUCUGAAGGAAUUGC | 4537 |
| 54790_2_523 | + | chr4: 105192937-105192957 | UCUGAAGGAAUUGCAGGUAG | 4538 |
| 54790_2_529 | + | chr4: 105192957-105192977 | UGGAGAACAGCCAAAAGACC | 4539 |
| 54790_2_531 | + | chr4: 105192969-105192989 | AAAAGACCUGGAGUAGUAAA | 4540 |
| 54790_2_544 | + | chr4: 105193052-105193072 | AUACACUUAAGUAAGUGAUA | 4541 |
| 54790_2_549 | + | chr4: 105193065-105193085 | AGUGAUAUGGACAAGAACUU | 4542 |
| 54790_2_551 | + | chr4: 105193081-105193101 | ACUUUGGAAGUUGAAUAGCA | 4543 |
| 54790_2_555 | + | chr4: 105193090-105193110 | GUUGAAUAGCAAGGUCCAUC | 4544 |
| 54790_2_560 | + | chr4: 105193103-105193123 | GUCCAUCUGGACUAUAACAG | 4545 |
| 54790_2_561 | + | chr4: 105193106-105193126 | CAUCUGGACUAUAACAGAGG | 4546 |
| 54790_2_564 | + | chr4: 105193117-105193137 | UAACAGAGGAGGCUUCACAA | 4547 |
| 54790_2_565 | + | chr4: 105193121-105193141 | AGAGGAGGCUUCACAAAGGA | 4548 |
| 54790_2_567 | + | chr4: 105193128-105193148 | GCUUCACAAAGGAAGGUGAC | 4549 |
| 54790_2_568 | + | chr4: 105193129-105193149 | CUUCACAAAGGAAGGUGACA | 4550 |
| 54790_2_570 | + | chr4: 105193134-105193154 | CAAAGGAAGGUGACAGGGCA | 4551 |
| 54790_2_572 | + | chr4: 105193139-105193159 | GAAGGUGACAGGGCAUGGCC | 4552 |
| 54790_2_575 | + | chr4: 105193149-105193169 | GGGCAUGGCCUGGAUCCUGA | 4553 |
| 54790_2_577 | + | chr4: 105193154-105193174 | UGGCCUGGAUCCUGAAGGAC | 4554 |
| 54790_2_583 | + | chr4: 105193163-105193183 | UCCUGAAGGACAGGAAGAAU | 4555 |
| 54790_2_584 | + | chr4: 105193164-105193184 | CCUGAAGGACAGGAAGAAUU | 4556 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_589 | + | chr4: 105193193-105193213 | AACAAAGAAUGACAUCCCAG | 4557 |
| 54790_2_595 | + | chr4: 105193203-105193223 | GACAUCCCAGUGGAGAGAAG | 4558 |
| 54790_2_598 | + | chr4: 105193206-105193226 | AUCCCAGUGGAGAGAAGUGG | 4559 |
| 54790_2_600 | + | chr4: 105193207-105193227 | UCCCAGUGGAGAGAAGUGGA | 4560 |
| 54790_2_601 | + | chr4: 105193208-105193228 | CCCAGUGGAGAGAAGUGGAG | 4561 |
| 54790_2_605 | + | chr4: 105193224-105193244 | GGAGGGGAAACAGCAUGAAA | 4562 |
| 54790_2_610 | + | chr4: 105193243-105193263 | AUGGAGUGAAAUAAGAAUGU | 4563 |
| 54790_2_612 | + | chr4: 105193251-105193271 | AAAUAAGAAUGUUGGCCUUU | 4564 |
| 54790_2_613 | + | chr4: 105193252-105193272 | AAUAAGAAUGUUGGCCUUUA | 4565 |
| 54790_2_615 | + | chr4: 105193256-105193276 | AGAAUGUUGGCCUUUAGGGC | 4566 |
| 54790_2_618 | + | chr4: 105193261-105193281 | GUUGGCCUUUAGGGCAGGAA | 4567 |
| 54790_2_619 | + | chr4: 105193262-105193282 | UUGGCCUUUAGGGCAGGAAU | 4568 |
| 54790_2_621 | + | chr4: 105193267-105193287 | CUUUAGGGCAGGAAUGGGCC | 4569 |
| 54790_2_626 | + | chr4: 105193273-105193293 | GGCAGGAAUGGGCCAGGCAG | 4570 |
| 54790_2_627 | + | chr4: 105193274-105193294 | GCAGGAAUGGGCCAGGCAGA | 4571 |
| 54790_2_630 | + | chr4: 105193281-105193301 | UGGGCCAGGCAGAGGGCAAG | 4572 |
| 54790_2_632 | + | chr4: 105193282-105193302 | GGGCCAGGCAGAGGGCAAGU | 4573 |
| 54790_2_635 | + | chr4: 105193289-105193309 | GCAGAGGGCAAGUGGGAAGC | 4574 |
| 54790_2_636 | + | chr4: 105193296-105193316 | GCAAGUGGGAAGCAGGAAAA | 4575 |
| 54790_2_637 | + | chr4: 105193321-105193341 | ACCUUGUAUAAAGUUCAUGU | 4576 |
| 54790_2_645 | + | chr4: 105193339-105193359 | GUUGGCAAAUAGAGAGAAGA | 4577 |
| 54790_2_647 | + | chr4: 105193340-105193360 | UUGGCAAAUAGAGAGAAGAU | 4578 |
| 54790_2_650 | + | chr4: 105193348-105193368 | UAGAGAGAAGAUGGGAAAGC | 4579 |
| 54790_2_651 | + | chr4: 105193349-105193369 | AGAGAGAAGAUGGGAAAGCA | 4580 |
| 54790_2_652 | + | chr4: 105193354-105193374 | GAAGAUGGGAAAGCAGGGUA | 4581 |
| 54790_2_659 | + | chr4: 105193417-105193437 | GCAUGCUAUCCUGAAAAUAU | 4582 |
| 54790_2_661 | + | chr4: 105193418-105193438 | CAUGCUAUCCUGAAAAUAUU | 4583 |
| 54790_2_664 | + | chr4: 105193419-105193439 | AUGCUAUCCUGAAAAUAUUG | 4584 |
| 54790_2_670 | + | chr4: 105193446-105193466 | AUUAGAGCAGAUGAGUAGAA | 4585 |
| 54790_2_680 | + | chr4: 105193499-105193519 | UUUACAAAUUUAAACAAAUA | 4586 |
| 54790_2_686 | + | chr4: 105193505-105193525 | AAUUUAAACAAAUAAGGAAA | 4587 |
| 54790_2_688 | + | chr4: 105193508-105193528 | UUAAACAAAUAAGGAAAUGG | 4588 |
| 54790_2_692 | + | chr4: 105193518-105193538 | AAGGAAAUGGAGGCAGUAGU | 4589 |
| 54790_2_695 | + | chr4: 105193529-105193549 | GGCAGUAGUUGGAGUAAUUU | 4590 |
| 54790_2_700 | + | chr4: 105193546-105193566 | UUUAGGAGAUAAAUUGAAAA | 4591 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_709 | + | chr4: 105193565-105193585 | AUGGAUUUGUUAAGAGAGA | 4592 |
| 54790_2_711 | + | chr4: 105193566-105193586 | UGGAUUUGUUAAGAGAGAA | 4593 |
| 54790_2_717 | + | chr4: 105193591-105193611 | GAUAGAUUUAUAUAUUUUA | 4594 |
| 54790_2_724 | + | chr4: 105193604-105193624 | UAUUUUAAGGAAAAAUCAUG | 4595 |
| 54790_2_737 | + | chr4: 105193642-105193662 | GCACGUAAGAGAUAAAAGAG | 4596 |
| 54790_2_741 | + | chr4: 105193689-105193709 | CAAAAUGAUUAAUUACGUGU | 4597 |
| 54790_2_750 | + | chr4: 105193705-105193725 | GUGUUGGUAUUAAAAGAAAU | 4598 |
| 54790_2_751 | + | chr4: 105193706-105193726 | UGUUGGUAUUAAAAGAAAUA | 4599 |
| 54790_2_755 | + | chr4: 105193713-105193733 | AUUAAAGAAAUAGGGAAGU | 4600 |
| 54790_2_757 | + | chr4: 105193714-105193734 | UUAAAGAAAUAGGGAAGUU | 4601 |
| 54790_2_767 | + | chr4: 105193775-105193795 | AUCAGAUGCAGAUAUUCUUA | 4602 |
| 54790_2_770 | + | chr4: 105193808-105193828 | UCAUUUGAUAUUUGUCAUAU | 4603 |
| 54790_2_790 | + | chr4: 105193917-105193937 | UUUGUAUUUUAUAAUAAGU | 4604 |
| 54790_2_806 | + | chr4: 105193949-105193969 | GAAUCAAAAAUUAUUGAUU | 4605 |
| 54790_2_813 | + | chr4: 105193990-105194010 | AGUCCAAUUAGUUCAUUUUG | 4606 |
| 54790_2_817 | + | chr4: 105193994-105194014 | CAAUUAGUUCAUUUUGUGGA | 4607 |
| 54790_2_820 | + | chr4: 105194001-105194021 | UUCAUUUGUGGAAGGAAAA | 4608 |
| 54790_2_829 | + | chr4: 105194058-105194078 | CCUCUAGCUAGUAUCUAACU | 4609 |
| 54790_2_830 | + | chr4: 105194069-105194089 | UAUCUAACUUGGUCUAGCCC | 4610 |
| 54790_2_833 | + | chr4: 105194126-105194146 | AAAUAAUAAAAAAGUAUUAG | 4611 |
| 54790_2_834 | + | chr4: 105194141-105194161 | AUUAGUGGUUUUGUAUUUGC | 4612 |
| 54790_2_838 | + | chr4: 105194152-105194172 | GUAUUUUGCUGGCUUGCUUG | 4613 |
| 54790_2_847 | + | chr4: 105194160-105194180 | CUGGCUUGCUUGUGGAGAAU | 4614 |
| 54790_2_850 | + | chr4: 105194169-105194189 | UUGUGGAGAAUAGGAUUAGA | 4615 |
| 54790_2_892 | + | chr4: 105194367-105194387 | UUUAUCUUUUCAGUAGUAUA | 4616 |
| 54790_2_898 | + | chr4: 105194370-105194390 | AUCUUUUCAGUAGUAUAAGG | 4617 |
| 54790_2_918 | + | chr4: 105194438-105194458 | AGAAAAAUAGCUUUUCUUAU | 4618 |
| 54790_2_925 | + | chr4: 105194462-105194482 | CCAAAAACCAUCACCCUAC | 4619 |
| 54790_2_927 | + | chr4: 105194500-105194520 | UUUGCUUGAUUUUCCUGAUC | 4620 |
| 54790_2_942 | + | chr4: 105194568-105194588 | CUUCAUUGUUACUUCCUUAC | 4621 |
| 54790_2_956 | + | chr4: 105194639-105194659 | CAGUUUAUUCUUUGAGUCAC | 4622 |
| 54790_2_993 | + | chr4: 105194837-105194857 | UCUCCAUUACACAUGCCACA | 4623 |
| 54790_2_996 | + | chr4: 105194891-105194911 | AGCAAAACCACUCUUAUACA | 4624 |
| 54790_2_998 | + | chr4: 105194912-105194932 | GGUGUCUUGCAUAUAUAUUA | 4625 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_1001 | + | chr4: 105194922-105194942 | AUAUAUAUUAAGGCCCAGAG | 4626 |
| 54790_2_1006 | + | chr4: 105194982-105195002 | CAAGACUGUUGACCUUCUUG | 4627 |
| 54790_2_1009 | + | chr4: 105195002-105195022 | UGGCAUUUAUCUGACAACCU | 4628 |
| 54790_2_1035 | + | chr4: 105195166-105195186 | GUUUCAGUUUCCUCAUCAAA | 4629 |
| 54790_2_1042 | + | chr4: 105195197-105195217 | CAGCUGCCUCUGUUGAUCUC | 4630 |
| 54790_2_1048 | + | chr4: 105195216-105195236 | CAGGAUCUUUUAAGUAGAAA | 4631 |
| 54790_2_1061 | + | chr4: 105195273-105195293 | GAAAAUUGCAAUGUAAAUAC | 4632 |
| 54790_2_1074 | + | chr4: 105195348-105195368 | CUCAAAAUGUGAAAAUAGUA | 4633 |
| 54790_2_1092 | + | chr4: 105195450-105195470 | CAGUUGUCCUUCAGUAUCUG | 4634 |
| 54790_2_1095 | + | chr4: 105195451-105195471 | AGUUGUCCUUCAGUAUCUGU | 4635 |
| 54790_2_1097 | + | chr4: 105195458-105195478 | CUUCAGUAUCUGUGGGAGAU | 4636 |
| 54790_2_1100 | + | chr4: 105195465-105195485 | AUCUGUGGGAGAUUGGUUCC | 4637 |
| 54790_2_1102 | + | chr4: 105195476-105195496 | AUUGGUUCCAGGACCCCCCA | 4638 |
| 54790_2_1106 | + | chr4: 105195492-105195512 | CCCAUGGAUAUCAAAAUCUG | 4639 |
| 54790_2_1118 | + | chr4: 105195636-105195656 | GUUAUUACACUGUAUUGUUU | 4640 |
| 54790_2_1120 | + | chr4: 105195637-105195657 | UUAUUACACUGUAUUGUUUA | 4641 |
| 54790_2_1146 | + | chr4: 105195741-105195761 | UUGAUUGAAUCCACAGAUGC | 4642 |
| 54790_2_1152 | + | chr4: 105195760-105195780 | CUGGAAUCCAUGAAUACCCA | 4643 |
| 54790_2_1154 | + | chr4: 105195761-105195781 | UGGAAUCCAUGAAUACCCAU | 4644 |
| 54790_2_1155 | + | chr4: 105195762-105195782 | GGAAUCCAUGAAUACCCAUG | 4645 |
| 54790_2_1157 | + | chr4: 105195763-105195783 | GAAUCCAUGAAUACCCAUGG | 4646 |
| 54790_2_1158 | + | chr4: 105195764-105195784 | AAUCCAUGAAUACCCAUGGG | 4647 |
| 54790_2_1161 | + | chr4: 105195816-105195836 | AAUUUUGUAAUUCUCAACCA | 4648 |
| 54790_2_1167 | + | chr4: 105195840-105195860 | CACGUAUAGUCCUUGAAUCU | 4649 |
| 54790_2_1169 | + | chr4: 105195844-105195864 | UAUAGUCCUUGAAUCUUGGU | 4650 |
| 54790_2_1173 | + | chr4: 105195852-105195872 | UUGAAUCUUGGUAGGAGUCU | 4651 |
| 54790_2_1175 | + | chr4: 105195853-105195873 | UGAAUCUUGGUAGGAGUCUU | 4652 |
| 54790_2_1176 | + | chr4: 105195854-105195874 | GAAUCUUGGUAGGAGUCUUG | 4653 |
| 54790_2_1237 | + | chr4: 105196244-105196264 | UCUUAAUAUCCUUUCUUUUA | 4654 |
| 54790_2_1246 | + | chr4: 105196270-105196290 | CCCAUUUCAGACUUUAUUAA | 4655 |
| 54790_2_1249 | + | chr4: 105196275-105196295 | UUCAGACUUUAUUAAAGGAG | 4656 |
| 54790_2_1261 | + | chr4: 105196325-105196345 | UGAAGUUUUUGCAAUUAGAA | 4657 |
| 54790_2_1268 | + | chr4: 105196336-105196356 | CAAUUAGAAUGGAGUUUAUU | 4658 |
| 54790_2_1279 | + | chr4: 105196371-105196391 | UAGAUGUGAUGUAGAAUUCU | 4659 |
| 54790_2_1281 | + | chr4: 105196372-105196392 | AGAUGUGAUGUAGAAUUCUU | 4660 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_1282 | + | chr4: 105196373-105196393 | GAUGUGAUGUAGAAUUCUUG | 4661 |
| 54790_2_1286 | + | chr4: 105196401-105196421 | UACUUAUCCCCUUUUCAGAG | 4662 |
| 54790_2_1295 | + | chr4: 105196426-105196446 | CUGAAUAGCUCUGUGAACCC | 4663 |
| 54790_2_1302 | + | chr4: 105196504-105196524 | UAUGCUUGAUAUUCCUGAUC | 4664 |
| 54790_2_1303 | + | chr4: 105196511-105196531 | GAUAUUCCUGAUCUGGCUCC | 4665 |
| 54790_2_1330 | + | chr4: 105196665-105196685 | CACAGCUCAGAUUUCUCAUA | 4666 |
| 54790_2_1333 | + | chr4: 105196666-105196686 | ACAGCUCAGAUUUCUCAUAA | 4667 |
| 54790_2_1336 | + | chr4: 105196686-105196706 | GGGAAGCUUCAUAUUUGUUG | 4668 |
| 54790_2_1351 | + | chr4: 105196766-105196786 | UUGCAGAUUCUGAAAUUCCU | 4669 |
| 54790_2_1352 | + | chr4: 105196767-105196787 | UGCAGAUUCUGAAAUUCCUA | 4670 |
| 54790_2_1355 | + | chr4: 105196773-105196793 | UUCUGAAAUUCCUAGGGCAA | 4671 |
| 54790_2_1361 | + | chr4: 105196817-105196837 | CUAAUAUUUUACACAGUAUC | 4672 |
| 54790_2_1366 | + | chr4: 105196829-105196849 | ACAGUAUCUGGUUACAUAGU | 4673 |
| 54790_2_1371 | + | chr4: 105196858-105196878 | AUCAUACAAUUUAAAAGAAG | 4674 |
| 54790_2_1381 | + | chr4: 105196908-105196928 | UUAUUUCCCUCUCCCCCUAC | 4675 |
| 54790_2_1393 | + | chr4: 105196958-105196978 | UACAGCACUUGCCCACUAAG | 4676 |
| 54790_2_1395 | + | chr4: 105196961-105196981 | AGCACUUGCCCACUAAGUGG | 4677 |
| 54790_2_1397 | + | chr4: 105196962-105196982 | GCACUUGCCCACUAAGUGGA | 4678 |
| 54790_2_1400 | + | chr4: 105196968-105196988 | GCCCACUAAGUGGAGGGAAG | 4679 |
| 54790_2_1403 | + | chr4: 105196973-105196993 | CUAAGUGGAGGGAAGAGGUG | 4680 |
| 54790_2_1405 | + | chr4: 105196974-105196994 | UAAGUGGAGGGAAGAGGUGU | 4681 |
| 54790_2_1410 | + | chr4: 105196988-105197008 | AGGUGUGGGAGUCGAGUAGU | 4682 |
| 54790_2_1415 | + | chr4: 105197041-105197061 | UUUGCAAAGUUACAUUAUAU | 4683 |
| 54790_2_1424 | + | chr4: 105197084-105197104 | UUAAUUAUAAGCAACACUUG | 4684 |
| 54790_2_1440 | + | chr4: 105197159-105197179 | UGUUGCAGUUGAGAUUUGUG | 4685 |
| 54790_2_1447 | + | chr4: 105197183-105197203 | UUUAGCUAUUUAGAGACUUU | 4686 |
| 54790_2_1449 | + | chr4: 105197184-105197204 | UUAGCUAUUUAGAGACUUUA | 4687 |
| 54790_2_1475 | + | chr4: 105197288-105197308 | AAUGAUAUUUGAUGUCUAUU | 4688 |
| 54790_2_1499 | + | chr4: 105197412-105197432 | UUUUCUUAUCCAGCAGUUUU | 4689 |
| 54790_2_1518 | + | chr4: 105197451-105197471 | ACUGUCAGAGAAGCAGAAAG | 4690 |
| 54790_2_1520 | + | chr4: 105197458-105197478 | GAGAAGCAGAAAGUGGUCAG | 4691 |
| 54790_2_1523 | + | chr4: 105197473-105197493 | GUCAGUGGACUUUAGAAUGU | 4692 |
| 54790_2_1526 | + | chr4: 105197483-105197503 | UUUAGAAUGUAGGCUCUUGU | 4693 |
| 54790_2_1528 | + | chr4: 105197486-105197506 | AGAAUGUAGGCUCUUGUAGG | 4694 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_1533 | + | chr4: 105197512-105197532 | UAUGUUUGAGAGUGCUGUCC | 4695 |
| 54790_2_1536 | + | chr4: 105197527-105197547 | UGUCCAGGUGCUUUGUGAUG | 4696 |
| 54790_2_1541 | + | chr4: 105197537-105197557 | CUUUGUGAUGUGGCUGAGAA | 4697 |
| 54790_2_1544 | + | chr4: 105197544-105197564 | AUGUGGCUGAGAAUGGAUGC | 4698 |
| 54790_2_1546 | + | chr4: 105197552-105197572 | GAGAAUGGAUGCAGGCUUGC | 4699 |
| 54790_2_1548 | + | chr4: 105197553-105197573 | AGAAUGGAUGCAGGCUUGCA | 4700 |
| 54790_2_1554 | + | chr4: 105197591-105197611 | AGAUCUCUAGAGAGCAUUUU | 4701 |
| 54790_2_1558 | + | chr4: 105197611-105197631 | AGGAAAGACUUCUAAGCUUU | 4702 |
| 54790_2_1567 | + | chr4: 105197662-105197682 | CUUAAUAUCCAUAGCUAUAG | 4703 |
| 54790_2_1574 | + | chr4: 105197708-105197728 | AAAUGUAGAAUUAAAUAUUU | 4704 |
| 54790_2_1587 | + | chr4: 105197778-105197798 | UAAUGAAAUAUAAAACCAGA | 4705 |
| 54790_2_1589 | + | chr4: 105197789-105197809 | AAAACCAGAUGGUCUCUGAA | 4706 |
| 54790_2_1595 | + | chr4: 105197819-105197839 | CUUUACUCACUUUCAGAGUA | 4707 |
| 54790_2_1600 | + | chr4: 105197824-105197844 | CUCACUUUCAGAGUAAGGCA | 4708 |
| 54790_2_1656 | + | chr4: 105198032-105198052 | AGUAUUUAAUAAAUGUUUUU | 4709 |
| 54790_2_1657 | + | chr4: 105198033-105198053 | GUAUUUAAUAAAUGUUUUUU | 4710 |
| 54790_2_1658 | + | chr4: 105198038-105198058 | UAAUAAAUGUUUUUUGGGCC | 4711 |
| 54790_2_1662 | + | chr4: 105198043-105198063 | AAUGUUUUUUGGGCCAGGUG | 4712 |
| 54790_2_1669 | + | chr4: 105198073-105198093 | CUCCUGUAAUCCCAGCAAUU | 4713 |
| 54790_2_1671 | + | chr4: 105198074-105198094 | UCCUGUAAUCCCAGCAAUUU | 4714 |
| 54790_2_1673 | + | chr4: 105198077-105198097 | UGUAAUCCCAGCAAUUUGGG | 4715 |
| 54790_2_1675 | + | chr4: 105198083-105198103 | CCCAGCAAUUUGGGAGGCCG | 4716 |
| 54790_2_1677 | + | chr4: 105198086-105198106 | AGCAAUUUGGGAGGCCGAGG | 4717 |
| 54790_2_1678 | + | chr4: 105198087-105198107 | GCAAUUUGGGAGGCCGAGGC | 4718 |
| 54790_2_1680 | + | chr4: 105198090-105198110 | AUUUGGGAGGCCGAGGCGGG | 4719 |
| 54790_2_1684 | + | chr4: 105198101-105198121 | CGAGGCGGGUGGAUCACCUG | 4720 |
| 54790_2_1687 | + | chr4: 105198133-105198153 | UGAGACCAGCCUGACCAGUA | 4721 |
| 54790_2_1692 | + | chr4: 105198171-105198191 | ACUAAAAAUGCAAAAUUAGC | 4722 |
| 54790_2_1695 | + | chr4: 105198172-105198192 | CUAAAAAUGCAAAAUUAGCU | 4723 |
| 54790_2_1696 | + | chr4: 105198173-105198193 | UAAAAAUGCAAAAUUAGCUG | 4724 |
| 54790_2_1697 | + | chr4: 105198174-105198194 | AAAAAUGCAAAAUUAGCUGG | 4725 |
| 54790_2_1698 | + | chr4: 105198177-105198197 | AAUGCAAAAUUAGCUGGGGG | 4726 |
| 54790_2_1699 | + | chr4: 105198180-105198200 | GCAAAAUUAGCUGGGGGUGG | 4727 |
| 54790_2_1702 | + | chr4: 105198207-105198227 | UGCCUAUAAUACCAGCUACU | 4728 |
| 54790_2_1705 | + | chr4: 105198208-105198228 | GCCUAUAAUACCAGCUACUC | 4729 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_1706 | + | chr4: 105198211-105198231 | UAUAAUACCAGCUACUCGGG | 4730 |
| 54790_2_1708 | + | chr4: 105198217-105198237 | ACCAGCUACUCGGGAGGCUG | 4731 |
| 54790_2_1710 | + | chr4: 105198221-105198241 | GCUACUCGGGAGGCUGAGGC | 4732 |
| 54790_2_1713 | + | chr4: 105198222-105198242 | CUACUCGGGAGGCUGAGGCA | 4733 |
| 54790_2_1715 | + | chr4: 105198223-105198243 | UACUCGGGAGGCUGAGGCAG | 4734 |
| 54790_2_1718 | + | chr4: 105198240-105198260 | CAGGGGAAUCGCUUGAACUC | 4735 |
| 54790_2_1720 | + | chr4: 105198243-105198263 | GGGAAUCGCUUGAACUCAGG | 4736 |
| 54790_2_1723 | + | chr4: 105198246-105198266 | AAUCGCUUGAACUCAGGAGG | 4737 |
| 54790_2_1724 | + | chr4: 105198249-105198269 | CGCUUGAACUCAGGAGGUGG | 4738 |
| 54790_2_1734 | + | chr4: 105198369-105198389 | AAUGCUUUUGAUUUAACGA | 4739 |
| 54790_2_1744 | + | chr4: 105198390-105198410 | GGUGUCAUUGUCCUAUGAAA | 4740 |
| 54790_2_1752 | + | chr4: 105198440-105198460 | CUUAGCUUUUGAUAAUGAUA | 4741 |
| 54790_2_1768 | + | chr4: 105198524-105198544 | AAAUAUUUGAGACCAGUUAA | 4742 |
| 54790_2_1774 | + | chr4: 105198534-105198554 | GACCAGUUAAAGGAGACAGA | 4743 |
| 54790_2_1778 | + | chr4: 105198543-105198563 | AAGGAGACAGAAGGAAGUUA | 4744 |
| 54790_2_1786 | + | chr4: 105198571-105198591 | GAAGCAGUAGCCAGAAAAUA | 4745 |
| 54790_2_1787 | + | chr4: 105198572-105198592 | AAGCAGUAGCCAGAAAAUAA | 4746 |
| 54790_2_1803 | + | chr4: 105198638-105198658 | AAAUUGCUAUUAUUAUCAUC | 4747 |
| 54790_2_1808 | + | chr4: 105198657-105198677 | CUGGAAAAAUAUGCCUUGU | 4748 |
| 54790_2_1814 | + | chr4: 105198694-105198714 | AUUCCCUUUCCAUACCAUGC | 4749 |
| 54790_2_1820 | + | chr4: 105198721-105198741 | UUCUUUACUGCAUUCCUAAG | 4750 |
| 54790_2_1826 | + | chr4: 105198742-105198762 | GGACUAGUCUAGCACCUAAU | 4751 |
| 54790_2_1827 | + | chr4: 105198752-105198772 | AGCACCUAAUUGGAUACUUG | 4752 |
| 54790_2_1830 | + | chr4: 105198762-105198782 | UGGAUACUUGUGGUAAUAUU | 4753 |
| 54790_2_1832 | + | chr4: 105198763-105198783 | GGAUACUUGUGGUAAUAUUU | 4754 |
| 54790_2_1835 | + | chr4: 105198778-105198798 | UAUUUGGGAACUCACUGAUC | 4755 |
| 54790_2_1839 | + | chr4: 105198791-105198811 | ACUGAUCUGGUACAUCAGUG | 4756 |
| 54790_2_1842 | + | chr4: 105198792-105198812 | CUGAUCUGGUACAUCAGUGU | 4757 |
| 54790_2_1875 | + | chr4: 105198979-105198999 | UGUUGCAGUUGAGAGUUGUG | 4758 |
| 54790_2_1880 | + | chr4: 105198993-105199013 | GUUGUGAGGUUUUAGCUAUU | 4759 |
| 54790_2_1884 | + | chr4: 105199003-105199023 | UUUAGCUAUUUGGAAACUUU | 4760 |
| 54790_2_1885 | + | chr4: 105199004-105199024 | UUAGCUAUUUGGAAACUUUA | 4761 |
| 54790_2_1913 | + | chr4: 105199106-105199126 | GAGCAAGAAUCUGUCACUCU | 4762 |
| 54790_2_1919 | + | chr4: 105199134-105199154 | UACUCUUUAUUAAAGAAUGU | 4763 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_1923 | + | chr4: 105199154-105199174 | UGGAUUCAUUUAUAACUUAC | 4764 |
| 54790_2_1929 | + | chr4: 105199176-105199196 | GUCCCUUAAAUAUUAAAGUU | 4765 |
| 54790_2_1930 | + | chr4: 105199183-105199203 | AAAUAUUAAAGUUUGGUGUU | 4766 |
| 54790_2_1938 | + | chr4: 105199212-105199232 | AAACAUGAUUACAUCCUUAU | 4767 |
| 54790_2_1940 | + | chr4: 105199213-105199233 | AACAUGAUUACAUCCUUAUA | 4768 |
| 54790_2_1944 | + | chr4: 105199232-105199252 | AGGGCUCUCUUCUAAUUGCC | 4769 |
| 54790_2_1958 | + | chr4: 105199326-105199346 | ACAUUGAAGUUAGUCCGCAA | 4770 |
| 54790_2_1961 | + | chr4: 105199345-105199365 | AAGGUUUUGUCUUUUUUUC | 4771 |
| 54790_2_1978 | + | chr4: 105199413-105199433 | GUGAUUUCUAAAUAAAUGU | 4772 |
| 54790_2_1995 | + | chr4: 105199472-105199492 | UUCUUCAAGUCCCUCCUUUA | 4773 |
| 54790_2_2001 | + | chr4: 105199482-105199502 | CCCUCCUUUAAGGAAAUUUA | 4774 |
| 54790_2_2007 | + | chr4: 105199508-105199528 | UCUUUUCCAUACCAUCAAG | 4775 |
| 54790_2_2018 | + | chr4: 105199543-105199563 | UAACUUUUUUCCUUAAGUUC | 4776 |
| 54790_2_2027 | + | chr4: 105199557-105199577 | AAGUUCAGGAGUACACGUGC | 4777 |
| 54790_2_2030 | + | chr4: 105199570-105199590 | CACGUGCAGGUUUGUUGCAU | 4778 |
| 54790_2_2032 | + | chr4: 105199579-105199599 | GUUUGUUGCAUAGGCAACCU | 4779 |
| 54790_2_2033 | + | chr4: 105199580-105199600 | UUUGUUGCAUAGGCAACCUU | 4780 |
| 54790_2_2037 | + | chr4: 105199586-105199606 | GCAUAGGCAACCUUGGGUCA | 4781 |
| 54790_2_2039 | + | chr4: 105199587-105199607 | CAUAGGCAACCUUGGGUCAU | 4782 |
| 54790_2_2043 | + | chr4: 105199602-105199622 | GUCAUGGGAGUUUGUUGUAC | 4783 |
| 54790_2_2046 | + | chr4: 105199619-105199639 | UACAGGUUAUUUCAUCACCC | 4784 |
| 54790_2_2058 | + | chr4: 105199690-105199710 | CCCACCCUCCACCCUCUGAU | 4785 |
| 54790_2_2059 | + | chr4: 105199696-105199716 | CUCCACCCUCUGAUAGGCCC | 4786 |
| 54790_2_2067 | + | chr4: 105199773-105199793 | AAGUGAGAACAUGCAGUAUU | 4787 |
| 54790_2_2074 | + | chr4: 105199802-105199822 | GUUCCUAUGUUAGUUUGCUA | 4788 |
| 54790_2_2076 | + | chr4: 105199809-105199829 | UGUUAGUUUGCUAUGGAUAA | 4789 |
| 54790_2_2080 | + | chr4: 105199863-105199883 | CAUGAUCUUAUUCUCUUAUA | 4790 |
| 54790_2_2083 | + | chr4: 105199881-105199901 | UAUGGCUGCAUGUUAUUCCA | 4791 |
| 54790_2_2087 | + | chr4: 105199923-105199943 | UUUUUUAUCCAGUCUAUUAU | 4792 |
| 54790_2_2093 | + | chr4: 105199926-105199946 | UUUAUCCAGUCUAUUAUUGG | 4793 |
| 54790_2_2095 | + | chr4: 105199927-105199947 | UUAUCCAGUCUAUUAUUGGU | 4794 |
| 54790_2_2099 | + | chr4: 105199935-105199955 | UCUAUUAUUGGUGGGCAUUU | 4795 |
| 54790_2_2108 | + | chr4: 105199966-105199986 | AUGUCUUUGCUAUUGUGAAU | 4796 |
| 54790_2_2117 | + | chr4: 105200026-105200046 | AGAAUAAUUUUUUUUUCCUU | 4797 |
| 54790_2_2128 | + | chr4: 105200043-105200063 | CUUUGGUAUAUACCCAGUAG | 4798 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_2129 | + | chr4: 105200044-105200064 | UUUGGUAUAUACCCAGUAGU | 4799 |
| 54790_2_2130 | + | chr4: 105200045-105200065 | UUGGUAUAUACCCAGUAGUG | 4800 |
| 54790_2_2134 | + | chr4: 105200052-105200072 | AUACCCAGUAGUGGGGUUGC | 4801 |
| 54790_2_2135 | + | chr4: 105200053-105200073 | UACCCAGUAGUGGGGUUGCU | 4802 |
| 54790_2_2139 | + | chr4: 105200077-105200097 | UGAAUAGUAUUUCUGUCUUG | 4803 |
| 54790_2_2144 | + | chr4: 105200086-105200106 | UUUCUGUCUUGAGGUCUUUG | 4804 |
| 54790_2_2150 | + | chr4: 105200112-105200132 | CGCUACACUGUCUUCCACAA | 4805 |
| 54790_2_2168 | + | chr4: 105200218-105200238 | UUAAUAAUAGCCGUCCUGAC | 4806 |
| 54790_2_2174 | + | chr4: 105200228-105200248 | CCGUCCUGACUGGUGUGAGA | 4807 |
| 54790_2_2175 | + | chr4: 105200241-105200261 | UGUGAGAUGGUAUCUCAUUG | 4808 |
| 54790_2_2186 | + | chr4: 105200301-105200321 | GCUUUAUUUCAUAUGUUUGU | 4809 |
| 54790_2_2201 | + | chr4: 105200362-105200382 | UCCUUUGCCCACUUUUUCAA | 4810 |
| 54790_2_2202 | + | chr4: 105200363-105200383 | CCUUUGCCCACUUUUUCAAU | 4811 |
| 54790_2_2204 | + | chr4: 105200364-105200384 | CUUUGCCCACUUUUUCAAUG | 4812 |
| 54790_2_2224 | + | chr4: 105200419-105200439 | UUUAAGAUCCUUAUAGAUGC | 4813 |
| 54790_2_2230 | + | chr4: 105200469-105200489 | AAAUUUUCUCCCAUUCUGU | 4814 |
| 54790_2_2257 | + | chr4: 105200560-105200580 | UGUGAAUUUUGCUAUGAAC | 4815 |
| 54790_2_2264 | + | chr4: 105200597-105200617 | UAUGUUUAAUUUUAACUCCC | 4816 |
| 54790_2_2290 | + | chr4: 105200657-105200677 | UGUUUUGUUUUGUUUUU | 4817 |
| 54790_2_2298 | + | chr4: 105200663-105200683 | UGUUUUGUUUUUUGGAGA | 4818 |
| 54790_2_2312 | + | chr4: 105200687-105200707 | GUCUCACGCUGUCACCAGUC | 4819 |
| 54790_2_2314 | + | chr4: 105200694-105200714 | GCUGUCACCAGUCUGGAGUG | 4820 |
| 54790_2_2315 | + | chr4: 105200708-105200728 | GGAGUGUGGUGAUACAAUCU | 4821 |
| 54790_2_2318 | + | chr4: 105200732-105200752 | UCAUUGCAACCUCCACAUUC | 4822 |
| 54790_2_2319 | + | chr4: 105200733-105200753 | CAUUGCAACCUCCACAUUCC | 4823 |
| 54790_2_2328 | + | chr4: 105200772-105200792 | GCCUCAGCCUCCUGAGUAGC | 4824 |
| 54790_2_2329 | + | chr4: 105200773-105200793 | CCUCAGCCUCCUGAGUAGCU | 4825 |
| 54790_2_2330 | + | chr4: 105200781-105200801 | UCCUGAGUAGCUGGGACUAC | 4826 |
| 54790_2_2333 | + | chr4: 105200828-105200848 | UUUUGUAUUUUAGUAAAGA | 4827 |
| 54790_2_2334 | + | chr4: 105200829-105200849 | UUUGUAUUUUAGUAAAGAU | 4828 |
| 54790_2_2335 | + | chr4: 105200830-105200850 | UUGUAUUUUAGUAAAGAUG | 4829 |
| 54790_2_2344 | + | chr4: 105200844-105200864 | AAGAUGGGGUUUCACCAUGU | 4830 |
| 54790_2_2346 | + | chr4: 105200849-105200869 | GGGGUUUCACCAUGUUGGCC | 4831 |
| 54790_2_2347 | + | chr4: 105200853-105200873 | UUUCACCAUGUUGGCCAGGA | 4832 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_2_2354 | + | chr4: 105200905-105200925 | GCCUCAGCCUCCCAAAGUGC | 4833 |
| 54790_2_2356 | + | chr4: 105200906-105200926 | CCUCAGCCUCCCAAAGUGCU | 4834 |
| 54790_2_2357 | + | chr4: 105200914-105200934 | UCCCAAAGUGCUGGGAUUAC | 4835 |
| 54790_2_2360 | + | chr4: 105200933-105200953 | CAGGCUUGAGCCACCACACC | 4836 |
| 54790_2_2361 | + | chr4: 105200940-105200960 | GAGCCACCACACCUGGCCCC | 4837 |
| 54790_2_2371 | + | chr4: 105200983-105201003 | AGAAAAAGAUUGACUUCAC | 4838 |
| 54790_2_2391 | + | chr4: 105201067-105201087 | UGAGUUACUUGAUAAUACCA | 4839 |
| 54790_2_2400 | + | chr4: 105201105-105201125 | UUGAAUCCUUCAACCCCUUG | 4840 |
| 54790_2_2423 | + | chr4: 105201204-105201224 | CUUGAUACAUUUUUUAAAGC | 4841 |
| 54790_2_2432 | + | chr4: 105201250-105201270 | UUAUCUCUUCUUCAAAAAAA | 4842 |
| 54790_2_2438 | + | chr4: 105201281-105201301 | CCCCCACAAAUGUGUAAUUU | 4843 |
| 54790_2_2441 | + | chr4: 105201297-105201317 | AUUUAGGAAUUGUUUUCUAU | 4844 |
| 54790_2_2445 | + | chr4: 105201302-105201322 | GGAAUUGUUUUCUAUUGGAG | 4845 |
| 54790_2_2453 | + | chr4: 105201338-105201358 | AUUUAGUUGCUCUAAUGCA | 4846 |
| 54790_2_2460 | + | chr4: 105201359-105201379 | GGUGUUUCCUAAAAAGUUUA | 4847 |
| 54790_2_2471 | + | chr4: 105201405-105201425 | AUGAUAGUAAAUAAUACAAU | 4848 |
| 54790_2_2474 | + | chr4: 105201406-105201426 | UGAUAGUAAAUAAUACAAUA | 4849 |
| 54790_2_2475 | + | chr4: 105201407-105201427 | GAUAGUAAAUAAUACAAUAG | 4850 |
| 54790_2_2476 | + | chr4: 105201408-105201428 | AUAGUAAAUAAUACAAUAGG | 4851 |
| 54790_2_2493 | + | chr4: 105201519-105201539 | AAAUCAAACAGUUCCACAAG | 4852 |
| 54790_2_2508 | + | chr4: 105201572-105201592 | UUUUAAACUUAACCUUACUG | 4853 |
| 54790_2_2510 | + | chr4: 105201573-105201593 | UUUAAACUUAACCUUACUGA | 4854 |
| 54790_2_2511 | + | chr4: 105201574-105201594 | UUAAACUUAACCUUACUGAG | 4855 |
| 54790_2_2517 | + | chr4: 105201582-105201602 | AACCUUACUGAGGGGUUUUA | 4856 |
| 54790_2_2526 | + | chr4: 105201629-105201649 | GCAAAGUAUAAAGUAAUAGA | 4857 |
| 54790_2_2528 | + | chr4: 105201643-105201663 | AAUAGAAGGUUACCAAGUUG | 4858 |
| 54790_2_2534 | + | chr4: 105201678-105201698 | UAGUGCCAAUACAGUUAAAA | 4859 |
| 54790_2_2539 | + | chr4: 105201706-105201726 | UUAACAGAACAUCUUCAUCC | 4860 |
| 54790_2_2552 | + | chr4: 105201743-105201763 | UUUUUUUUUUUUUUCAGAC | 4861 |
| 54790_2_2553 | + | chr4: 105201744-105201764 | UUUUUUUUUUUUUCAGACA | 4862 |
| 54790_2_2571 | + | chr4: 105201770-105201790 | CACUCCGUUGCCCAGACUG | 4863 |
| 54790_2_2573 | + | chr4: 105201778-105201798 | UUGCCCAGACUGCGGUGCAG | 4864 |
| 54790_2_2576 | + | chr4: 105201789-105201809 | GCGGUGCAGUGGCCUGAUUG | 4865 |
| 54790_2_2578 | + | chr4: 105201814-105201834 | CACUGCAGCCUCAACUUCCC | 4866 |
| 54790_2_2579 | + | chr4: 105201820-105201840 | AGCCUCAACUUCCCAGGCUC | 4867 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_2584 | + | chr4: 105201862-105201882 | UCCAGAGUAGCUGAGACCAC | 4868 |
| 54790_2_2586 | + | chr4: 105201863-105201883 | CCAGAGUAGCUGAGACCACA | 4869 |
| 54790_2_2588 | + | chr4: 105201864-105201884 | CAGAGUAGCUGAGACCACAG | 4870 |
| 54790_2_2589 | + | chr4: 105201881-105201901 | CAGGGGCAUGCCACCACCCC | 4871 |
| 54790_2_2592 | + | chr4: 105201911-105201931 | UUUGUAUUUUUGUAGAGAC | 4872 |
| 54790_2_2595 | + | chr4: 105201912-105201932 | UUGUAUUUUUGUAGAGACA | 4873 |
| 54790_2_2604 | + | chr4: 105201931-105201951 | AGGGUUUUGCCAUGUUGCCC | 4874 |
| 54790_2_2609 | + | chr4: 105201949-105201969 | CCAGGCUGUUCGCAAACUCC | 4875 |
| 54790_2_2611 | + | chr4: 105201973-105201993 | CUCAAGCAAUCCACCUGCCU | 4876 |
| 54790_2_2613 | + | chr4: 105201989-105202009 | GCCUCGGCUUCCCAAAGUGC | 4877 |
| 54790_2_2617 | + | chr4: 105201997-105202017 | UUCCCAAAGUGCUGGAAUUA | 4878 |
| 54790_2_2619 | + | chr4: 105201998-105202018 | UCCCAAAGUGCUGGAAUUAU | 4879 |
| 54790_2_2625 | + | chr4: 105202026-105202046 | GCUGCCACACCCAGCCCCUC | 4880 |
| 54790_2_2628 | + | chr4: 105202058-105202078 | AUUACCAACUUCUGUCUUCC | 4881 |
| 54790_2_2633 | + | chr4: 105202073-105202093 | CUUCCAGGUUUUUAUGUCCU | 4882 |
| 54790_2_2641 | + | chr4: 105202096-105202116 | AAAUUUAUGCAUAUUUUUAG | 4883 |
| 54790_2_2659 | + | chr4: 105202216-105202236 | AUACUUUAACUUAUUAUAGA | 4884 |
| 54790_2_2665 | + | chr4: 105202232-105202252 | UAGAAGGCUUACAAAAACUG | 4885 |
| 54790_2_2691 | + | chr4: 105202391-105202411 | GUGAAGCAGCGAAUUUCUAG | 4886 |
| 54790_2_2693 | + | chr4: 105202395-105202415 | AGCAGCGAAUUUCUAGAGGC | 4887 |
| 54790_2_2694 | + | chr4: 105202396-105202416 | GCAGCGAAUUUCUAGAGGCU | 4888 |
| 54790_2_2697 | + | chr4: 105202409-105202429 | AGAGGCUGGGUUCACGCUUC | 4889 |
| 54790_2_2699 | + | chr4: 105202425-105202445 | CUUCAGGUCCUCUAAAUCCU | 4890 |
| 54790_2_2717 | + | chr4: 105202527-105202547 | AAUUUUUAUUGAACAAAUAC | 4891 |
| 54790_2_2730 | + | chr4: 105202566-105202586 | CUCAUUGCUCUUGAAUACAU | 4892 |
| 54790_2_2741 | + | chr4: 105202606-105202626 | UGAAAUUCUGUUUUCCUUAA | 4893 |
| 54790_2_2745 | + | chr4: 105202620-105202640 | CCUUAAAGGCAGUCAUUUUU | 4894 |
| 54790_2_2756 | + | chr4: 105202670-105202690 | UAGUAACAUCAUAACUUCAG | 4895 |
| 54790_2_2765 | + | chr4: 105202718-105202738 | AUAUGCCUACUUUUCAUAUC | 4896 |
| 54790_2_2789 | + | chr4: 105202806-105202826 | AAUUGCUGUCAACAAAGUAG | 4897 |
| 54790_2_2794 | + | chr4: 105202849-105202869 | UUCAUUGUGAAAACAUGAAA | 4898 |
| 54790_2_2798 | + | chr4: 105202868-105202888 | AUGGCUGUUAACUAUACAUC | 4899 |
| 54790_2_2802 | + | chr4: 105202883-105202903 | ACAUCAGGCAAAAUAAAAAC | 4900 |
| 54790_2_2805 | + | chr4: 105202902-105202922 | CAGGAAAUAUAAACAUUUCC | 4901 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_2807 | + | chr4: 105202908-105202928 | AUAUAAACAUUUCCUGGAAC | 4902 |
| 54790_2_2808 | + | chr4: 105202909-105202929 | UAUAAACAUUUCCUGGAACA | 4903 |
| 54790_2_2813 | + | chr4: 105202928-105202948 | AGGGCAGAGUAUGAGUAAUA | 4904 |
| 54790_2_2815 | + | chr4: 105202944-105202964 | AAUAAGGUAUCAAAUAUAAU | 4905 |
| 54790_2_2824 | + | chr4: 105202988-105203008 | AAUGUCUUAAGAAAUGUCAC | 4906 |
| 54790_2_2828 | + | chr4: 105202997-105203017 | AGAAAUGUCACUGGAAAGAC | 4907 |
| 54790_2_2831 | + | chr4: 105203006-105203026 | ACUGGAAAGACUGGAGUACU | 4908 |
| 54790_2_2838 | + | chr4: 105203049-105203069 | UUGAUUCCUAACACUGUGCU | 4909 |
| 54790_2_2843 | + | chr4: 105203056-105203076 | CUAACACUGUGCUUGGCACA | 4910 |
| 54790_2_2844 | + | chr4: 105203060-105203080 | CACUGUGCUUGGCACAUGGU | 4911 |
| 54790_2_2847 | + | chr4: 105203081-105203101 | GGUAAUUAAUAAAUGUGUGA | 4912 |
| 54790_2_2855 | + | chr4: 105203123-105203143 | CAAUUAGUGACUAAGAGAGU | 4913 |
| 54790_2_2858 | + | chr4: 105203128-105203148 | AGUGACUAAGAGAGUUGGAA | 4914 |
| 54790_2_2859 | + | chr4: 105203129-105203149 | GUGACUAAGAGAGUUGGAAA | 4915 |
| 54790_2_2862 | + | chr4: 105203147-105203167 | AAGGGCUAUCAAUUUCAAAU | 4916 |
| 54790_2_2871 | + | chr4: 105203178-105203198 | AGACAUUUUUACGUAAGAUU | 4917 |
| 54790_2_2872 | + | chr4: 105203179-105203199 | GACAUUUUUACGUAAGAUUU | 4918 |
| 54790_2_2888 | + | chr4: 105203250-105203270 | CCAUUCCUACAUUGACCAUG | 4919 |
| 54790_2_2891 | + | chr4: 105203262-105203282 | UGACCAUGUGGACUCAUAUU | 4920 |
| 54790_2_2901 | + | chr4: 105203304-105203324 | AUAAACAAAGCACCAAAAGU | 4921 |
| 54790_2_2904 | + | chr4: 105203310-105203330 | AAAGCACCAAAAGUUGGAAA | 4922 |
| 54790_2_2906 | + | chr4: 105203323-105203343 | UUGGAAAAGGAAGUAGUAGU | 4923 |
| 54790_2_2911 | + | chr4: 105203328-105203348 | AAAGGAAGUAGUAGUAGGAG | 4924 |
| 54790_2_2912 | + | chr4: 105203329-105203349 | AAGGAAGUAGUAGUAGGAGA | 4925 |
| 54790_2_2914 | + | chr4: 105203351-105203371 | GUUUUAAGCUAUGUAUUUAC | 4926 |
| 54790_2_2917 | + | chr4: 105203352-105203372 | UUUUAAGCUAUGUAUUUACU | 4927 |
| 54790_2_2934 | + | chr4: 105203409-105203429 | UAAACAGUACUGUAAUCACU | 4928 |
| 54790_2_2935 | + | chr4: 105203410-105203430 | AAACAGUACUGUAAUCACUU | 4929 |
| 54790_2_2940 | + | chr4: 105203439-105203459 | AUGUGCUUUGUGUCAGACAA | 4930 |
| 54790_2_2951 | + | chr4: 105203495-105203515 | AAUACAUUACAUUACACAGA | 4931 |
| 54790_2_2953 | + | chr4: 105203496-105203516 | AUACAUUACAUUACACAGAA | 4932 |
| 54790_2_2956 | + | chr4: 105203505-105203525 | AUUACACAGAAGGGAGUGCC | 4933 |
| 54790_2_2966 | + | chr4: 105203560-105203580 | AAUACAUUACAUUACACAGA | 4934 |
| 54790_2_2969 | + | chr4: 105203561-105203581 | AUACAUUACAUUACACAGAA | 4935 |
| 54790_2_2971 | + | chr4: 105203570-105203590 | AUUACACAGAAGGGAGUGCC | 4936 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_2982 | + | chr4: 105203625-105203645 | AAUACAUUACAUUACACAGA | 4937 |
| 54790_2_2984 | + | chr4: 105203626-105203646 | AUACAUUACAUUACACAGAA | 4938 |
| 54790_2_2986 | + | chr4: 105203635-105203655 | AUUACACAGAAGGGAGUGCC | 4939 |
| 54790_2_2990 | + | chr4: 105203641-105203661 | CAGAAGGGAGUGCCUGGCUU | 4940 |
| 54790_2_2991 | + | chr4: 105203642-105203662 | AGAAGGGAGUGCCUGGCUUU | 4941 |
| 54790_2_2996 | + | chr4: 105203689-105203709 | CAUAGCACAAUGCUGCCAUA | 4942 |
| 54790_2_2997 | + | chr4: 105203693-105203713 | GCACAAUGCUGCCAUACGGU | 4943 |
| 54790_2_2999 | + | chr4: 105203713-105203733 | AGGUAAUACCAAGACAAAUC | 4944 |
| 54790_2_3000 | + | chr4: 105203714-105203734 | GGUAAUACCAAGACAAAUCA | 4945 |
| 54790_2_3003 | + | chr4: 105203735-105203755 | GGCCGUUAUUAACAACCUUG | 4946 |
| 54790_2_3007 | + | chr4: 105203746-105203766 | ACAACCUUGAGGAAAUGUCU | 4947 |
| 54790_2_3011 | + | chr4: 105203747-105203767 | CAACCUUGAGGAAAUGUCUU | 4948 |
| 54790_2_3018 | + | chr4: 105203783-105203803 | AUUUUUGUUUAAUUAUAAUA | 4949 |
| 54790_2_3028 | + | chr4: 105203823-105203843 | AAGUCAUCCCAAACUCUUCG | 4950 |
| 54790_2_3033 | + | chr4: 105203868-105203888 | CUGUUUUUAAUGUUUCUAA | 4951 |
| 54790_2_3044 | + | chr4: 105203897-105203917 | UGUAUAAUCUAUUAGAAAAC | 4952 |
| 54790_2_3045 | + | chr4: 105203910-105203930 | AGAAAACUGGCCAAGUGCAG | 4953 |
| 54790_2_3049 | + | chr4: 105203937-105203957 | UGCCUGUAAUCGCAGCACUU | 4954 |
| 54790_2_3050 | + | chr4: 105203938-105203958 | GCCUGUAAUCGCAGCACUUU | 4955 |
| 54790_2_3052 | + | chr4: 105203941-105203961 | UGUAAUCGCAGCACUUUGGG | 4956 |
| 54790_2_3053 | + | chr4: 105203947-105203967 | CGCAGCACUUUGGGAGGCCA | 4957 |
| 54790_2_3055 | + | chr4: 105203950-105203970 | AGCACUUUGGGAGGCCAAGG | 4958 |
| 54790_2_3056 | + | chr4: 105203951-105203971 | GCACUUUGGGAGGCCAAGGC | 4959 |
| 54790_2_3060 | + | chr4: 105203965-105203985 | CAAGGCGGGUAGAUUACCUG | 4960 |
| 54790_2_3063 | + | chr4: 105203970-105203990 | CGGGUAGAUUACCUGAGGUC | 4961 |
| 54790_2_3066 | + | chr4: 105203997-105204017 | UGAGACCAGCCUAGCCAAUA | 4962 |
| 54790_2_3070 | + | chr4: 105204035-105204055 | UAAAAUACAAAAAUUAGCC | 4963 |
| 54790_2_3071 | + | chr4: 105204043-105204063 | CAAAAUUAGCCAGGCGUAG | 4964 |
| 54790_2_3074 | + | chr4: 105204071-105204091 | GCCUGUAAUCCCAGCUACUC | 4965 |
| 54790_2_3076 | + | chr4: 105204074-105204094 | UGUAAUCCCAGCUACUCAGG | 4966 |
| 54790_2_3078 | + | chr4: 105204080-105204100 | CCCAGCUACUCAGGAGGCUG | 4967 |
| 54790_2_3081 | + | chr4: 105204084-105204104 | GCUACUCAGGAGGCUGAGGC | 4968 |
| 54790_2_3086 | + | chr4: 105204102-105204122 | GCAGGAGAAUCUCUUGAACC | 4969 |
| 54790_2_3088 | + | chr4: 105204103-105204123 | CAGGAGAAUCUCUUGAACCC | 4970 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_3090 | + | chr4: 105204106-105204126 | GAGAAUCUCUUGAACCCGGG | 4971 |
| 54790_2_3092 | + | chr4: 105204111-105204131 | UCUCUUGAACCCGGGAGGCG | 4972 |
| 54790_2_3099 | + | chr4: 105204151-105204171 | CGCGUCACUGCAUUCCAGCC | 4973 |
| 54790_2_3100 | + | chr4: 105204152-105204172 | GCGUCACUGCAUUCCAGCCU | 4974 |
| 54790_2_3104 | + | chr4: 105204158-105204178 | CUGCAUUCCAGCCUGGGCGA | 4975 |
| 54790_2_3117 | + | chr4: 105204316-105204336 | UUAAGCAUCUCUCUUCCUCA | 4976 |
| 54790_2_3126 | + | chr4: 105204348-105204368 | UUGAAUCCUUAGUGCAUAUG | 4977 |
| 54790_2_3135 | + | chr4: 105204419-105204439 | AUUAGACAUCAUGUAAUAUC | 4978 |
| 54790_2_3145 | + | chr4: 105204469-105204489 | AACUAAGAAUAAUUUACCAA | 4979 |
| 54790_2_3168 | + | chr4: 105204543-105204563 | ACAUUAAGAGUUACGUUUCU | 4980 |
| 54790_2_3177 | + | chr4: 105204566-105204586 | AAAAUUGAAAAGAAUAUCUG | 4981 |
| 54790_2_3180 | + | chr4: 105204574-105204594 | AAAGAAUAUCUGUGGCACAA | 4982 |
| 54790_2_3181 | + | chr4: 105204575-105204595 | AAGAAUAUCUGUGGCACAAU | 4983 |
| 54790_2_3183 | + | chr4: 105204581-105204601 | AUCUGUGGCACAAUGGGCUC | 4984 |
| 54790_2_3184 | + | chr4: 105204582-105204602 | UCUGUGGCACAAUGGGCUCU | 4985 |
| 54790_2_3186 | + | chr4: 105204594-105204614 | UGGGCUCUGGGUAUAAUUGC | 4986 |
| 54790_2_3193 | + | chr4: 105204629-105204649 | GUUUAAAGAAUAUUUUCAAU | 4987 |
| 54790_2_3197 | + | chr4: 105204645-105204665 | CAAUAGGUAUAAGUUUAUUU | 4988 |
| 54790_2_3208 | + | chr4: 105204692-105204712 | UUUAGCAGUAUAUAUUUCCC | 4989 |
| 54790_2_3213 | + | chr4: 105204710-105204730 | CCUGGAACACCAUGCACUCU | 4990 |
| 54790_2_3214 | + | chr4: 105204726-105204746 | CUCUAGGUUUUCUAAUUUAU | 4991 |
| 54790_2_3218 | + | chr4: 105204740-105204760 | AUUUAUUGGUUUAAAAUACA | 4992 |
| 54790_2_3227 | + | chr4: 105204775-105204795 | UAAAUAUUCUCUGUAUCUGU | 4993 |
| 54790_2_3242 | + | chr4: 105204861-105204881 | AUUCACUAGAUUAUUUCCA | 4994 |
| 54790_2_3277 | + | chr4: 105204986-105205006 | GUUUCCUAAAUUAGUGAUU | 4995 |
| 54790_2_3308 | + | chr4: 105205080-105205100 | UAUAGCCAAUGCAUUUUGAG | 4996 |
| 54790_2_3330 | + | chr4: 105205156-105205176 | CUUUGAACAAAGAGUUAUUU | 4997 |
| 54790_2_3338 | + | chr4: 105205166-105205186 | AGAGUUAUUUAGGAAAAGAA | 4998 |
| 54790_2_3360 | + | chr4: 105205262-105205282 | UACUUCUUUAUAUUUUGUUG | 4999 |
| 54790_2_3392 | + | chr4: 105205373-105205393 | CUAAGAAAAUUUUCUUUGUC | 5000 |
| 54790_2_3393 | + | chr4: 105205379-105205399 | AAAUUUCUUUGUCAGGAUA | 5001 |
| 54790_2_3398 | + | chr4: 105205388-105205408 | UUGUCAGGAUAAGGCACAUG | 5002 |
| 54790_2_3422 | + | chr4: 105205502-105205522 | GAAGUCCCCCCAACCCAAU | 5003 |
| 54790_2_3431 | + | chr4: 105205543-105205563 | UCCUAUUCACACAUUCUUGA | 5004 |
| 54790_2_3462 | + | chr4: 105205654-105205674 | GUUUUUCACUCUUGUUGCCU | 5005 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_3466 | + | chr4: 105205658-105205678 | UUCACUCUUGUUGCCUAGGC | 5006 |
| 54790_2_3470 | + | chr4: 105205668-105205688 | UUGCCUAGGCUGGAGUGCAA | 5007 |
| 54790_2_3474 | + | chr4: 105205672-105205692 | CUAGGCUGGAGUGCAAUGGC | 5008 |
| 54790_2_3475 | + | chr4: 105205703-105205723 | UCACUGCAACCUCCGCCUCC | 5009 |
| 54790_2_3482 | + | chr4: 105205743-105205763 | GCCUCAGCCUCCCGAGUAGC | 5010 |
| 54790_2_3484 | + | chr4: 105205744-105205764 | CCUCAGCCUCCCGAGUAGCU | 5011 |
| 54790_2_3485 | + | chr4: 105205752-105205772 | UCCCGAGUAGCUGGGAUUAU | 5012 |
| 54790_2_3487 | + | chr4: 105205771-105205791 | UAGGCAUGCACCACCACUCC | 5013 |
| 54790_2_3491 | + | chr4: 105205801-105205821 | UUUUCUAUUUUUAGUAGAGA | 5014 |
| 54790_2_3502 | + | chr4: 105205817-105205837 | GAGACGGAGUUUCUCCAUGU | 5015 |
| 54790_2_3503 | + | chr4: 105205822-105205842 | GGAGUUUCUCCAUGUUGGUC | 5016 |
| 54790_2_3504 | + | chr4: 105205826-105205846 | UUUCUCCAUGUUGGUCAGGC | 5017 |
| 54790_2_3508 | + | chr4: 105205847-105205867 | GGUCUCAAACUCCCAACCUC | 5018 |
| 54790_2_3510 | + | chr4: 105205881-105205901 | CUUCAGCCUCCUAAAGUGCU | 5019 |
| 54790_2_3512 | + | chr4: 105205889-105205909 | UCCUAAAGUGCUAGGAUUAC | 5020 |
| 54790_2_3518 | + | chr4: 105205929-105205949 | AGCCGAAAACAUUAUCUUAA | 5021 |
| 54790_2_3532 | + | chr4: 105205992-105206012 | AAAAUACUGCUUAAAAGAUC | 5022 |
| 54790_2_3535 | + | chr4: 105206045-105206065 | UAUUUCUCUUUUACUUGUCU | 5023 |
| 54790_2_3544 | + | chr4: 105206070-105206090 | UCUAGUUCAGAUUUAUAGUU | 5024 |
| 54790_2_3553 | + | chr4: 105206110-105206130 | UGUUAGUGCUUCAGCCCAUC | 5025 |
| 54790_2_3558 | + | chr4: 105206114-105206134 | AGUGCUUCAGCCCAUCUGGU | 5026 |
| 54790_2_3559 | + | chr4: 105206115-105206135 | GUGCUUCAGCCCAUCUGGUU | 5027 |
| 54790_2_3562 | + | chr4: 105206116-105206136 | UGCUUCAGCCCAUCUGGUUG | 5028 |
| 54790_2_3567 | + | chr4: 105206135-105206155 | GGGGAACAGCUCUAUCCCAC | 5029 |
| 54790_2_3568 | + | chr4: 105206136-105206156 | GGGAACAGCUCUAUCCCACU | 5030 |
| 54790_2_3572 | + | chr4: 105206167-105206187 | CUUUCCUCAUGAGUGACGCC | 5031 |
| 54790_2_3573 | + | chr4: 105206168-105206188 | UUUCCUCAUGAGUGACGCCA | 5032 |
| 54790_2_3584 | + | chr4: 105206239-105206259 | UUCCCCAGCUUCGCUGCCUU | 5033 |
| 54790_2_3596 | + | chr4: 105206309-105206329 | UCGCCUUUAGUCCUUGAUGC | 5034 |
| 54790_2_3599 | + | chr4: 105206310-105206330 | CGCCUUUAGUCCUUGAUGCU | 5035 |
| 54790_2_3601 | + | chr4: 105206311-105206331 | GCCUUUAGUCCUUGAUGCUG | 5036 |
| 54790_2_3604 | + | chr4: 105206320-105206340 | CCUUGAUGCUGGGGACCUUU | 5037 |
| 54790_2_3607 | + | chr4: 105206324-105206344 | GAUGCUGGGGACCUUUUGGU | 5038 |
| 54790_2_3609 | + | chr4: 105206325-105206345 | AUGCUGGGGACCUUUUGGUU | 5039 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_3616 | + | chr4: 105206347-105206367 | GAAGACAGCUUCCUUAUGUC | 5040 |
| 54790_2_3617 | + | chr4: 105206348-105206368 | AAGACAGCUUCCUUAUGUCA | 5041 |
| 54790_2_3621 | + | chr4: 105206365-105206385 | UCAGGGUGAGCCUGCUACAC | 5042 |
| 54790_2_3628 | + | chr4: 105206431-105206451 | GUUUCUUUGUCUCCCUCAAA | 5043 |
| 54790_2_3635 | + | chr4: 105206442-105206462 | UCCCUCAAAUGGUACAAACG | 5044 |
| 54790_2_3637 | + | chr4: 105206445-105206465 | CUCAAAUGGUACAAACGUGG | 5045 |
| 54790_2_3638 | + | chr4: 105206446-105206466 | UCAAAUGGUACAAACGUGGA | 5046 |
| 54790_2_3648 | + | chr4: 105206520-105206540 | GCCCUCCAAAUAAGAGAUGA | 5047 |
| 54790_2_3657 | + | chr4: 105206569-105206589 | UCCACAACUGACUUUAAAAG | 5048 |
| 54790_2_3658 | + | chr4: 105206570-105206590 | CCACAACUGACUUUAAAAGA | 5049 |
| 54790_2_3660 | + | chr4: 105206575-105206595 | ACUGACUUUAAAAGAGGGAC | 5050 |
| 54790_2_3662 | + | chr4: 105206576-105206596 | CUGACUUUAAAAGAGGGACU | 5051 |
| 54790_2_3664 | + | chr4: 105206581-105206601 | UUUAAAAGAGGGACUGGGAU | 5052 |
| 54790_2_3665 | + | chr4: 105206582-105206602 | UUAAAAGAGGGACUGGGAUU | 5053 |
| 54790_2_3670 | + | chr4: 105206607-105206627 | CUUAGUGAUGACUUUUAAUG | 5054 |
| 54790_2_3682 | + | chr4: 105206659-105206679 | UAAACUCUCUGCCUCUCAGC | 5055 |
| 54790_2_3685 | + | chr4: 105206672-105206692 | UCUCAGCUGGCACUAUUCCA | 5056 |
| 54790_2_3687 | + | chr4: 105206689-105206709 | CCAUGGUAUUUUAGUGCUAA | 5057 |
| 54790_2_3689 | + | chr4: 105206690-105206710 | CAUGGUAUUUUAGUGCUAAU | 5058 |
| 54790_2_3693 | + | chr4: 105206691-105206711 | AUGGUAUUUUAGUGCUAAUG | 5059 |
| 54790_2_3694 | + | chr4: 105206692-105206712 | UGGUAUUUUAGUGCUAAUGG | 5060 |
| 54790_2_3711 | + | chr4: 105206740-105206760 | UGACUGUUUAAAUCAUUUAC | 5061 |
| 54790_2_3716 | + | chr4: 105206747-105206767 | UUAAAUCAUUUACUGGAAAG | 5062 |
| 54790_2_3717 | + | chr4: 105206748-105206768 | UAAAUCAUUUACUGGAAAGA | 5063 |
| 54790_2_3725 | + | chr4: 105206820-105206840 | GAUUUUGUUCAUGAACAUGA | 5064 |
| 54790_2_3732 | + | chr4: 105206851-105206871 | UUCUUAAAUGCCUUUAAUAU | 5065 |
| 54790_2_3738 | + | chr4: 105206866-105206886 | AAUAUUGGAUACUGCUUUCA | 5066 |
| 54790_2_3743 | + | chr4: 105206887-105206907 | GGAAAUUUAAAAUAGCAAGC | 5067 |
| 54790_2_3756 | + | chr4: 105206964-105206984 | CAAGUCAUAUAAAACAAGUU | 5068 |
| 54790_2_3779 | + | chr4: 105207068-105207088 | AGAUUCCAAACAUUAAUAUA | 5069 |
| 54790_2_3787 | + | chr4: 105207116-105207136 | UACAUAAAUUUUACUAGAAG | 5070 |
| 54790_2_3799 | + | chr4: 105207167-105207187 | UCAAAAGAUCUCAAAUCUU | 5071 |
| 54790_2_3801 | + | chr4: 105207168-105207188 | CAAAAAGAUCUCAAAUCUUA | 5072 |
| 54790_2_3804 | + | chr4: 105207189-105207209 | GGACUAAUAUUGUAAGUAUA | 5073 |
| 54790_2_3806 | + | chr4: 105207190-105207210 | GACUAAUAUUGUAAGUAUAC | 5074 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_3809 | + | chr4: 105207191-105207211 | ACUAAUAUUGUAAGUAUACG | 5075 |
| 54790_2_3816 | + | chr4: 105207234-105207254 | UAUCUUGUGAGUUUUUAGUU | 5076 |
| 54790_2_3840 | + | chr4: 105207319-105207339 | ACUCUCCUUUUGAAGUACAA | 5077 |
| 54790_2_3842 | + | chr4: 105207320-105207340 | CUCUCCUUUUGAAGUACAAA | 5078 |
| 54790_2_3849 | + | chr4: 105207346-105207366 | CUAAAGUGAAUAACUCAAAC | 5079 |
| 54790_2_3868 | + | chr4: 105207437-105207457 | GUUUUAUUGCAUAGUUUCUU | 5080 |
| 54790_2_3870 | + | chr4: 105207438-105207458 | UUUUAUUGCAUAGUUUCUUU | 5081 |
| 54790_2_3877 | + | chr4: 105207452-105207472 | UUCUUUGGGAUAUACAUUGA | 5082 |
| 54790_2_3885 | + | chr4: 105207459-105207479 | GGAUAUACAUUGAAGGAGAA | 5083 |
| 54790_2_3889 | + | chr4: 105207462-105207482 | UAUACAUUGAAGGAGAAAGG | 5084 |
| 54790_2_3893 | + | chr4: 105207465-105207485 | ACAUUGAAGGAGAAAGGAGG | 5085 |
| 54790_2_3894 | + | chr4: 105207466-105207486 | CAUUGAAGGAGAAAGGAGGA | 5086 |
| 54790_2_3898 | + | chr4: 105207485-105207505 | AGGGAGUUUUAAAAGACAAG | 5087 |
| 54790_2_3903 | + | chr4: 105207508-105207528 | AAAGCCCUUUCUGCUUGUUU | 5088 |
| 54790_2_3904 | + | chr4: 105207514-105207534 | CUUUCUGCUUGUUUUGGCUA | 5089 |
| 54790_2_3913 | + | chr4: 105207541-105207561 | CAUUUCAGUGUCUGUAUUUA | 5090 |
| 54790_2_3915 | + | chr4: 105207542-105207562 | AUUUCAGUGUCUGUAUUUAA | 5091 |
| 54790_2_3919 | + | chr4: 105207553-105207573 | UGUAUUUAAGGGAUCAUAAA | 5092 |
| 54790_2_3922 | + | chr4: 105207559-105207579 | UAAGGGAUCAUAAAAGGAAC | 5093 |
| 54790_2_3926 | + | chr4: 105207568-105207588 | AUAAAAGGAACUGGAAAGAC | 5094 |
| 54790_2_3927 | + | chr4: 105207577-105207597 | ACUGGAAAGACUGGUCACAA | 5095 |
| 54790_2_3929 | + | chr4: 105207602-105207622 | GCUCUGUACCUGUAUGAUUU | 5096 |
| 54790_2_3940 | + | chr4: 105207649-105207669 | CUUGUUAACCUAUACUGCUG | 5097 |
| 54790_2_3943 | + | chr4: 105207672-105207692 | AAGUCAUUCAUUAUGCAGUU | 5098 |
| 54790_2_3950 | + | chr4: 105207706-105207726 | CAAAUAAAGUUCACAGCUCU | 5099 |
| 54790_2_3970 | + | chr4: 105207800-105207820 | AAGAAGAUAGAAUCAAUACU | 5100 |
| 54790_2_3971 | + | chr4: 105207811-105207831 | AUCAAUACUUGGUGAUUGAU | 5101 |
| 54790_2_3974 | + | chr4: 105207826-105207846 | UUGAUAGGUUAUUUUUAAA | 5102 |
| 54790_2_3977 | + | chr4: 105207827-105207847 | UGAUAGGUUAUUUUUAAAA | 5103 |
| 54790_2_3989 | + | chr4: 105207850-105207870 | AAGAAAGAAUUAAACAUCCA | 5104 |
| 54790_2_3992 | + | chr4: 105207869-105207889 | AUGGUUUCUUCUUAAGUAAC | 5105 |
| 54790_2_3994 | + | chr4: 105207870-105207890 | UGGUUUCUUCUUAAGUAACU | 5106 |
| 54790_2_3997 | + | chr4: 105207871-105207891 | GGUUUCUUCUUAAGUAACUG | 5107 |
| 54790_2_3998 | + | chr4: 105207872-105207892 | GUUUCUUCUUAAGUAACUGG | 5108 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_4000 | + | chr4: 105207873-105207893 | UUUCUUCUUAAGUAACUGGG | 5109 |
| 54790_2_4006 | + | chr4: 105207898-105207918 | GAUAGUAUCCCUCACACCAA | 5110 |
| 54790_2_4008 | + | chr4: 105207899-105207919 | AUAGUAUCCCUCACACCAAU | 5111 |
| 54790_2_4010 | + | chr4: 105207900-105207920 | UAGUAUCCCUCACACCAAUG | 5112 |
| 54790_2_4012 | + | chr4: 105207915-105207935 | CAAUGGGAGUAUAGAUGAC | 5113 |
| 54790_2_4015 | + | chr4: 105207920-105207940 | GGGAGUAUAGAUGACAGGUU | 5114 |
| 54790_2_4021 | + | chr4: 105207947-105207967 | AAAGACAGUGAAUUCCAUUU | 5115 |
| 54790_2_4029 | + | chr4: 105207973-105207993 | AGUUGAAUUUGAAGUGCCUA | 5116 |
| 54790_2_4031 | + | chr4: 105207974-105207994 | GUUGAAUUUGAAGUGCCUAU | 5117 |
| 54790_2_4033 | + | chr4: 105207983-105208003 | GAAGUGCCUAUGGGACAUAC | 5118 |
| 54790_2_4037 | + | chr4: 105207997-105208017 | ACAUACAGGUACAGAUGACU | 5119 |
| 54790_2_4050 | + | chr4: 105208079-105208099 | UAAAUUGCUACUUGAGUUCA | 5120 |
| 54790_2_4051 | + | chr4: 105208080-105208100 | AAAUUGCUACUUGAGUUCAU | 5121 |
| 54790_2_4055 | + | chr4: 105208091-105208111 | UGAGUUCAUGGGAAUAAAAU | 5122 |
| 54790_2_4058 | + | chr4: 105208106-105208126 | AAAAUAGGUCAUUCUGCAAA | 5123 |
| 54790_2_4060 | + | chr4: 105208126-105208146 | UGGUUAUCUCAAUAUCUUCC | 5124 |
| 54790_2_4063 | + | chr4: 105208137-105208157 | AUAUCUUCCUGGCCAUCUCU | 5125 |
| 54790_2_4064 | + | chr4: 105208138-105208158 | UAUCUUCCUGGCCAUCUCUU | 5126 |
| 54790_2_4074 | + | chr4: 105208194-105208214 | UCUAAAUUCUCAUGUUUUUA | 5127 |
| 54790_2_4076 | + | chr4: 105208207-105208227 | GUUUUUAAGGCUCUCAUCUU | 5128 |
| 54790_2_4082 | + | chr4: 105208221-105208241 | CAUCUUAGGCCAACUUAUCU | 5129 |
| 54790_2_4083 | + | chr4: 105208222-105208242 | AUCUUAGGCCAACUUAUCUU | 5130 |
| 54790_2_4094 | + | chr4: 105208276-105208296 | UCUCUAAAUUUGUGCUUUUA | 5131 |
| 54790_2_4097 | + | chr4: 105208293-105208313 | UUAAGGCCCCAUUCUCAAGC | 5132 |
| 54790_2_4101 | + | chr4: 105208307-105208327 | UCAAGCUGGCUUCUCUGUUU | 5133 |
| 54790_2_4104 | + | chr4: 105208310-105208330 | AGCUGGCUUCUCUGUUUUGG | 5134 |
| 54790_2_4107 | + | chr4: 105208311-105208331 | GCUGGCUUCUCUGUUUUGGU | 5135 |
| 54790_2_4108 | + | chr4: 105208317-105208337 | UUCUCUGUUUUGGUGGGAAC | 5136 |
| 54790_2_4113 | + | chr4: 105208350-105208370 | UCAUUUGUAAACAACCCAAA | 5137 |
| 54790_2_4119 | + | chr4: 105208365-105208385 | CCAAAUGGCUAGCAUUGAGC | 5138 |
| 54790_2_4125 | + | chr4: 105208411-105208431 | UUACAUUUGAGUUAUCUGA | 5139 |
| 54790_2_4133 | + | chr4: 105208430-105208450 | AAGGAUCAAUAUCUCAAACU | 5140 |
| 54790_2_4143 | + | chr4: 105208492-105208512 | UUUCUUGCCUUUAAGUAUA | 5141 |
| 54790_2_4145 | + | chr4: 105208493-105208513 | UUUCUUGCCUUUAAGUAUAA | 5142 |
| 54790_2_4160 | + | chr4: 105208544-105208564 | ACAAGUUAAAAAAUUUAAUU | 5143 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_4187 | + | chr4: 105208658-105208678 | AGCAUGAAGAAGAGUAAAAU | 5144 |
| 54790_2_4190 | + | chr4: 105208663-105208683 | GAAGAAGAGUAAAAUAGGAG | 5145 |
| 54790_2_4191 | + | chr4: 105208670-105208690 | AGUAAAAUAGGAGUGGAUAA | 5146 |
| 54790_2_4192 | + | chr4: 105208678-105208698 | AGGAGUGGAUAAAGGCACAG | 5147 |
| 54790_2_4195 | + | chr4: 105208716-105208736 | UCCAUUAAUCUCAAAGUUU | 5148 |
| 54790_2_4210 | + | chr4: 105208768-105208788 | UGUCUUCCUGCUUUUUGACG | 5149 |
| 54790_2_4218 | + | chr4: 105208788-105208808 | UGGUAACCUGCCAUAACAAA | 5150 |
| 54790_2_4221 | + | chr4: 105208798-105208818 | CCAUAACAAAAGGAAACAGC | 5151 |
| 54790_2_4222 | + | chr4: 105208806-105208826 | AAAGGAAACAGCAGGAAACU | 5152 |
| 54790_2_4233 | + | chr4: 105208898-105208918 | AAGUGUUUUAGAGUGAAACA | 5153 |
| 54790_2_4238 | + | chr4: 105208912-105208932 | GAAACAAGGAUAAAGAGACA | 5154 |
| 54790_2_4240 | + | chr4: 105208936-105208956 | UAUUAAAUUUUAACAUCUGC | 5155 |
| 54790_2_4248 | + | chr4: 105208970-105208990 | CAUGCCAGUAGAAUUAAGUU | 5156 |
| 54790_2_4259 | + | chr4: 105209021-105209041 | GAAAUGAAAUAGAUGCCUCA | 5157 |
| 54790_2_4260 | + | chr4: 105209026-105209046 | GAAAUAGAUGCCUCAAGGCA | 5158 |
| 54790_2_4265 | + | chr4: 105209087-105209107 | UAUAUAUAUAUGUUUGAGCG | 5159 |
| 54790_2_4266 | + | chr4: 105209088-105209108 | AUAUAUAUAUGUUUGAGCGA | 5160 |
| 54790_2_4267 | + | chr4: 105209089-105209109 | UAUAUAUAUGUUUGAGCGAG | 5161 |
| 54790_2_4271 | + | chr4: 105209116-105209136 | UCUAGCAAAACUGAAUACAC | 5162 |
| 54790_2_4274 | + | chr4: 105209159-105209179 | UUUUUUUAUCCAUUCACUUU | 5163 |
| 54790_2_4287 | + | chr4: 105209191-105209211 | CAGCUGUGAGUUAUUCAACC | 5164 |
| 54790_2_4293 | + | chr4: 105209227-105209247 | AGUCUGAUUAAUAACGUUUA | 5165 |
| 54790_2_4312 | + | chr4: 105209325-105209345 | AAAUGAAUUUCCAUCCAAAU | 5166 |
| 54790_2_4314 | + | chr4: 105209326-105209346 | AAUGAAUUUCCAUCCAAAUA | 5167 |
| 54790_2_4317 | + | chr4: 105209329-105209349 | GAAUUUCCAUCCAAAUAGGG | 5168 |
| 54790_2_4326 | + | chr4: 105209371-105209391 | CAGUGUUGACUGAGAUGCUC | 5169 |
| 54790_2_4331 | + | chr4: 105209381-105209401 | UGAGAUGCUCUGGAUGAGCC | 5170 |
| 54790_2_4334 | + | chr4: 105209403-105209423 | GACUCAGAGCUCACCAACUU | 5171 |
| 54790_2_4338 | + | chr4: 105209427-105209447 | UCUUUAUGUUAAGUAGUCAG | 5172 |
| 54790_2_4340 | + | chr4: 105209428-105209448 | CUUUAUGUUAAGUAGUCAGU | 5173 |
| 54790_2_4341 | + | chr4: 105209429-105209449 | UUUAUGUUAAGUAGUCAGUG | 5174 |
| 54790_2_4348 | + | chr4: 105209477-105209497 | UGUUCUACACCUCUUGAUAU | 5175 |
| 54790_2_4350 | + | chr4: 105209484-105209504 | CACCUCUUGAUAUAGGUCAG | 5176 |
| 54790_2_4358 | + | chr4: 105209544-105209564 | AAACAGUACAUAUACCAAGU | 5177 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_4360 | + | chr4: 105209557-105209577 | ACCAAGUUGGUUUGUCACAA | 5178 |
| 54790_2_4363 | + | chr4: 105209558-105209578 | CCAAGUUGGUUUGUCACAAU | 5179 |
| 54790_2_4374 | + | chr4: 105209618-105209638 | UUUGUGUGUAUGUUUCUGAA | 5180 |
| 54790_2_4376 | + | chr4: 105209619-105209639 | UUGUGUGUAUGUUUCUGAAU | 5181 |
| 54790_2_4382 | + | chr4: 105209648-105209668 | UACAUAAUUUUACUCUUCCU | 5182 |
| 54790_2_4390 | + | chr4: 105209669-105209689 | GGUGAAGAUGCUUUUAUAAG | 5183 |
| 54790_2_4400 | + | chr4: 105209701-105209721 | AGAAAAUUAAGAAAUGUUGU | 5184 |
| 54790_2_4411 | + | chr4: 105209742-105209762 | UUUAAACAGAAUUAGUAUAG | 5185 |
| 54790_2_4419 | + | chr4: 105209761-105209781 | GAGGUGUGAAGAUCUACUGA | 5186 |
| 54790_2_4420 | + | chr4: 105209762-105209782 | AGGUGUGAAGAUCUACUGAA | 5187 |
| 54790_2_4423 | + | chr4: 105209778-105209798 | UGAAGGGUGAUAAGUAAGUG | 5188 |
| 54790_2_4425 | + | chr4: 105209787-105209807 | AUAAGUAAGUGUGGAAGAGA | 5189 |
| 54790_2_4427 | + | chr4: 105209800-105209820 | GAAGAGAUGGUGUUCAGCAU | 5190 |
| 54790_2_4428 | + | chr4: 105209801-105209821 | AAGAGAUGGUGUUCAGCAUU | 5191 |
| 54790_2_4431 | + | chr4: 105209817-105209837 | CAUUGGGCUUCAGUAUGAAU | 5192 |
| 54790_2_4436 | + | chr4: 105209833-105209853 | GAAUAGGUAGAAGAUGAGCA | 5193 |
| 54790_2_4440 | + | chr4: 105209861-105209881 | AGACAAGAAGUUCAUUCAAU | 5194 |
| 54790_2_4441 | + | chr4: 105209870-105209890 | GUUCAUUCAAUAGGCUGUUG | 5195 |
| 54790_2_4445 | + | chr4: 105209889-105209909 | GCGGUUAUCCAGCAAUGAGA | 5196 |
| 54790_2_4449 | + | chr4: 105209907-105209927 | GAUGGUGACAGCAUGAGCCA | 5197 |
| 54790_2_4451 | + | chr4: 105209921-105209941 | GAGCCAUGGUAGUAAAAGUA | 5198 |
| 54790_2_4453 | + | chr4: 105209927-105209947 | UGGUAGUAAAAGUAAGGACA | 5199 |
| 54790_2_4455 | + | chr4: 105209938-105209958 | GUAAGGACAUGGAUAAUUUG | 5200 |
| 54790_2_4456 | + | chr4: 105209939-105209959 | UAAGGACAUGGAUAAUUUGU | 5201 |
| 54790_2_4462 | + | chr4: 105209972-105209992 | AAUAAGAACAUAGAACCGAU | 5202 |
| 54790_2_4464 | + | chr4: 105209987-105210007 | CCGAUAGGUUAUUUUUUAAA | 5203 |
| 54790_2_4467 | + | chr4: 105209988-105210008 | CGAUAGGUUAUUUUUUAAAC | 5204 |
| 54790_2_4478 | + | chr4: 105210011-105210031 | AAGAAAGAAUUAAACAUCCA | 5205 |
| 54790_2_4481 | + | chr4: 105210034-105210054 | UUUCUUCUUAAGUAACUGCG | 5206 |
| 54790_2_4488 | + | chr4: 105210059-105210079 | GAUAGUACCCUCACACUGA | 5207 |
| 54790_2_4490 | + | chr4: 105210060-105210080 | AUAGUACCCUCACACUGAU | 5208 |
| 54790_2_4491 | + | chr4: 105210061-105210081 | UAGUACCCUCACACUGAUG | 5209 |
| 54790_2_4493 | + | chr4: 105210076-105210096 | UGAUGGGAAUGUAGAUGAC | 5210 |
| 54790_2_4496 | + | chr4: 105210081-105210101 | GGGAAUGUAGAUGACAGGUU | 5211 |
| 54790_2_4504 | + | chr4: 105210106-105210126 | UGAAAGAAUGAAUUCCAUUU | 5212 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_4512 | + | chr4: 105210132-105210152 | AGUAGAGUUUGAAGUGCCUA | 5213 |
| 54790_2_4514 | + | chr4: 105210133-105210153 | GUAGAGUUUGAAGUGCCUAU | 5214 |
| 54790_2_4516 | + | chr4: 105210142-105210162 | GAAGUGCCUAUGGGACAUAC | 5215 |
| 54790_2_4519 | + | chr4: 105210156-105210176 | ACAUACAGGUACAGAUGACU | 5216 |
| 54790_2_4525 | + | chr4: 105210194-105210214 | CAAAUUGUGAACUCUGCUGA | 5217 |
| 54790_2_4534 | + | chr4: 105210238-105210258 | UGAAUUGCUACUUGAGUUCA | 5218 |
| 54790_2_4535 | + | chr4: 105210239-105210259 | GAAUUGCUACUUGAGUUCAU | 5219 |
| 54790_2_4539 | + | chr4: 105210250-105210270 | UGAGUUCAUGGGAAUAAAAU | 5220 |
| 54790_2_4543 | + | chr4: 105210285-105210305 | UUGUUAUCUCAAUAUCUUCC | 5221 |
| 54790_2_4547 | + | chr4: 105210296-105210316 | AUAUCUUCCUGGCCAUCUCU | 5222 |
| 54790_2_4548 | + | chr4: 105210297-105210317 | UAUCUUCCUGGCCAUCUCUU | 5223 |
| 54790_2_4556 | + | chr4: 105210342-105210362 | UCUUUACAAUGUCAAAAUUC | 5224 |
| 54790_2_4560 | + | chr4: 105210353-105210373 | UCAAAAUUCUGGUGUUUUUA | 5225 |
| 54790_2_4562 | + | chr4: 105210366-105210386 | GUUUUUAAGGCCCCAAUCUC | 5226 |
| 54790_2_4564 | + | chr4: 105210370-105210390 | UUAAGGCCCCAAUCUCAGGC | 5227 |
| 54790_2_4570 | + | chr4: 105210395-105210415 | UCUCCAACUGUACUCUUACU | 5228 |
| 54790_2_4571 | + | chr4: 105210396-105210416 | CUCCAACUGUACUCUUACUU | 5229 |
| 54790_2_4575 | + | chr4: 105210416-105210436 | GGGAUGAUCUUAUCUAGUCA | 5230 |
| 54790_2_4578 | + | chr4: 105210417-105210437 | GGAUGAUCUUAUCUAGUCAU | 5231 |
| 54790_2_4579 | + | chr4: 105210418-105210438 | GAUGAUCUUAUCUAGUCAUG | 5232 |
| 54790_2_4581 | + | chr4: 105210434-105210454 | CAUGGGGCAUUAAAUACCAU | 5233 |
| 54790_2_4582 | + | chr4: 105210438-105210458 | GGGCAUUAAAUACCAUUGGU | 5234 |
| 54790_2_4611 | + | chr4: 105210661-105210681 | UUAGCUCAAGACAAAACUCU | 5235 |
| 54790_2_4635 | + | chr4: 105210790-105210810 | CCACUGCUAUUCUCUAGUUC | 5236 |
| 54790_2_4639 | + | chr4: 105210821-105210841 | UCCUUUCUCUUGUAUUACUG | 5237 |
| 54790_2_4654 | + | chr4: 105210897-105210917 | CUACCAGAGUGAUCUUUUAA | 5238 |
| 54790_2_4659 | + | chr4: 105210942-105210962 | CUUUAUAUAUAAUGCACCUA | 5239 |
| 54790_2_4663 | + | chr4: 105210953-105210973 | AUGCACCUAUGGCUUCCCAC | 5240 |
| 54790_2_4667 | + | chr4: 105210990-105211010 | CUUAACACUUUACUCCUCCA | 5241 |
| 54790_2_4692 | + | chr4: 105211142-105211162 | UCUAGCUGAAUCAUUCUUCC | 5242 |
| 54790_2_4693 | + | chr4: 105211157-105211177 | CUUCCAGGUCAUUCUAUCAU | 5243 |
| 54790_2_4719 | + | chr4: 105211310-105211330 | UCUGAAAUUGUUUGUUUAUU | 5244 |
| 54790_2_4727 | + | chr4: 105211340-105211360 | UUUGUCUAGAUAAACUUCAC | 5245 |
| 54790_2_4733 | + | chr4: 105211346-105211366 | UAGAUAAACUUCACUGGUGA | 5246 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_4749 | + | chr4: 105211444-105211464 | GAAAGAAUGUUGAAGAGAAG | 5247 |
| 54790_2_4750 | + | chr4: 105211445-105211465 | AAAGAAUGUUGAAGAGAAGA | 5248 |
| 54790_2_4753 | + | chr4: 105211465-105211485 | GGGUCCAGUCCAGCCCCCUG | 5249 |
| 54790_2_4756 | + | chr4: 105211480-105211500 | CCCUGAGGUGACCAGCAUUU | 5250 |
| 54790_2_4758 | + | chr4: 105211481-105211501 | CCUGAGGUGACCAGCAUUUA | 5251 |
| 54790_2_4760 | + | chr4: 105211493-105211513 | AGCAUUUAGGGAAUAAGCCG | 5252 |
| 54790_2_4764 | + | chr4: 105211499-105211519 | UAGGGAAUAAGCCGAGGCAG | 5253 |
| 54790_2_4768 | + | chr4: 105211502-105211522 | GGAAUAAGCCGAGGCAGAGG | 5254 |
| 54790_2_4769 | + | chr4: 105211503-105211523 | GAAUAAGCCGAGGCAGAGGA | 5255 |
| 54790_2_4773 | + | chr4: 105211515-105211535 | GCAGAGGAGGGCCAUUAAGA | 5256 |
| 54790_2_4780 | + | chr4: 105211533-105211553 | GAAGGAGCAAUGAGAGAUAG | 5257 |
| 54790_2_4782 | + | chr4: 105211549-105211569 | AUAGAGGAAAACUAAGAACA | 5258 |
| 54790_2_4785 | + | chr4: 105211580-105211600 | AAGUGAGAGUGUCCUAACAC | 5259 |
| 54790_2_4788 | + | chr4: 105211593-105211613 | CUAACACAGGUCUAAAUGAA | 5260 |
| 54790_2_4792 | + | chr4: 105211608-105211628 | AUGAAAGGAUAGUUCAGAAG | 5261 |
| 54790_2_4793 | + | chr4: 105211609-105211629 | UGAAAGGAUAGUUCAGAAGA | 5262 |
| 54790_2_4794 | + | chr4: 105211621-105211641 | UCAGAAGAGGGCACUGCAGC | 5263 |
| 54790_2_4801 | + | chr4: 105211641-105211661 | UGGCUGAAAGAGAACAAGAA | 5264 |
| 54790_2_4802 | + | chr4: 105211649-105211669 | AGAGAACAAGAAAGGCUGUA | 5265 |
| 54790_2_4804 | + | chr4: 105211652-105211672 | GAACAAGAAAGGCUGUAAGG | 5266 |
| 54790_2_4806 | + | chr4: 105211655-105211675 | CAAGAAAGGCUGUAAGGUGG | 5267 |
| 54790_2_4812 | + | chr4: 105211685-105211705 | UUAAUUGAGCCGUGAAAGAU | 5268 |
| 54790_2_4816 | + | chr4: 105211686-105211706 | UAAUUGAGCCGUGAAAGAUA | 5269 |
| 54790_2_4822 | + | chr4: 105211702-105211722 | GAUAGGGAAAUUCUGUAUGA | 5270 |
| 54790_2_4825 | + | chr4: 105211711-105211731 | AUUCUGUAUGAAGGAGUAAA | 5271 |
| 54790_2_4827 | + | chr4: 105211714-105211734 | CUGUAUGAAGGAGUAAAUGG | 5272 |
| 54790_2_4830 | + | chr4: 105211722-105211742 | AGGAGUAAAUGGAGGCAUAG | 5273 |
| 54790_2_4832 | + | chr4: 105211730-105211750 | AUGGAGGCAUAGAGGCAUAG | 5274 |
| 54790_2_4836 | + | chr4: 105211752-105211772 | GCAGAAGAUGCAUGCCUGUU | 5275 |
| 54790_2_4838 | + | chr4: 105211753-105211773 | CAGAAGAUGCAUGCCUGUUU | 5276 |
| 54790_2_4839 | + | chr4: 105211754-105211774 | AGAAGAUGCAUGCCUGUUUG | 5277 |
| 54790_2_4856 | + | chr4: 105211848-105211868 | GUCACUAGAUUAAAAAACAA | 5278 |
| 54790_2_4859 | + | chr4: 105211858-105211878 | UAAAAAACAAAGGCUCCAUC | 5279 |
| 54790_2_4865 | + | chr4: 105211884-105211904 | ACACAGUAAACAGAAGAAUA | 5280 |
| 54790_2_4868 | + | chr4: 105211894-105211914 | CAGAAGAAUAUGGAUUUAAA | 5281 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_4873 | + | chr4: 105211953-105211973 | UAAGUCAUUGAGAUUCCUUA | 5282 |
| 54790_2_4881 | + | chr4: 105211996-105212016 | AUAUAACAGUAUGCCAAUGU | 5283 |
| 54790_2_4883 | + | chr4: 105212003-105212023 | AGUAUGCCAAUGUAGGAAUG | 5284 |
| 54790_2_4886 | + | chr4: 105212017-105212037 | GGAAUGAGGCGUGAAUAAGC | 5285 |
| 54790_2_4887 | + | chr4: 105212018-105212038 | GAAUGAGGCGUGAAUAAGCA | 5286 |
| 54790_2_4890 | + | chr4: 105212058-105212078 | UCUCACCUUGAUUAUUCCUU | 5287 |
| 54790_2_4895 | + | chr4: 105212069-105212089 | UUAUUCCUUUGGUAGCUUCA | 5288 |
| 54790_2_4897 | + | chr4: 105212070-105212090 | UAUUCCUUUGGUAGCUUCAA | 5289 |
| 54790_2_4905 | + | chr4: 105212085-105212105 | UUCAAGGGAAAUUGAGUUUG | 5290 |
| 54790_2_4919 | + | chr4: 105212179-105212199 | GCAGUUUUUAUCUAGUCAGA | 5291 |
| 54790_2_4926 | + | chr4: 105212193-105212213 | GUCAGAUGGUUGAGAAGUCC | 5292 |
| 54790_2_4940 | + | chr4: 105212292-105212312 | UCAGUGUACCUUUCAGAUUG | 5293 |
| 54790_2_4952 | + | chr4: 105212369-105212389 | AAUAAGCUCAUGUUAGUUUC | 5294 |
| 54790_2_4963 | + | chr4: 105212418-105212438 | UAAUAUUUACAUAUAAUGAC | 5295 |
| 54790_2_4972 | + | chr4: 105212471-105212491 | CCUGUAUUUGCCUUUAUUUG | 5296 |
| 54790_2_4973 | + | chr4: 105212472-105212492 | CUGUAUUUGCCUUUAUUUGU | 5297 |
| 54790_2_4988 | + | chr4: 105212567-105212587 | CAAAAUUUUCAAAUUGUGUA | 5298 |
| 54790_2_4989 | + | chr4: 105212571-105212591 | AUUUCAAAUUGUGUAUGGC | 5299 |
| 54790_2_4995 | + | chr4: 105212586-105212606 | AUGGCUGGUCUAUAUUUUCU | 5300 |
| 54790_2_4996 | + | chr4: 105212600-105212620 | UUUUCUAGGACUGUCCUUUC | 5301 |
| 54790_2_5023 | + | chr4: 105212691-105212711 | AAAAAUAUUAAUUUCCAGCC | 5302 |
| 54790_2_5024 | + | chr4: 105212696-105212716 | UAUUAAUUUCCAGCCAGGUG | 5303 |
| 54790_2_5029 | + | chr4: 105212726-105212746 | CGCCUGUAAUCCCAGCACUU | 5304 |
| 54790_2_5032 | + | chr4: 105212727-105212747 | GCCUGUAAUCCCAGCACUUU | 5305 |
| 54790_2_5033 | + | chr4: 105212730-105212750 | UGUAAUCCCAGCACUUUGGG | 5306 |
| 54790_2_5035 | + | chr4: 105212736-105212756 | CCCAGCACUUUGGGAGGCUG | 5307 |
| 54790_2_5037 | + | chr4: 105212739-105212759 | AGCACUUUGGGAGGCUGAGG | 5308 |
| 54790_2_5038 | + | chr4: 105212740-105212760 | GCACUUUGGGAGGCUGAGGC | 5309 |
| 54790_2_5040 | + | chr4: 105212743-105212763 | CUUUGGGAGGCUGAGGCGGG | 5310 |
| 54790_2_5046 | + | chr4: 105212759-105212779 | CGGGUGGAUCACCUGAAGUC | 5311 |
| 54790_2_5047 | + | chr4: 105212777-105212797 | UCAGGAGUUCAAAACCAGCC | 5312 |
| 54790_2_5048 | + | chr4: 105212786-105212806 | CAAAACCAGCCUGGCCAACA | 5313 |
| 54790_2_5051 | + | chr4: 105212826-105212846 | UAAAAUACAAAAACUAGCC | 5314 |
| 54790_2_5052 | + | chr4: 105212831-105212851 | AUACAAAAACUAGCCAGGCA | 5315 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_5053 | + | chr4: 105212834-105212854 | CAAAACUAGCCAGGCAUGG | 5316 |
| 54790_2_5055 | + | chr4: 105212861-105212881 | UGCCUGUAGUCCCAGAUACU | 5317 |
| 54790_2_5056 | + | chr4: 105212865-105212885 | UGUAGUCCCAGAUACUUGGA | 5318 |
| 54790_2_5058 | + | chr4: 105212871-105212891 | CCCAGAUACUUGGAUGGCUG | 5319 |
| 54790_2_5060 | + | chr4: 105212875-105212895 | GAUACUUGGAUGGCUGAGGC | 5320 |
| 54790_2_5067 | + | chr4: 105212894-105212914 | CAGGAGAAUCACUUGAACCC | 5321 |
| 54790_2_5069 | + | chr4: 105212897-105212917 | GAGAAUCACUUGAACCCAGG | 5322 |
| 54790_2_5072 | + | chr4: 105212900-105212920 | AAUCACUUGAACCCAGGAGG | 5323 |
| 54790_2_5073 | + | chr4: 105212903-105212923 | CACUUGAACCCAGGAGGCGG | 5324 |
| 54790_2_5078 | + | chr4: 105212943-105212963 | UGUGCCACUGCACUCUAGCC | 5325 |
| 54790_2_5086 | + | chr4: 105212971-105212991 | AGAGUGAGAAUCUGUCUCAG | 5326 |
| 54790_2_5094 | + | chr4: 105213028-105213048 | CACCCACCAAAAGACUCCAU | 5327 |
| 54790_2_5119 | + | chr4: 105213147-105213167 | UUUCUGACAUAGAAAUAUAC | 5328 |
| 54790_2_5127 | + | chr4: 105213184-105213204 | GCUAAUAGUGACUAUUUUCU | 5329 |
| 54790_2_5128 | + | chr4: 105213185-105213205 | CUAAUAGUGACUAUUUUCUA | 5330 |
| 54790_2_5138 | + | chr4: 105213274-105213294 | UUUGUUAUUCUAAGUCAUAA | 5331 |
| 54790_2_5148 | + | chr4: 105213284-105213304 | UAAGUCAUAAAGGCAGAAUU | 5332 |
| 54790_2_5156 | + | chr4: 105213318-105213338 | GCUUUUCAAAUAUGCAGAAG | 5333 |
| 54790_2_5164 | + | chr4: 105213331-105213351 | GCAGAAGAGGAAAAAUUGAG | 5334 |
| 54790_2_5176 | + | chr4: 105213388-105213408 | AAAUUGAGUUUGAAACUUAC | 5335 |
| 54790_2_5193 | + | chr4: 105213512-105213532 | UAUACCUAUGCUUGACCAAA | 5336 |
| 54790_2_5212 | + | chr4: 105213590-105213610 | UCAAGCAUUUCCCUUUACCU | 5337 |
| 54790_2_5225 | + | chr4: 105213663-105213683 | ACUACCAAAAGCCCUUCAUU | 5338 |
| 54790_2_5231 | + | chr4: 105213707-105213727 | CUCCAUAGUUGCAUGUCUGA | 5339 |
| 54790_2_5243 | + | chr4: 105213794-105213814 | AAUUGUCAUUCUGUUUCCCA | 5340 |
| 54790_2_5248 | + | chr4: 105213821-105213841 | UAGUACAGUACUCUGCUCAC | 5341 |
| 54790_2_5251 | + | chr4: 105213858-105213878 | AGUUGAGCUACGUUUUUUUA | 5342 |
| 54790_2_5261 | + | chr4: 105213882-105213902 | AGAGUCUCCCUCUGUCGCCC | 5343 |
| 54790_2_5262 | + | chr4: 105213883-105213903 | GAGUCUCCCUCUGUCGCCCA | 5344 |
| 54790_2_5264 | + | chr4: 105213886-105213906 | UCUCCCUCUGUCGCCCAGGG | 5345 |
| 54790_2_5266 | + | chr4: 105213896-105213916 | UCGCCCAGGGUGGAGUACAG | 5346 |
| 54790_2_5268 | + | chr4: 105213930-105213950 | CUCACUGCAACCUCUGCUGC | 5347 |
| 54790_2_5269 | + | chr4: 105213931-105213951 | UCACUGCAACCUCUGCUGCU | 5348 |
| 54790_2_5275 | + | chr4: 105213970-105213990 | GUCUCAGACUCCCGAGUAGC | 5349 |
| 54790_2_5276 | + | chr4: 105213971-105213991 | UCUCAGACUCCCGAGUAGCU | 5350 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_5277 | + | chr4: 105213998-105214018 | UACCACCAUGCCACCAUGCC | 5351 |
| 54790_2_5280 | + | chr4: 105214020-105214040 | GCUAACUUUUAGUAGAAACA | 5352 |
| 54790_2_5284 | + | chr4: 105214034-105214054 | GAAACAAGGUUUCACCAUGU | 5353 |
| 54790_2_5285 | + | chr4: 105214039-105214059 | AAGGUUUCACCAUGUUGGCC | 5354 |
| 54790_2_5286 | + | chr4: 105214043-105214063 | UUUCACCAUGUUGGCCAGGC | 5355 |
| 54790_2_5290 | + | chr4: 105214057-105214077 | CCAGGCUGGUCUCCAACUCC | 5356 |
| 54790_2_5291 | + | chr4: 105214081-105214101 | CUCAAGUGAUCCACCUGCCU | 5357 |
| 54790_2_5293 | + | chr4: 105214098-105214118 | CCUUGGCCUCAUAAAGUGCU | 5358 |
| 54790_2_5297 | + | chr4: 105214136-105214156 | UGUCAUGUUACGAUAUAUAU | 5359 |
| 54790_2_5300 | + | chr4: 105214149-105214169 | UAUAUAUUGGUUUUUGUCCA | 5360 |
| 54790_2_5301 | + | chr4: 105214156-105214176 | UGGUUUUUGUCCAUGGUUUC | 5361 |
| 54790_2_5316 | + | chr4: 105214202-105214222 | UACAGUCUUUUGUUAGAAUG | 5362 |
| 54790_2_5317 | + | chr4: 105214203-105214223 | ACAGUCUUUUGUUAGAAUGU | 5363 |
| 54790_2_5320 | + | chr4: 105214204-105214224 | CAGUCUUUUGUUAGAAUGUG | 5364 |
| 54790_2_5322 | + | chr4: 105214212-105214232 | UGUUAGAAUGUGGGGUGUGU | 5365 |
| 54790_2_5329 | + | chr4: 105214219-105214239 | AUGUGGGGUGUGUUGGACCU | 5366 |
| 54790_2_5330 | + | chr4: 105214220-105214240 | UGUGGGGUGUGUUGGACCUC | 5367 |
| 54790_2_5331 | + | chr4: 105214221-105214241 | GUGGGGUGUGUUGGACCUCG | 5368 |
| 54790_2_5332 | + | chr4: 105214225-105214245 | GGUGUGUUGGACCUCGGGGC | 5369 |
| 54790_2_5342 | + | chr4: 105214274-105214294 | UUCCUUUCACUUGUCCCCCG | 5370 |
| 54790_2_5343 | + | chr4: 105214275-105214295 | UCCUUUCACUUGUCCCCCGA | 5371 |
| 54790_2_5372 | + | chr4: 105214329-105214349 | AAGACUUCCCUGUGUCACCC | 5372 |
| 54790_2_5374 | + | chr4: 105214333-105214353 | CUUCCCUGUGUCACCCAGGC | 5373 |
| 54790_2_5377 | + | chr4: 105214343-105214363 | UCACCCAGGCUGGAGUGCAG | 5374 |
| 54790_2_5378 | + | chr4: 105214379-105214399 | CACCGCAGCCUCAGCCUCCU | 5375 |
| 54790_2_5382 | + | chr4: 105214418-105214438 | AUCUCAGCCUCCCAAGUACC | 5376 |
| 54790_2_5383 | + | chr4: 105214419-105214439 | UCUCAGCCUCCCAAGUACCU | 5377 |
| 54790_2_5384 | + | chr4: 105214427-105214447 | UCCCAAGUACCUGGGACUAC | 5378 |
| 54790_2_5385 | + | chr4: 105214446-105214466 | CAGGCACAUGCCACCACACC | 5379 |
| 54790_2_5394 | + | chr4: 105214480-105214500 | UUUUUUUUUUUUUUGUAGAG | 5380 |
| 54790_2_5411 | + | chr4: 105214503-105214523 | UUUCGCCAUGUUGCCCAGUC | 5381 |
| 54790_2_5416 | + | chr4: 105214517-105214537 | CCAGUCUGGCCUCCAGCUCC | 5382 |
| 54790_2_5417 | + | chr4: 105214518-105214538 | CAGUCUGGCCUCCAGCUCCU | 5383 |
| 54790_2_5418 | + | chr4: 105214541-105214561 | CUCAAGUGAUCCACCCACCU | 5384 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_5423 | + | chr4: 105214568-105214588 | AACCACCACACCCAACCCUG | 5385 |
| 54790_2_5424 | + | chr4: 105214569-105214589 | ACCACCACACCCAACCCUGA | 5386 |
| 54790_2_5434 | + | chr4: 105214623-105214643 | GAGUCUUAAAACCCCAGAGA | 5387 |
| 54790_2_5439 | + | chr4: 105214641-105214661 | GAAGGUCCCACCCUUUGCAC | 5388 |
| 54790_2_5441 | + | chr4: 105214642-105214662 | AAGGUCCCACCCUUUGCACU | 5389 |
| 54790_2_5443 | + | chr4: 105214643-105214663 | AGGUCCCACCCUUUGCACUG | 5390 |
| 54790_2_5446 | + | chr4: 105214648-105214668 | CCACCCUUUGCACUGGGGAA | 5391 |
| 54790_2_5452 | + | chr4: 105214685-105214705 | UGAAGCCUCCAUAAAAACUC | 5392 |
| 54790_2_5454 | + | chr4: 105214688-105214708 | AGCCUCCAUAAAAACUCAGG | 5393 |
| 54790_2_5457 | + | chr4: 105214699-105214719 | AAACUCAGGAGGAUUGAGUC | 5394 |
| 54790_2_5460 | + | chr4: 105214700-105214720 | AACUCAGGAGGAUUGAGUCU | 5395 |
| 54790_2_5462 | + | chr4: 105214701-105214721 | ACUCAGGAGGAUUGAGUCUG | 5396 |
| 54790_2_5464 | + | chr4: 105214710-105214730 | GAUUGAGUCUGGGGAGCUUC | 5397 |
| 54790_2_5469 | + | chr4: 105214726-105214746 | CUUCUGGAUAGCUGAACCAG | 5398 |
| 54790_2_5470 | + | chr4: 105214729-105214749 | CUGGAUAGCUGAACCAGUGG | 5399 |
| 54790_2_5473 | + | chr4: 105214736-105214756 | GCUGAACCAGUGGAGGUUCC | 5400 |
| 54790_2_5475 | + | chr4: 105214740-105214760 | AACCAGUGGAGGUUCCUGGA | 5401 |
| 54790_2_5476 | + | chr4: 105214743-105214763 | CAGUGGAGGUUCCUGGAAGG | 5402 |
| 54790_2_5479 | + | chr4: 105214753-105214773 | UCCUGGAAGGUGGCUCAUCC | 5403 |
| 54790_2_5480 | + | chr4: 105214754-105214774 | CCUGGAAGGUGGCUCAUCCA | 5404 |
| 54790_2_5484 | + | chr4: 105214757-105214777 | GGAAGGUGGCUCAUCCAGGG | 5405 |
| 54790_2_5504 | + | chr4: 105214896-105214916 | CAAACGUAUUGAACCCAAAG | 5406 |
| 54790_2_5505 | + | chr4: 105214897-105214917 | AAACGUAUUGAACCCAAAGA | 5407 |
| 54790_2_5507 | + | chr4: 105214905-105214925 | UGAACCCAAAGAGGGUGUUG | 5408 |
| 54790_2_5509 | + | chr4: 105214906-105214926 | GAACCCAAAGAGGGUGUUGU | 5409 |
| 54790_2_5514 | + | chr4: 105214925-105214945 | UGGGAACCCCAACUCGAAGC | 5410 |
| 54790_2_5515 | + | chr4: 105214929-105214949 | AACCCCAACUCGAAGCUGGU | 5411 |
| 54790_2_5519 | + | chr4: 105214942-105214962 | AGCUGGUUGGUCAGAAGUUC | 5412 |
| 54790_2_5520 | + | chr4: 105214945-105214965 | UGGUUGGUCAGAAGUUCUGG | 5413 |
| 54790_2_5522 | + | chr4: 105214950-105214970 | GGUCAGAAGUUCUGGAGGCC | 5414 |
| 54790_2_5525 | + | chr4: 105214971-105214991 | GGAUUUGUGACUUGUGUCUG | 5415 |
| 54790_2_5528 | + | chr4: 105214975-105214995 | UUGUGACUUGUGUCUGUGGC | 5416 |
| 54790_2_5534 | + | chr4: 105214985-105215005 | UGUCUGUGGCAGGAGCAUCU | 5417 |
| 54790_2_5536 | + | chr4: 105214986-105215006 | GUCUGUGGCAGGAGCAUCUU | 5418 |
| 54790_2_5540 | + | chr4: 105215007-105215027 | GGAACUGAGCGUUUAAUCUA | 5419 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_5542 | + | chr4: 105215008-105215028 | GAACUGAGCGUUUAAUCUAC | 5420 |
| 54790_2_5543 | + | chr4: 105215009-105215029 | AACUGAGCGUUUAAUCUACG | 5421 |
| 54790_2_5547 | + | chr4: 105215026-105215046 | ACGGGGUCUGACACUGUCUC | 5422 |
| 54790_2_5550 | + | chr4: 105215027-105215047 | CGGGGUCUGACACUGUCUCC | 5423 |
| 54790_2_5553 | + | chr4: 105215038-105215058 | ACUGUCUCCGGGAAUUAAAU | 5424 |
| 54790_2_5555 | + | chr4: 105215041-105215061 | GUCUCCGGGAAUUAAAUGG | 5425 |
| 54790_2_5560 | + | chr4: 105215073-105215093 | UAGUGUCUGCUGCUUGUUAU | 5426 |
| 54790_2_5562 | + | chr4: 105215074-105215094 | AGUGUCUGCUGCUUGUUAUU | 5427 |
| 54790_2_5564 | + | chr4: 105215075-105215095 | GUGUCUGCUGCUUGUUAUUG | 5428 |
| 54790_2_5569 | + | chr4: 105215095-105215115 | GGGAGAAACCCUCACACAUU | 5429 |
| 54790_2_5587 | + | chr4: 105215148-105215168 | UUGUUGUGAUGUGAGAGCAG | 5430 |
| 54790_2_5592 | + | chr4: 105215163-105215183 | AGCAGAGGAAAAAUGCAUUU | 5431 |
| 54790_2_5595 | + | chr4: 105215168-105215188 | AGGAAAAAUGCAUUUUGGAG | 5432 |
| 54790_2_5599 | + | chr4: 105215190-105215210 | GUUUUUUCCUACACAGCCAU | 5433 |
| 54790_2_5626 | + | chr4: 105215294-105215314 | GCAUUUAAACUAAAAAGAAU | 5434 |
| 54790_2_5667 | + | chr4: 105215503-105215523 | CUUGUAAAUGUUUAUAAGAU | 5435 |
| 54790_2_5670 | + | chr4: 105215514-105215534 | UUAUAAGAUUGGUAGCUGUG | 5436 |
| 54790_2_5671 | + | chr4: 105215515-105215535 | UAUAAGAUUGGUAGCUGUGU | 5437 |
| 54790_2_5696 | + | chr4: 105215588-105215608 | UUUUGAAAAAGAAACAGAA | 5438 |
| 54790_2_5726 | + | chr4: 105215757-105215777 | ACAAAGAGAACAUUGAAACA | 5439 |
| 54790_2_5729 | + | chr4: 105215758-105215778 | CAAAGAGAACAUUGAAACAU | 5440 |
| 54790_2_5741 | + | chr4: 105215803-105215823 | CCAGAAUGCCAACUCAUUUC | 5441 |
| 54790_2_5743 | + | chr4: 105215804-105215824 | CAGAAUGCCAACUCAUUUCU | 5442 |
| 54790_2_5744 | + | chr4: 105215805-105215825 | AGAAUGCCAACUCAUUUCUG | 5443 |
| 54790_2_5756 | + | chr4: 105215866-105215886 | UUUUUAUACGAUACCAUAAA | 5444 |
| 54790_2_5758 | + | chr4: 105215870-105215890 | UAUACGAUACCAUAAAUGGU | 5445 |
| 54790_2_5793 | + | chr4: 105216068-105216088 | AUGAUCUUGAUUACUAACUG | 5446 |
| 54790_2_5795 | + | chr4: 105216069-105216089 | UGAUCUUGAUUACUAACUGU | 5447 |
| 54790_2_5807 | + | chr4: 105216128-105216148 | AAUAUUAGAGCUAGUAUACU | 5448 |
| 54790_2_5809 | + | chr4: 105216135-105216155 | GAGCUAGUAUACUUGGAGUU | 5449 |
| 54790_2_5812 | + | chr4: 105216148-105216168 | UGGAGUUGGCUAGUAUUUC | 5450 |
| 54790_2_5813 | + | chr4: 105216149-105216169 | GGAGUUGGCUAGUAUUUCU | 5451 |
| 54790_2_5817 | + | chr4: 105216150-105216170 | GAGUUGGCUAGUAUUUCUG | 5452 |
| 54790_2_5818 | + | chr4: 105216151-105216171 | AGUUGGCUAGUAUUUCUGG | 5453 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_5820 | + | chr4: 105216154-105216174 | UUGGCUAGUAUUUCUGGGGG | 5454 |
| 54790_2_5827 | + | chr4: 105216163-105216183 | AUUUCUGGGGGAGGUAGAAG | 5455 |
| 54790_2_5838 | + | chr4: 105216216-105216236 | GCCACGCUGACUAAAACAAA | 5456 |
| 54790_2_5845 | + | chr4: 105216260-105216280 | UCAUAGUACUUCUUUGAAAC | 5457 |
| 54790_2_5849 | + | chr4: 105216264-105216284 | AGUACUUCUUUGAAACAGGU | 5458 |
| 54790_2_5852 | + | chr4: 105216265-105216285 | GUACUUCUUUGAAACAGGUC | 5459 |
| 54790_2_5854 | + | chr4: 105216266-105216286 | UACUUCUUUGAAACAGGUCG | 5460 |
| 54790_2_5856 | + | chr4: 105216267-105216287 | ACUUCUUUGAAACAGGUCGG | 5461 |
| 54790_2_5858 | + | chr4: 105216268-105216288 | CUUCUUUGAAACAGGUCGGG | 5462 |
| 54790_2_5861 | + | chr4: 105216271-105216291 | CUUUGAAACAGGUCGGGGGG | 5463 |
| 54790_2_5873 | + | chr4: 105216316-105216336 | UUUUAAUCAAAGUUCUUUCA | 5464 |
| 54790_2_5877 | + | chr4: 105216325-105216345 | AAGUUCUUUCAUGGAAUUGU | 5465 |
| 54790_2_5880 | + | chr4: 105216334-105216354 | CAUGGAAUUGUUGGUGCUUC | 5466 |
| 54790_2_5896 | + | chr4: 105216414-105216434 | AAUUCAGUGCUUGUCUUAAC | 5467 |
| 54790_2_5898 | + | chr4: 105216417-105216437 | UCAGUGCUUGUCUUAACUGG | 5468 |
| 54790_2_5901 | + | chr4: 105216430-105216450 | UAACUGGUGGACUUAUUUUA | 5469 |
| 54790_2_5905 | + | chr4: 105216449-105216469 | AUGGUAUUAUGUUUAUAAGA | 5470 |
| 54790_2_5912 | + | chr4: 105216486-105216506 | UUUUUUAUACUCCUAAAAGA | 5471 |
| 54790_2_5921 | + | chr4: 105216498-105216518 | CUAAAAGAUGGAUACGAUAG | 5472 |
| 54790_2_5922 | + | chr4: 105216499-105216519 | UAAAAGAUGGAUACGAUAGA | 5473 |
| 54790_2_5925 | + | chr4: 105216500-105216520 | AAAAGAUGGAUACGAUAGAG | 5474 |
| 54790_2_5928 | + | chr4: 105216505-105216525 | AUGGAUACGAUAGAGGGGAA | 5475 |
| 54790_2_5930 | + | chr4: 105216506-105216526 | UGGAUACGAUAGAGGGGAAA | 5476 |
| 54790_2_5931 | + | chr4: 105216507-105216527 | GGAUACGAUAGAGGGGAAAG | 5477 |
| 54790_2_5932 | + | chr4: 105216508-105216528 | GAUACGAUAGAGGGGAAAGG | 5478 |
| 54790_2_5933 | + | chr4: 105216526-105216546 | GGGGGUAAGCUACAACUUUU | 5479 |
| 54790_2_5934 | + | chr4: 105216533-105216553 | AGCUACAACUUUUAGGUUGU | 5480 |
| 54790_2_5953 | + | chr4: 105216618-105216638 | UAAAGUAAUGAUUUGCCAC | 5481 |
| 54790_2_5973 | + | chr4: 105216703-105216723 | UAUGAAAAUGCCAUAAACU | 5482 |
| 54790_2_5985 | + | chr4: 105216763-105216783 | AAAGCUAAUUCAUCUUUUAG | 5483 |
| 54790_2_5994 | + | chr4: 105216808-105216828 | AGAUGUAUAGCUAAGUCUGU | 5484 |
| 54790_2_5995 | + | chr4: 105216820-105216840 | AAGUCUGUUGGACAAACUGU | 5485 |
| 54790_2_6000 | + | chr4: 105216877-105216897 | GUGAAUUUAUGAUAUUUCCU | 5486 |
| 54790_2_6003 | + | chr4: 105216888-105216908 | AUAUUUCCUAGGUAAUGUUA | 5487 |
| 54790_2_6007 | + | chr4: 105216896-105216916 | UAGGUAAUGUUAAGGUUAUA | 5488 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_6010 | + | chr4: 105216911-105216931 | UUAUAUGGAAAUUUCUUUGC | 5489 |
| 54790_2_6024 | + | chr4: 105216960-105216980 | UGUUAUUUUCAAUACAUACG | 5490 |
| 54790_2_6064 | + | chr4: 105217145-105217165 | GACCUUUCUCUUCAUUUCAA | 5491 |
| 54790_2_6068 | + | chr4: 105217155-105217175 | UUCAUUUCAAAGGCAUAACU | 5492 |
| 54790_2_6070 | + | chr4: 105217159-105217179 | UUUCAAAGGCAUAACUUGGA | 5493 |
| 54790_2_6073 | + | chr4: 105217175-105217195 | UGGAUGGUCUGUUUAGCUCA | 5494 |
| 54790_2_6079 | + | chr4: 105217206-105217226 | AAAAGUUAUGAUUUUGUAUU | 5495 |
| 54790_2_6080 | + | chr4: 105217207-105217227 | AAAGUUAUGAUUUUGUAUUU | 5496 |
| 54790_2_6082 | + | chr4: 105217218-105217238 | UUUGUAUUUGGGCAAAGUAC | 5497 |
| 54790_2_6093 | + | chr4: 105217255-105217275 | CAUUAGAACAGCAAUAUAAC | 5498 |
| 54790_2_6107 | + | chr4: 105217313-105217333 | AGCUAAAGCAAAACUUGCAU | 5499 |
| 54790_2_6116 | + | chr4: 105217363-105217383 | CUCAGAACUCUACAUCUGAG | 5500 |
| 54790_2_6121 | + | chr4: 105217395-105217415 | UUUAUACUCUCCUAGUCCAC | 5501 |
| 54790_2_6129 | + | chr4: 105217468-105217488 | UCAUAUACUACAUCUGAAUU | 5502 |
| 54790_2_6130 | + | chr4: 105217469-105217489 | CAUAUACUACAUCUGAAUUA | 5503 |
| 54790_2_6134 | + | chr4: 105217494-105217514 | UUCCAAAGUAUGCUAUUCCA | 5504 |
| 54790_2_6140 | + | chr4: 105217512-105217532 | CAUGGAAAUACUGUUUAUUC | 5505 |
| 54790_2_6141 | + | chr4: 105217513-105217533 | AUGGAAAUACUGUUUAUUCA | 5506 |
| 54790_2_6147 | + | chr4: 105217553-105217573 | UCCUGUGUUUCAUUAUGUCC | 5507 |
| 54790_2_6154 | + | chr4: 105217608-105217628 | UCAUCAUAUUAAAGACUUUG | 5508 |
| 54790_2_6174 | + | chr4: 105217686-105217706 | ACAGAACUUUAUUUUUUCUC | 5509 |
| 54790_2_6175 | + | chr4: 105217690-105217710 | AACUUUAUUUUUUCUCAGGC | 5510 |
| 54790_2_6194 | + | chr4: 105217777-105217797 | AUGAUAAGAAUCUGUUUCAA | 5511 |
| 54790_2_6195 | + | chr4: 105217783-105217803 | AGAAUCUGUUUCAAUGGUGU | 5512 |
| 54790_2_6198 | + | chr4: 105217801-105217821 | GUUGGUGUACAUGUGUGUUC | 5513 |
| 54790_2_6201 | + | chr4: 105217816-105217836 | UGUUCAGGUACCUACACAUU | 5514 |
| 54790_2_6208 | + | chr4: 105217860-105217880 | ACUGCACUUAUAAAGAGACA | 5515 |
| 54790_2_6213 | + | chr4: 105217889-105217909 | CAUCAAGAAGACAUCAUUUU | 5516 |
| 54790_2_6214 | + | chr4: 105217890-105217910 | AUCAAGAAGACAUCAUUUUA | 5517 |
| 54790_2_6216 | + | chr4: 105217893-105217913 | AAGAAGACAUCAUUUUAGGG | 5518 |
| 54790_2_6219 | + | chr4: 105217908-105217928 | UAGGGUGGACACCAUUGCCU | 5519 |
| 54790_2_6236 | + | chr4: 105217978-105217998 | CGCAGAGUUGACUCGAGUGA | 5520 |
| 54790_2_6264 | + | chr4: 105218103-105218123 | AUUAUUUAUGUCCACUGUCC | 5521 |
| 54790_2_6265 | + | chr4: 105218104-105218124 | UUAUUUAUGUCCACUGUCCA | 5522 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_6270 | + | chr4: 105218118-105218138 | UGUCCAGGGUACUUGCUUUA | 5523 |
| 54790_2_6271 | + | chr4: 105218119-105218139 | GUCCAGGGUACUUGCUUUAA | 5524 |
| 54790_2_6280 | + | chr4: 105218153-105218173 | UCUUGAAGAUGAAGAGUCUU | 5525 |
| 54790_2_6301 | + | chr4: 105218244-105218264 | UCCUAGUGAUGUGAUCAUAU | 5526 |
| 54790_2_6305 | + | chr4: 105218269-105218289 | AAUCCAGUGUUUCUUUUCCA | 5527 |
| 54790_2_6310 | + | chr4: 105218284-105218304 | UUCCAAGGACAGUACUGAUA | 5528 |
| 54790_2_6317 | + | chr4: 105218341-105218361 | AUCUCCAUCUAUUCAUAGUU | 5529 |
| 54790_2_6320 | + | chr4: 105218353-105218373 | UCAUAGUUUGGCUCAGAAGU | 5530 |
| 54790_2_6322 | + | chr4: 105218359-105218379 | UUUGGCUCAGAAGUUGGACA | 5531 |
| 54790_2_6328 | + | chr4: 105218392-105218412 | UAUCUACUUCUUCCUCAUGU | 5532 |
| 54790_2_6339 | + | chr4: 105218445-105218465 | GUUUACUUAUGUGUAAAAUG | 5533 |
| 54790_2_6345 | + | chr4: 105218475-105218495 | UACACCCUUCAAACCGAAAG | 5534 |
| 54790_2_6375 | + | chr4: 105218624-105218644 | AAUUUUUAAAAAUUGAGAUG | 5535 |
| 54790_2_6376 | + | chr4: 105218625-105218645 | AUUUUUAAAAAUUGAGAUGU | 5536 |
| 54790_2_6377 | + | chr4: 105218626-105218646 | UUUUUAAAAAUUGAGAUGUG | 5537 |
| 54790_2_6378 | + | chr4: 105218629-105218649 | UUAAAAAUUGAGAUGUGGGG | 5538 |
| 54790_2_6392 | + | chr4: 105218705-105218725 | UGACUGUGUCUAUGUCCUGU | 5539 |
| 54790_2_6401 | + | chr4: 105218778-105218798 | ACCAUAUUUUAUGCAACUUC | 5540 |
| 54790_2_6420 | + | chr4: 105218897-105218917 | AAAACAUGCUAUAUAAUUUU | 5541 |
| 54790_2_6435 | + | chr4: 105218964-105218984 | AGAGUAAUCUUCAUCAUGUA | 5542 |
| 54790_2_6438 | + | chr4: 105218965-105218985 | GAGUAAUCUUCAUCAUGUAU | 5543 |
| 54790_2_6443 | + | chr4: 105218997-105219017 | GUAUUUUCUGAUGAACACA | 5544 |
| 54790_2_6452 | + | chr4: 105219050-105219070 | UACUCUUUCUUCUGAUAGAC | 5545 |
| 54790_2_6461 | + | chr4: 105219081-105219101 | UUUAUGUUAUGAAAUAAUGU | 5546 |
| 54790_2_6475 | + | chr4: 105219136-105219156 | UUUCUUAAAUUGAUAGCUCA | 5547 |
| 54790_2_6480 | + | chr4: 105219148-105219168 | AUAGCUCAUGGAUGUGCAGU | 5548 |
| 54790_2_6481 | + | chr4: 105219156-105219176 | UGGAUGUGCAGUUGGUUUAA | 5549 |
| 54790_2_6494 | + | chr4: 105219264-105219284 | AUUGCUAGUUGUUCCAAAAU | 5550 |
| 54790_2_6501 | + | chr4: 105219292-105219312 | UAAAAAUGACCAGAUUGUUA | 5551 |
| 54790_2_6506 | + | chr4: 105219322-105219342 | UUGAUUAAGACUAGAUCAAU | 5552 |
| 54790_2_6513 | + | chr4: 105219371-105219391 | AAACUUCUCCAAAACAUAGA | 5553 |
| 54790_2_6516 | + | chr4: 105219385-105219405 | CAUAGAUGGCAUGCCUUUUG | 5554 |
| 54790_2_6517 | + | chr4: 105219391-105219411 | UGGCAUGCCUUUUGAGGCAA | 5555 |
| 54790_2_6520 | + | chr4: 105219395-105219415 | AUGCCUUUUGAGGCAAUGGU | 5556 |
| 54790_2_6521 | + | chr4: 105219396-105219416 | UGCCUUUUGAGGCAAUGGUA | 5557 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_2_6529 | + | chr4: 105219417-105219437 | GGAACAAAAUAUUUUUGAGA | 5558 |
| 54790_2_6533 | + | chr4: 105219430-105219450 | UUUGAGAAGGAGCAGAUUUU | 5559 |
| 54790_2_6535 | + | chr4: 105219431-105219451 | UUGAGAAGGAGCAGAUUUUA | 5560 |
| 54790_2_6543 | + | chr4: 105219474-105219494 | GCCAAAAUGCUUGUGUUACA | 5561 |
| 54790_2_6545 | + | chr4: 105219482-105219502 | GCUUGUGUUACAAGGAUUCC | 5562 |
| 54790_2_6550 | + | chr4: 105219509-105219529 | GAGUUUUAAAUAAAAUGCU | 5563 |
| 54790_2_6561 | + | chr4: 105219551-105219571 | AUUAAUAUUGUAGAGUCCCC | 5564 |
| 54790_2_6563 | + | chr4: 105219552-105219572 | UUAAUAUUGUAGAGUCCCCU | 5565 |
| 54790_2_6565 | + | chr4: 105219553-105219573 | UAAUAUUGUAGAGUCCCCUG | 5566 |
| 54790_2_6573 | + | chr4: 105219615-105219635 | UCUACCUUUUGAUAGCUUUG | 5567 |
| 54790_2_6575 | + | chr4: 105219616-105219636 | CUACCUUUUGAUAGCUUUGU | 5568 |
| 54790_2_6578 | + | chr4: 105219617-105219637 | UACCUUUUGAUAGCUUUGUG | 5569 |
| 54790_2_6595 | + | chr4: 105219659-105219679 | GUUUUGCCAUUCUUGAUUUU | 5570 |
| 54790_2_6597 | + | chr4: 105219660-105219680 | UUUUGCCAUUCUUGAUUUUA | 5571 |
| 54790_2_6612 | + | chr4: 105219722-105219742 | UGCAUUGAUUAAGAUCAUCU | 5572 |
| 54790_2_6631 | + | chr4: 105219817-105219837 | CUCAUUAUAUAGUAUUUAAU | 5573 |
| 54790_2_6632 | + | chr4: 105219818-105219838 | UCAUUAUAUAGUAUUUAAUA | 5574 |
| 54790_2_6664 | + | chr4: 105219962-105219982 | UUUCUCCUCAUUAGAAUAUC | 5575 |
| 54790_2_6672 | + | chr4: 105219976-105219996 | AAUAUCAGGUCCAAGAAGAC | 5576 |
| 54790_2_6674 | + | chr4: 105220001-105220021 | UAUUUAUCUCUUUUGUUCAG | 5577 |
| 54790_2_6677 | + | chr4: 105220012-105220032 | UUUGUUCAGUGGUGUGUUAC | 5578 |
| 54790_2_6709 | + | chr4: 105220195-105220215 | UAUUAUUAGAACCCAUUUGU | 5579 |
| 54790_2_6712 | + | chr4: 105220208-105220228 | CAUUUGUUGGCCUUAUGUAA | 5580 |
| 54790_2_6718 | + | chr4: 105220217-105220237 | GCCUUAUGUAAUGGUUCUAU | 5581 |
| 54790_2_6734 | + | chr4: 105220332-105220352 | CCAUUAAUGUCUUCUUGACC | 5582 |
| 54790_2_6738 | + | chr4: 105220359-105220379 | AUAAUUUUUACAGCACCUUU | 5583 |
| 54790_2_6763 | + | chr4: 105220466-105220486 | CCCAGCACAAACUUAAACAC | 5584 |
| 54790_2_6766 | + | chr4: 105220479-105220499 | UAAACACUGGCUCCAACCCU | 5585 |
| 54790_2_6770 | + | chr4: 105220492-105220512 | CAACCCUGGAGUUGAAAGU | 5586 |
| 54790_2_6773 | + | chr4: 105220493-105220513 | AACCCUUGGAGUUGAAAGUA | 5587 |
| 54790_2_6774 | + | chr4: 105220494-105220514 | ACCCUUGGAGUUGAAAGUAG | 5588 |
| 54790_2_6781 | + | chr4: 105220548-105220568 | UACCGUGAGCACCAGUGCCU | 5589 |
| 54790_2_6783 | + | chr4: 105220555-105220575 | AGCACCAGUGCCUAGGAGAU | 5590 |
| 54790_2_6784 | + | chr4: 105220556-105220576 | GCACCAGUGCCUAGGAGAUU | 5591 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_6786 | + | chr4: 105220560-105220580 | CAGUGCCUAGGAGAUUGGGC | 5592 |
| 54790_2_6789 | + | chr4: 105220567-105220587 | UAGGAGAUUGGGCAGGACUG | 5593 |
| 54790_2_6792 | + | chr4: 105220571-105220591 | AGAUUGGGCAGGACUGAGGA | 5594 |
| 54790_2_6796 | + | chr4: 105220580-105220600 | AGGACUGAGGAAGGAUGAAA | 5595 |
| 54790_2_6799 | + | chr4: 105220588-105220608 | GGAAGGAUGAAAAGGAGCUC | 5596 |
| 54790_2_6800 | + | chr4: 105220589-105220609 | GAAGGAUGAAAAGGAGCUCA | 5597 |
| 54790_2_6804 | + | chr4: 105220615-105220635 | CUUAAGCACCUGAACAAGAC | 5598 |
| 54790_2_6806 | + | chr4: 105220618-105220638 | AAGCACCUGAACAAGACUGG | 5599 |
| 54790_2_6809 | + | chr4: 105220625-105220645 | UGAACAAGACUGGAGGACUU | 5600 |
| 54790_2_6811 | + | chr4: 105220647-105220667 | GAUGUUGCUAUUUUUCUGCC | 5601 |
| 54790_2_6814 | + | chr4: 105220657-105220677 | UUUUUCUGCCUGGCAUUGAC | 5602 |
| 54790_2_6820 | + | chr4: 105220664-105220684 | GCCUGGCAUUGACUGGCUAU | 5603 |
| 54790_2_6823 | + | chr4: 105220679-105220699 | GCUAUUGGACGCCCUCUGUG | 5604 |
| 54790_2_6824 | + | chr4: 105220683-105220703 | UUGGACGCCCUCUGUGAGGC | 5605 |
| 54790_2_6827 | + | chr4: 105220697-105220717 | UGAGGCAGGCAUCCGAAUAC | 5606 |
| 54790_2_6830 | + | chr4: 105220715-105220735 | ACUGGCUUUCUUGACAUAUA | 5607 |
| 54790_2_6836 | + | chr4: 105220732-105220752 | AUAUGGAGCGUUCUUUAGAG | 5608 |
| 54790_2_6838 | + | chr4: 105220741-105220761 | GUUCUUUAGAGAGGCCUACA | 5609 |
| 54790_2_6839 | + | chr4: 105220742-105220762 | UUCUUUAGAGAGGCCUACAA | 5610 |
| 54790_2_6844 | + | chr4: 105220768-105220788 | UCACUGCACAGUACCCUGAU | 5611 |
| 54790_2_6857 | + | chr4: 105220850-105220870 | ACCCCACAGUCUCUUUCUGC | 5612 |
| 54790_2_6858 | + | chr4: 105220851-105220871 | CCCCACAGUCUCUUUCUGCU | 5613 |
| 54790_2_6859 | + | chr4: 105220852-105220872 | CCCACAGUCUCUUUCUGCUG | 5614 |
| 54790_2_6862 | + | chr4: 105220866-105220886 | CUGCUGGGGCAUCCUUGCCC | 5615 |
| 54790_2_6878 | + | chr4: 105220953-105220973 | UAAUUGAAAGUUUCAAGCAU | 5616 |
| 54790_2_6886 | + | chr4: 105220990-105221010 | UCCUAGACAGUGUUCCAGUA | 5617 |
| 54790_2_6890 | + | chr4: 105221024-105221044 | ACAAUUAUCCAUUCUAAUAA | 5618 |
| 54790_2_6891 | + | chr4: 105221025-105221045 | CAAUUAUCCAUUCUAAUAAU | 5619 |
| 54790_2_6920 | + | chr4: 105221158-105221178 | UCCUUCAGUACACACUAGUU | 5620 |
| 54790_2_6926 | + | chr4: 105221168-105221188 | CACACUAGUUUGGUGAGACU | 5621 |
| 54790_2_6930 | + | chr4: 105221175-105221195 | GUUUGGUGAGACUUGGAGAA | 5622 |
| 54790_2_6935 | + | chr4: 105221180-105221200 | GUGAGACUUGGAGAAAGGCC | 5623 |
| 54790_2_6938 | + | chr4: 105221211-105221231 | CAAAUUCAAAAAACAAUUCC | 5624 |
| 54790_2_6941 | + | chr4: 105221227-105221247 | UUCCAGGAUUAACAGAUAAG | 5625 |
| 54790_2_6950 | + | chr4: 105221278-105221298 | UCAUUUUACCAAUAAGAAAC | 5626 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_6951 | + | chr4: 105221282-105221302 | UUUACCAAUAAGAAACUGGU | 5627 |
| 54790_2_6956 | + | chr4: 105221291-105221311 | AAGAAACUGGUUGGUUAACU | 5628 |
| 54790_2_6957 | + | chr4: 105221292-105221312 | AGAAACUGGUUGGUUAACUU | 5629 |
| 54790_2_6963 | + | chr4: 105221325-105221345 | AAAGCAGAUUUAUACUAAAC | 5630 |
| 54790_2_6964 | + | chr4: 105221329-105221349 | CAGAUUUAUACUAAACUGGC | 5631 |
| 54790_2_6969 | + | chr4: 105221391-105221411 | AAUCUGCCUCUCAUCUUCAA | 5632 |
| 54790_2_6991 | + | chr4: 105221488-105221508 | AGAUUUUAAAACUUUAAACA | 5633 |
| 54790_2_6994 | + | chr4: 105221489-105221509 | GAUUUUAAAACUUUAAACAU | 5634 |
| 54790_2_6998 | + | chr4: 105221500-105221520 | UUUAAACAUGGGAAUUAAAU | 5635 |
| 54790_2_7003 | + | chr4: 105221511-105221531 | GAAUUAAAUAGGCCCUACUG | 5636 |
| 54790_2_7009 | + | chr4: 105221559-105221579 | CUAUGCACAUGAUUUAGAUU | 5637 |
| 54790_2_7018 | + | chr4: 105221623-105221643 | AAUUAACACCUUUUCAGAAA | 5638 |
| 54790_2_7021 | + | chr4: 105221626-105221646 | UAACACCUUUUCAGAAAUGG | 5639 |
| 54790_2_7028 | + | chr4: 105221640-105221660 | AAAUGGAGGAACUUUCUCUG | 5640 |
| 54790_2_7059 | + | chr4: 105221723-105221743 | AUUAUUAUACUUUAAGUUUU | 5641 |
| 54790_2_7061 | + | chr4: 105221724-105221744 | UUAUUAUACUUUAAGUUUUA | 5642 |
| 54790_2_7065 | + | chr4: 105221731-105221751 | ACUUUAAGUUUUAGGGUACA | 5643 |
| 54790_2_7066 | + | chr4: 105221732-105221752 | CUUUAAGUUUUAGGGUACAU | 5644 |
| 54790_2_7072 | + | chr4: 105221745-105221765 | GGUACAUGGGCACAAUGUGC | 5645 |
| 54790_2_7075 | + | chr4: 105221777-105221797 | UAUGUAUACAUGUGCCAUGC | 5646 |
| 54790_2_7076 | + | chr4: 105221813-105221833 | CUAACUCGUCAUCUAGCAUU | 5647 |
| 54790_2_7089 | + | chr4: 105221939-105221959 | CACCUAUGAGUGAGAAUAUG | 5648 |
| 54790_2_7090 | + | chr4: 105221946-105221966 | GAGUGAGAAUAUGCGGUGUU | 5649 |
| 54790_2_7108 | + | chr4: 105222012-105222032 | UUUCAUCCAUGUCCCUACAA | 5650 |
| 54790_2_7112 | + | chr4: 105222036-105222056 | CAUGAACUCAUCAUUUUUUA | 5651 |
| 54790_2_7115 | + | chr4: 105222054-105222074 | UAUGGCUGCAUAGUAUUCCA | 5652 |
| 54790_2_7124 | + | chr4: 105222097-105222117 | UUAAUCCAGUCUAUCAUUGU | 5653 |
| 54790_2_7127 | + | chr4: 105222105-105222125 | GUCUAUCAUUGUUGGACAUU | 5654 |
| 54790_2_7128 | + | chr4: 105222106-105222126 | UCUAUCAUUGUUGGACAUUA | 5655 |
| 54790_2_7129 | + | chr4: 105222110-105222130 | UCAUUGUUGGACAUUAGGGU | 5656 |
| 54790_2_7142 | + | chr4: 105222196-105222216 | CAGCAUGAUUUAUAGUCCUU | 5657 |
| 54790_2_7143 | + | chr4: 105222197-105222217 | AGCAUGAUUUAUAGUCCUUU | 5658 |
| 54790_2_7147 | + | chr4: 105222214-105222234 | UUUGGGUAUAAACCCAGUAA | 5659 |
| 54790_2_7149 | + | chr4: 105222215-105222235 | UUGGGUAUAAACCCAGUAAU | 5660 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_7152 | + | chr4: 105222219-105222239 | GUAUAAACCCAGUAAUGGGA | 5661 |
| 54790_2_7153 | + | chr4: 105222232-105222252 | AAUGGGAUGGCUCAGUCAAA | 5662 |
| 54790_2_7157 | + | chr4: 105222257-105222277 | UUUCUAGUUCUAGAUCCCUG | 5663 |
| 54790_2_7161 | + | chr4: 105222283-105222303 | CGCCACACUGACUUCCACAA | 5664 |
| 54790_2_7172 | + | chr4: 105222391-105222411 | UUAAUGAUCGCCAUUCUAAC | 5665 |
| 54790_2_7179 | + | chr4: 105222414-105222434 | UGUGAGAUGAUAUCUCAUUG | 5666 |
| 54790_2_7181 | + | chr4: 105222438-105222458 | UUUGAUUUCAUUUCUCUGA | 5667 |
| 54790_2_7187 | + | chr4: 105222448-105222468 | AUUUCUCUGAUGGCCAGUGA | 5668 |
| 54790_2_7192 | + | chr4: 105222474-105222494 | GCAUUUUUCAUGUGUCUUU | 5669 |
| 54790_2_7209 | + | chr4: 105222534-105222554 | GUGCUUCGCCCACUUUUUGA | 5670 |
| 54790_2_7211 | + | chr4: 105222535-105222555 | UGCUUCGCCCACUUUUUGAU | 5671 |
| 54790_2_7231 | + | chr4: 105222585-105222605 | UUUGAGUUCUUUGUAGAUUC | 5672 |
| 54790_2_7239 | + | chr4: 105222612-105222632 | UAGCCCUUUGUCAGAUGAGU | 5673 |
| 54790_2_7246 | + | chr4: 105222639-105222659 | GAAAAUUUCUGCCAUUUUG | 5674 |
| 54790_2_7247 | + | chr4: 105222640-105222660 | AAAAUUUCUGCCAUUUUGU | 5675 |
| 54790_2_7254 | + | chr4: 105222660-105222680 | GGGUUGCCUGUUCACUCUGA | 5676 |
| 54790_2_7266 | + | chr4: 105222720-105222740 | UAGAUCCCAUUUGUCAAUUU | 5677 |
| 54790_2_7273 | + | chr4: 105222742-105222762 | GCUUUUGUUGCCAUUGCUUU | 5678 |
| 54790_2_7287 | + | chr4: 105222786-105222806 | GCCCGUGCCUAUGUCGUGAA | 5679 |
| 54790_2_7289 | + | chr4: 105222797-105222817 | UGUCGUGAAUGGUGUUGCCU | 5680 |
| 54790_2_7291 | + | chr4: 105222809-105222829 | UGUUGCCUAGGUUUUCUUCU | 5681 |
| 54790_2_7292 | + | chr4: 105222810-105222830 | GUUGCCUAGGUUUUCUUCUA | 5682 |
| 54790_2_7294 | + | chr4: 105222819-105222839 | GUUUUCUUCUAGGGUUUUUA | 5683 |
| 54790_2_7298 | + | chr4: 105222826-105222846 | UCUAGGGUUUUAUGGUUUU | 5684 |
| 54790_2_7312 | + | chr4: 105222874-105222894 | CUUGAAUUGAUUUUUGUAUA | 5685 |
| 54790_2_7315 | + | chr4: 105222881-105222901 | UGAUUUUGUAUAAGGUGUA | 5686 |
| 54790_2_7320 | + | chr4: 105222885-105222905 | UUUUGUAUAAGGUGUAAGGA | 5687 |
| 54790_2_7321 | + | chr4: 105222886-105222906 | UUUGUAUAAGGUGUAAGGAA | 5688 |
| 54790_2_7326 | + | chr4: 105222912-105222932 | CAGUUUCAGCUUUCCACAUA | 5689 |
| 54790_2_7333 | + | chr4: 105222947-105222967 | CCCAGCACCAUUUAUUAAAU | 5690 |
| 54790_2_7338 | + | chr4: 105222948-105222968 | CCAGCACCAUUUAUUAAAUA | 5691 |
| 54790_2_7343 | + | chr4: 105222979-105222999 | CCCCAUUUCUUGUUUUUCUC | 5692 |
| 54790_2_7354 | + | chr4: 105223012-105223032 | AUCAGAUAGUUGUAGAUAUG | 5693 |
| 54790_2_7358 | + | chr4: 105223026-105223046 | GAUAUGUGGCCUUAUUUCUG | 5694 |
| 54790_2_7359 | + | chr4: 105223027-105223047 | AUAUGUGGCCUUAUUUCUGA | 5695 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_7365 | + | chr4: 105223064-105223084 | AUUGAUCUAUAUCUCUGUUU | 5696 |
| 54790_2_7368 | + | chr4: 105223077-105223097 | UCUGUUUUGGUACCAGCACC | 5697 |
| 54790_2_7402 | + | chr4: 105223234-105223254 | UCUCCAUACUUAAUCCAUAU | 5698 |
| 54790_2_7406 | + | chr4: 105223251-105223271 | UAUAGGAAACAUUAUAUUCC | 5699 |
| 54790_2_7407 | + | chr4: 105223263-105223283 | UAUAUUCCAGGUCUAACAUG | 5700 |
| 54790_2_7418 | + | chr4: 105223305-105223325 | CUGUUGAAAAAUAUAUGUUU | 5701 |
| 54790_2_7455 | + | chr4: 105223440-105223460 | UUUACCUCAAGAGUGAGACU | 5702 |
| 54790_2_7464 | + | chr4: 105223486-105223506 | AAUUUUAAAGUCAAACGAAA | 5703 |
| 54790_2_7475 | + | chr4: 105223538-105223558 | AUUUAAACUAACAUUUUGCU | 5704 |
| 54790_2_7477 | + | chr4: 105223539-105223559 | UUUAAACUAACAUUUUGCUC | 5705 |
| 54790_2_7487 | + | chr4: 105223561-105223581 | GAUUUAGAACACUAUACAG | 5706 |
| 54790_2_7488 | + | chr4: 105223562-105223582 | AUUUUAGAACACUAUACAGA | 5707 |
| 54790_2_7502 | + | chr4: 105223652-105223672 | AAGCUAUGUCCCAUGUUGAU | 5708 |
| 54790_2_7508 | + | chr4: 105223673-105223693 | GGAAGAAUCCAAAAUAGUUU | 5709 |
| 54790_2_7514 | + | chr4: 105223695-105223715 | GAGAAUAAUGCCAUCUAUGC | 5710 |
| 54790_2_7517 | + | chr4: 105223698-105223718 | AAUAAUGCCAUCUAUGCAGG | 5711 |
| 54790_2_7518 | + | chr4: 105223703-105223723 | UGCCAUCUAUGCAGGAGGUG | 5712 |
| 54790_2_7530 | + | chr4: 105223781-105223801 | ACACUCUGAAUUACUAAUAG | 5713 |
| 54790_2_7535 | + | chr4: 105223797-105223817 | AUAGAGGUGAAGCCUGUCAG | 5714 |
| 54790_2_7550 | + | chr4: 105223929-105223949 | AUCUGAAUGUAUAAAUAAAC | 5715 |
| 54790_2_7551 | + | chr4: 105223940-105223960 | UAAAUAAACAGGAUUCAUGA | 5716 |
| 54790_2_7555 | + | chr4: 105223972-105223992 | UUAUAUAUACUUGUAGUAUU | 5717 |
| 54790_2_7561 | + | chr4: 105223994-105224014 | GACAUGCAAAACUUAUUUUA | 5718 |
| 54790_2_7567 | + | chr4: 105224024-105224044 | UAAUUUACUACCUUAUAGUA | 5719 |
| 54790_2_7592 | + | chr4: 105224217-105224237 | AGCAUAUCUACAGCUUUAUG | 5720 |
| 54790_2_7601 | + | chr4: 105224263-105224283 | GAGUAAUCCGAAGAGUCAAA | 5721 |
| 54790_2_7604 | + | chr4: 105224268-105224288 | AUCCGAAGAGUCAAAUGGUA | 5722 |
| 54790_2_7606 | + | chr4: 105224298-105224318 | UUACAGUCCUAAAUGCAUAU | 5723 |
| 54790_2_7618 | + | chr4: 105224372-105224392 | GCAUCAUAGCAUCUUCAAAG | 5724 |
| 54790_2_7621 | + | chr4: 105224391-105224411 | GAGGCCUGUCAUAAUUAUGA | 5725 |
| 54790_2_7632 | + | chr4: 105224482-105224502 | AUAAUAAAUUAUUUUCAGAG | 5726 |
| 54790_2_7636 | + | chr4: 105224485-105224505 | AUAAAUUAUUUUCAGAGAGG | 5727 |
| 54790_2_7638 | + | chr4: 105224486-105224506 | UAAAUUAUUUUCAGAGAGGC | 5728 |
| 54790_2_7643 | + | chr4: 105224492-105224512 | AUUUUCAGAGAGGCGGGAGA | 5729 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_7649 | + | chr4: 105224506-105224526 | GGGAGAAGGAACAAAAUCAA | 5730 |
| 54790_2_7651 | + | chr4: 105224519-105224539 | AAAUCAAAGGAAAACUGCUG | 5731 |
| 54790_2_7652 | + | chr4: 105224535-105224555 | GCUGUGGCUAAAACCUGUUU | 5732 |
| 54790_2_7655 | + | chr4: 105224542-105224562 | CUAAAACCUGUUUUGGUCUU | 5733 |
| 54790_2_7660 | + | chr4: 105224572-105224592 | AAUGUUAGCUAGUAGUCAAA | 5734 |
| 54790_2_7669 | + | chr4: 105224636-105224656 | GCCUCUGACAUAGAAGAUAA | 5735 |
| 54790_2_7674 | + | chr4: 105224733-105224753 | UAGCUUAUGAAAAUUUAUUC | 5736 |
| 54790_2_7676 | + | chr4: 105224734-105224754 | AGCUUAUGAAAAUUUAUUCU | 5737 |
| 54790_2_7677 | + | chr4: 105224735-105224755 | GCUUAUGAAAAUUUAUUCUG | 5738 |
| 54790_2_7684 | + | chr4: 105224758-105224778 | CAUUAGCUGAAAUUAUUGAG | 5739 |
| 54790_2_7690 | + | chr4: 105224801-105224821 | UCUAUUUAUGUUAAAUUGCC | 5740 |
| 54790_2_7703 | + | chr4: 105224837-105224857 | UUUAGAAUUCUGAAAAAAA | 5741 |
| 54790_2_7705 | + | chr4: 105224840-105224860 | AGAAUUCUGAAAAAAAUGG | 5742 |
| 54790_2_7713 | + | chr4: 105224871-105224891 | GUAAAUAGAAAUAUUCUUUU | 5743 |
| 54790_2_7715 | + | chr4: 105224879-105224899 | AAAUAUUCUUUUUGGUUCCU | 5744 |
| 54790_2_7726 | + | chr4: 105224914-105224934 | UACAAGAACAUUAGAUUAU | 5745 |
| 54790_2_7730 | + | chr4: 105224923-105224943 | CAUUAGAUUAUUGGAAUAAA | 5746 |
| 54790_2_7736 | + | chr4: 105224949-105224969 | GACAUACAUAAUAUGACUAG | 5747 |
| 54790_2_7737 | + | chr4: 105224950-105224970 | ACAUACAUAAUAUGACUAGU | 5748 |
| 54790_2_7743 | + | chr4: 105225001-105225021 | AUUUAAUUAGUCUGUCAUUU | 5749 |
| 54790_2_7767 | + | chr4: 105225117-105225137 | AAUUCACUUUGUUGCCUUUU | 5750 |
| 54790_2_7792 | + | chr4: 105225274-105225294 | AACAUGCCAUGUAUUUUCCU | 5751 |
| 54790_2_7794 | + | chr4: 105225280-105225300 | CCAUGUAUUUUCCUAGGUUA | 5752 |
| 54790_2_7795 | + | chr4: 105225281-105225301 | CAUGUAUUUUCCUAGGUUAA | 5753 |
| 54790_2_7815 | + | chr4: 105225364-105225384 | CGCUCUAUGAGUUUUUAUG | 5754 |
| 54790_2_7824 | + | chr4: 105225408-105225428 | ACUGAUGCACAUUUCUCCUU | 5755 |
| 54790_2_7825 | + | chr4: 105225415-105225435 | CACAUUUCUCCUUAGGUCAC | 5756 |
| 54790_2_7830 | + | chr4: 105225441-105225461 | UCCUCCCUCAGCAAUGUUGU | 5757 |
| 54790_2_7842 | + | chr4: 105225507-105225527 | AGUGUUUUCUCUCAUACUA | 5758 |
| 54790_2_7854 | + | chr4: 105225546-105225566 | UAAAUUUUACAAGAGUGACU | 5759 |
| 54790_2_7855 | + | chr4: 105225547-105225567 | AAAUUUUACAAGAGUGACUU | 5760 |
| 54790_2_7857 | + | chr4: 105225550-105225570 | UUUUACAAGAGUGACUUGGG | 5761 |
| 54790_2_7863 | + | chr4: 105225572-105225592 | GCUGAUAUGCCCACAUUGAC | 5762 |
| 54790_2_7865 | + | chr4: 105225573-105225593 | CUGAUAUGCCCACAUUGACA | 5763 |
| 54790_2_7868 | + | chr4: 105225612-105225632 | UCCCCUCUCCUGUAUUCCCA | 5764 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_7874 | + | chr4: 105225654-105225674 | CCUCAACAUAACCACAGUUC | 5765 |
| 54790_2_7875 | + | chr4: 105225655-105225675 | CUCAACAUAACCACAGUUCA | 5766 |
| 54790_2_7878 | + | chr4: 105225664-105225684 | ACCACAGUUCAGGGCAGUAG | 5767 |
| 54790_2_7882 | + | chr4: 105225698-105225718 | UUUGUGUUAGCUCCAUGCCA | 5768 |
| 54790_2_7889 | + | chr4: 105225716-105225736 | CAUGGCAACUGCACUGAGUG | 5769 |
| 54790_2_7891 | + | chr4: 105225736-105225756 | AGGAUUCAACUCAGUGCAGC | 5770 |
| 54790_2_7899 | + | chr4: 105225797-105225817 | AUUCUCUGAGUGACAUUAUC | 5771 |
| 54790_2_7902 | + | chr4: 105225798-105225818 | UUCUCUGAGUGACAUUAUCA | 5772 |
| 54790_2_7904 | + | chr4: 105225799-105225819 | UCUCUGAGUGACAUUAUCAG | 5773 |
| 54790_2_7914 | + | chr4: 105225870-105225890 | CCAGCAUUGCAAAGAUAAUC | 5774 |
| 54790_2_7915 | + | chr4: 105225871-105225891 | CAGCAUUGCAAAGAUAAUCU | 5775 |
| 54790_2_7917 | + | chr4: 105225875-105225895 | AUUGCAAAGAUAAUCUGGGA | 5776 |
| 54790_2_7918 | + | chr4: 105225878-105225898 | GCAAAGAUAAUCUGGGAAGG | 5777 |
| 54790_2_7922 | + | chr4: 105225887-105225907 | AUCUGGGAAGGUGGCAAAGA | 5778 |
| 54790_2_7924 | + | chr4: 105225888-105225908 | UCUGGGAAGGUGGCAAAGAA | 5779 |
| 54790_2_7927 | + | chr4: 105225906-105225926 | AAGGGAUCAGAAUAACUCUG | 5780 |
| 54790_2_7943 | + | chr4: 105225986-105226006 | CACAUAAAGAAAUGAUUUGU | 5781 |
| 54790_2_7956 | + | chr4: 105226099-105226119 | AAAAAAAAGCUUAAAUUGU | 5782 |
| 54790_2_7968 | + | chr4: 105226163-105226183 | GCACUUGUCUUAGUAUUGUG | 5783 |
| 54790_2_7971 | + | chr4: 105226166-105226186 | CUUGUCUUAGUAUUGUGUGG | 5784 |
| 54790_2_7973 | + | chr4: 105226167-105226187 | UUGUCUUAGUAUUGUGUGGU | 5785 |
| 54790_2_7981 | + | chr4: 105226199-105226219 | AGAGAGCUGCCAGAGUGCUU | 5786 |
| 54790_2_7986 | + | chr4: 105226213-105226233 | GUGCUUAGGCCUAGUCCCUG | 5787 |
| 54790_2_7988 | + | chr4: 105226214-105226234 | UGCUUAGGCCUAGUCCCUGU | 5788 |
| 54790_2_7990 | + | chr4: 105226228-105226248 | CCCUGUGGGAGCCUCUGUUU | 5789 |
| 54790_2_7992 | + | chr4: 105226241-105226261 | UCUGUUUGGUGCUUCACCA | 5790 |
| 54790_2_7993 | + | chr4: 105226242-105226262 | CUGUUUUGGUGCUUCACCAU | 5791 |
| 54790_2_8005 | + | chr4: 105226282-105226302 | ACAUCUUUAAAAUGAGAAAA | 5792 |
| 54790_2_8011 | + | chr4: 105226327-105226347 | UGAAAUGUUUAUACAUUGUU | 5793 |
| 54790_2_8027 | + | chr4: 105226393-105226413 | AAUUCUUAGCCGUGUGAUA | 5794 |
| 54790_2_8029 | + | chr4: 105226398-105226418 | CUUAGCCGUGUGAUAUGGUU | 5795 |
| 54790_2_8032 | + | chr4: 105226405-105226425 | GUGUGAUAUGGUUUGGUUGU | 5796 |
| 54790_2_8039 | + | chr4: 105226446-105226466 | UGAAAUAUAAUCCCCAGUGU | 5797 |
| 54790_2_8042 | + | chr4: 105226449-105226469 | AAUAUAAUCCCCAGUGUUGG | 5798 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_8045 | + | chr4: 105226452-105226472 | AUAAUCCCCAGUGUUGGAGG | 5799 |
| 54790_2_8046 | + | chr4: 105226453-105226473 | UAAUCCCCAGUGUUGGAGGU | 5800 |
| 54790_2_8048 | + | chr4: 105226454-105226474 | AAUCCCCAGUGUUGGAGGUG | 5801 |
| 54790_2_8049 | + | chr4: 105226455-105226475 | AUCCCCAGUGUUGGAGGUGG | 5802 |
| 54790_2_8050 | + | chr4: 105226460-105226480 | CAGUGUUGGAGGUGGGGGCC | 5803 |
| 54790_2_8053 | + | chr4: 105226463-105226483 | UGUUGGAGGUGGGGCCUGG | 5804 |
| 54790_2_8055 | + | chr4: 105226464-105226484 | GUUGGAGGUGGGGCCUGGU | 5805 |
| 54790_2_8058 | + | chr4: 105226474-105226494 | GGGGCCUGGUGGGAAGUGUU | 5806 |
| 54790_2_8060 | + | chr4: 105226482-105226502 | GUGGGAAGUGUUUGGAUUAU | 5807 |
| 54790_2_8062 | + | chr4: 105226483-105226503 | UGGGAAGUGUUUGGAUUAUU | 5808 |
| 54790_2_8063 | + | chr4: 105226484-105226504 | GGGAAGUGUUUGGAUUAUUG | 5809 |
| 54790_2_8066 | + | chr4: 105226498-105226518 | UUAUGGGGCAGAUCCCUCA | 5810 |
| 54790_2_8068 | + | chr4: 105226503-105226523 | GGGGCAGAUCCCUCAUGGCA | 5811 |
| 54790_2_8072 | + | chr4: 105226540-105226560 | UAGUGAGUUCUCAAGAGAUC | 5812 |
| 54790_2_8074 | + | chr4: 105226546-105226566 | GUUCUCAAGAGAUCUGGUUA | 5813 |
| 54790_2_8075 | + | chr4: 105226547-105226567 | UUCUCAAGAGAUCUGGUUAA | 5814 |
| 54790_2_8077 | + | chr4: 105226554-105226574 | GAGAUCUGGUUAAGGGUGUG | 5815 |
| 54790_2_8094 | + | chr4: 105226712-105226732 | CCAUGAUUAUAAGUUUUGUA | 5816 |
| 54790_2_8113 | + | chr4: 105226855-105226875 | AGCCUAACAUACCUUUCAAA | 5817 |
| 54790_2_8124 | + | chr4: 105226909-105226929 | GAUCUCUUUGUCCAGAAUUC | 5818 |
| 54790_2_8129 | + | chr4: 105226934-105226954 | AUAAAGAUGCCAAAAUAAUA | 5819 |
| 54790_2_8131 | + | chr4: 105226952-105226972 | UAUGGCAUGUAUUUGAUCUC | 5820 |
| 54790_2_8133 | + | chr4: 105226953-105226973 | AUGGCAUGUAUUUGAUCUCA | 5821 |
| 54790_2_8138 | + | chr4: 105226974-105226994 | GGAAUUUUCAUUUUUUCAAA | 5822 |
| 54790_2_8142 | + | chr4: 105226977-105226997 | AUUUCAUUUUUUCAAAAGG | 5823 |
| 54790_2_8152 | + | chr4: 105227010-105227030 | AAUAUAAUUUUUUAAUAUUU | 5824 |
| 54790_2_8168 | + | chr4: 105227065-105227085 | GAGCACAUUGUGAAACUUUC | 5825 |
| 54790_2_8171 | + | chr4: 105227083-105227103 | UCAGGAAUUGCAUGAGCUGU | 5826 |
| 54790_2_8179 | + | chr4: 105227129-105227149 | ACCCAUAAGAGCAUCUCCUG | 5827 |
| 54790_2_8192 | + | chr4: 105227211-105227231 | GACAUCAUGAAAAUCAUCCC | 5828 |
| 54790_2_8193 | + | chr4: 105227212-105227232 | ACAUCAUGAAAAUCAUCCCU | 5829 |
| 54790_2_8195 | + | chr4: 105227233-105227253 | GGUAAACAAUUAGUCACUCC | 5830 |
| 54790_2_8197 | + | chr4: 105227245-105227265 | GUCACUCCAGGUUUUCCCAA | 5831 |
| 54790_2_8206 | + | chr4: 105227305-105227325 | CAGUUUAACAACCCCAAAAA | 5832 |
| 54790_2_8209 | + | chr4: 105227321-105227341 | AAAAAGGCCUUAAUUUUGAU | 5833 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_8214 | + | chr4: 105227337-105227357 | UGAUUGGCCAGCAUCCUCUU | 5834 |
| 54790_2_8227 | + | chr4: 105227402-105227422 | AAUAAGAAUUGUUUCCAUCU | 5835 |
| 54790_2_8229 | + | chr4: 105227403-105227423 | AUAAGAAUUGUUUCCAUCUA | 5836 |
| 54790_2_8234 | + | chr4: 105227418-105227438 | AUCUAGGGAAUGAUUUUUAU | 5837 |
| 54790_2_8237 | + | chr4: 105227433-105227453 | UUUAUAGGUAGAAUCUUAUU | 5838 |
| 54790_2_8243 | + | chr4: 105227438-105227458 | AGGUAGAAUCUUAUUUGGCA | 5839 |
| 54790_2_8252 | + | chr4: 105227487-105227507 | UGUGUAGACCUUCAAUAGCA | 5840 |
| 54790_2_8263 | + | chr4: 105227559-105227579 | CAUAUUAAUUUUGUGUUCUC | 5841 |
| 54790_2_8273 | + | chr4: 105227578-105227598 | CUGGUGUAAGAAAAAAUAGA | 5842 |
| 54790_2_8317 | + | chr4: 105227827-105227847 | CUCUACUUUCACUGAAUAGC | 5843 |
| 54790_2_8321 | + | chr4: 105227838-105227858 | CUGAAUAGCAGGUGAAUAGC | 5844 |
| 54790_2_8348 | + | chr4: 105228004-105228024 | CUACAAUGAGCAAAAUGCAU | 5845 |
| 54790_2_8364 | + | chr4: 105228095-105228115 | UUGAAAGAGUACUGUGCAAG | 5846 |
| 54790_2_8365 | + | chr4: 105228096-105228116 | UGAAAGAGUACUGUGCAAGU | 5847 |
| 54790_2_8368 | + | chr4: 105228103-105228123 | GUACUGUGCAAGUGGGUUAC | 5848 |
| 54790_2_8370 | + | chr4: 105228119-105228139 | UUACUGGAUCAUAAUAUUCC | 5849 |
| 54790_2_8371 | + | chr4: 105228120-105228140 | UACUGGAUCAUAAUAUUCCA | 5850 |
| 54790_2_8379 | + | chr4: 105228194-105228214 | GCAUUUUCUCCUUCUAAAA | 5851 |
| 54790_2_8406 | + | chr4: 105228320-105228340 | CAUUAAACUUUUCACACAAA | 5852 |
| 54790_2_8410 | + | chr4: 105228331-105228351 | UCACACAAAUGGUUGUAUAA | 5853 |
| 54790_2_8415 | + | chr4: 105228377-105228397 | UUCUGUAUAAUGUUUAAAAA | 5854 |
| 54790_2_8435 | + | chr4: 105228460-105228480 | GUAGCUAUUAUUAUACUCAA | 5855 |
| 54790_2_8447 | + | chr4: 105228501-105228521 | AAAGAAUGUCCAAAAUUAUG | 5856 |
| 54790_2_8450 | + | chr4: 105228506-105228526 | AUGUCCAAAAUUAUGUGGAA | 5857 |
| 54790_2_8471 | + | chr4: 105228669-105228689 | UGAUUGCUCUGUAUAUGAAU | 5858 |
| 54790_2_8482 | + | chr4: 105228707-105228727 | AAAGAAAAGUGCCUUUUUU | 5859 |
| 54790_2_8484 | + | chr4: 105228717-105228737 | UGCCUUUUUUGGUAGUAUC | 5860 |
| 54790_2_8485 | + | chr4: 105228722-105228742 | UUUUUGGUAGUAUCUGGAC | 5861 |
| 54790_2_8493 | + | chr4: 105228744-105228764 | GUAAUUGACUUUCUUUCUGC | 5862 |
| 54790_2_8513 | + | chr4: 105228806-105228826 | AAGUGAUAGUGUCCUGAUUU | 5863 |
| 54790_2_8524 | + | chr4: 105228875-105228895 | AAACCUAAAGUUUCUUUAUU | 5864 |
| 54790_2_8542 | + | chr4: 105228952-105228972 | GAAACAUAAUGUAAGCCACA | 5865 |
| 54790_2_8585 | + | chr4: 105229145-105229165 | AUAGAUACCACAUCUCAAUU | 5866 |
| 54790_2_8588 | + | chr4: 105229163-105229183 | UUUGGACUAGACACAUUUUA | 5867 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_8589 | + | chr4: 105229164-105229184 | UUGGACUAGACACAUUUUAA | 5868 |
| 54790_2_8596 | + | chr4: 105229196-105229216 | UAUAUGUGACUAGUCACUGU | 5869 |
| 54790_2_8600 | + | chr4: 105229230-105229250 | CUAGACCAUCUCUUAAUGUA | 5870 |
| 54790_2_8603 | + | chr4: 105229234-105229254 | ACCAUCUCUUAAUGUAUGGA | 5871 |
| 54790_2_8626 | + | chr4: 105229333-105229353 | CAGAGUCUCGCUCUGUUGCC | 5872 |
| 54790_2_8628 | + | chr4: 105229337-105229357 | GUCUCGCUCUGUUGCCAGGC | 5873 |
| 54790_2_8630 | + | chr4: 105229347-105229367 | GUUGCCAGGCUGGAGUGCAG | 5874 |
| 54790_2_8632 | + | chr4: 105229358-105229378 | GGAGUGCAGUGGCGCGAUCU | 5875 |
| 54790_2_8634 | + | chr4: 105229382-105229402 | UCACUGCAACCUCCGCCUCC | 5876 |
| 54790_2_8635 | + | chr4: 105229383-105229403 | CACUGCAACCUCCGCCUCCU | 5877 |
| 54790_2_8640 | + | chr4: 105229422-105229442 | GCCUCAGCCUCCCAAGUAAC | 5878 |
| 54790_2_8641 | + | chr4: 105229423-105229443 | CCUCAGCCUCCCAAGUAACU | 5879 |
| 54790_2_8642 | + | chr4: 105229431-105229451 | UCCCAAGUAACUGGGACUAC | 5880 |
| 54790_2_8643 | + | chr4: 105229475-105229495 | ACUUUUGUAUUUUUAGUAG | 5881 |
| 54790_2_8644 | + | chr4: 105229478-105229498 | UUUUGUAUUUUUAGUAGUGG | 5882 |
| 54790_2_8653 | + | chr4: 105229494-105229514 | GUGGCGGUGUUUGACCACGU | 5883 |
| 54790_2_8654 | + | chr4: 105229503-105229523 | UUUGACCACGUUGGCCAAGA | 5884 |
| 54790_2_8661 | + | chr4: 105229555-105229575 | GCCUCAGCCUCCCAAAGUGC | 5885 |
| 54790_2_8662 | + | chr4: 105229556-105229576 | CCUCAGCCUCCCAAAGUGCU | 5886 |
| 54790_2_8663 | + | chr4: 105229564-105229584 | UCCCAAAGUGCUGGGACUAC | 5887 |
| 54790_2_8665 | + | chr4: 105229583-105229603 | CAGGCGUGAGCCACCGUGCC | 5888 |
| 54790_2_8673 | + | chr4: 105229620-105229640 | UAUUAAGUAAUACACAUGCU | 5889 |
| 54790_2_8680 | + | chr4: 105229645-105229665 | GUUAUUUAAAAAAAAAAAAA | 5890 |
| 54790_2_8691 | + | chr4: 105229706-105229726 | AGCUGCCCAUUCCUUUUCC | 5891 |
| 54790_2_8692 | + | chr4: 105229709-105229729 | UGCCCAUUCCUUUUCCUGG | 5892 |
| 54790_2_8694 | + | chr4: 105229722-105229742 | UUCCUGGAGGCAAAUUAUUA | 5893 |
| 54790_2_8704 | + | chr4: 105229772-105229792 | GAUUUUUUUUAUUUUACAA | 5894 |
| 54790_2_8707 | + | chr4: 105229778-105229798 | UUUUUAUUUUACAAAGGUAU | 5895 |
| 54790_2_8722 | + | chr4: 105229835-105229855 | CCUUUAUUCCAUUUAAUUAC | 5896 |
| 54790_2_8724 | + | chr4: 105229836-105229856 | CUUUAUUCCAUUUAAUUACU | 5897 |
| 54790_2_8736 | + | chr4: 105229886-105229906 | UACUAAUUUUAAUAGCUACA | 5898 |
| 54790_2_8740 | + | chr4: 105229901-105229921 | CUACAUGGUAUUAUAUUGUG | 5899 |
| 54790_2_8745 | + | chr4: 105229942-105229962 | AACAUAACCCUUAUUGAUGU | 5900 |
| 54790_2_8768 | + | chr4: 105230064-105230084 | AGUGUCUCACUCUGUCACCC | 5901 |
| 54790_2_8771 | + | chr4: 105230068-105230088 | UCUCACUCUGUCACCCAGGC | 5902 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_8773 | + | chr4: 105230113-105230133 | UCACUGCAGUGUCCACCUCC | 5903 |
| 54790_2_8774 | + | chr4: 105230114-105230134 | CACUGCAGUGUCCACCUCCU | 5904 |
| 54790_2_8775 | + | chr4: 105230120-105230140 | AGUGUCCACCUCCUGGGUUC | 5905 |
| 54790_2_8781 | + | chr4: 105230153-105230173 | UCCUCAGCCUCCCAAGUAAC | 5906 |
| 54790_2_8782 | + | chr4: 105230154-105230174 | CCUCAGCCUCCCAAGUAACU | 5907 |
| 54790_2_8784 | + | chr4: 105230162-105230182 | UCCCAAGUAACUGGGAUUAC | 5908 |
| 54790_2_8787 | + | chr4: 105230203-105230223 | GCUAAUUUUGUAUCUUUUU | 5909 |
| 54790_2_8791 | + | chr4: 105230211-105230231 | UUGUAUCUUUUAGGAGAGA | 5910 |
| 54790_2_8794 | + | chr4: 105230212-105230232 | UGUAUCUUUUAGGAGAGAC | 5911 |
| 54790_2_8802 | + | chr4: 105230227-105230247 | GAGACGGGAUUUCACCAUGU | 5912 |
| 54790_2_8803 | + | chr4: 105230232-105230252 | GGGAUUUCACCAUGUUGGCC | 5913 |
| 54790_2_8804 | + | chr4: 105230236-105230256 | UUUCACCAUGUUGGCCAGGU | 5914 |
| 54790_2_8809 | + | chr4: 105230250-105230270 | CCAGGUUGGUCUAGAACUCC | 5915 |
| 54790_2_8810 | + | chr4: 105230257-105230277 | GGUCUAGAACUCCUGGCCUC | 5916 |
| 54790_2_8812 | + | chr4: 105230268-105230288 | CCUGGCCUCAGGUGAUCCAC | 5917 |
| 54790_2_8815 | + | chr4: 105230290-105230310 | GCCUUAGCUUCCCAAAGUGC | 5918 |
| 54790_2_8816 | + | chr4: 105230291-105230311 | CCUUAGCUUCCCAAAGUGCU | 5919 |
| 54790_2_8818 | + | chr4: 105230299-105230319 | UCCCAAAGUGCUGGGAUUAU | 5920 |
| 54790_2_8823 | + | chr4: 105230342-105230362 | CUGUCAGAUAAAUUCUUAAA | 5921 |
| 54790_2_8824 | + | chr4: 105230343-105230363 | UGUCAGAUAAAUUCUUAAAA | 5922 |
| 54790_2_8827 | + | chr4: 105230349-105230369 | AUAAAUUCUUAAAAGGGUCA | 5923 |
| 54790_2_8837 | + | chr4: 105230408-105230428 | GUCAUCCUACAUGAUAUUUG | 5924 |
| 54790_2_8852 | + | chr4: 105230506-105230526 | GCUUACUGAUCUUCACUAAU | 5925 |
| 54790_2_8886 | + | chr4: 105230654-105230674 | CUUGUCCAUUUUUAGUAUG | 5926 |
| 54790_2_8893 | + | chr4: 105230673-105230693 | GUGGUUAUUCAUUUAUUUGU | 5927 |
| 54790_2_8909 | + | chr4: 105230734-105230754 | CUCUUUUACAUGUUUAUUU | 5928 |
| 54790_2_8944 | + | chr4: 105230855-105230875 | CUCAGAUUGUUUUUAACUUU | 5929 |
| 54790_2_8947 | + | chr4: 105230856-105230876 | UCAGAUUGUUUUUAACUUUU | 5930 |
| 54790_2_8951 | + | chr4: 105230857-105230877 | CAGAUUGUUUUUAACUUUUG | 5931 |
| 54790_2_8953 | + | chr4: 105230858-105230878 | AGAUUGUUUUUAACUUUUGG | 5932 |
| 54790_2_8954 | + | chr4: 105230859-105230879 | GAUUGUUUUUAACUUUUGGG | 5933 |
| 54790_2_8955 | + | chr4: 105230860-105230880 | AUUGUUUUUAACUUUUGGGG | 5934 |
| 54790_2_8976 | + | chr4: 105230917-105230937 | AGAAUUUAUCUUAAAGUGUA | 5935 |
| 54790_2_8977 | + | chr4: 105230918-105230938 | GAAUUUAUCUUAAAGUGUAA | 5936 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_8983 | + | chr4: 105230946-105230966 | UCCCACUUUAUCAUUUUUUC | 5937 |
| 54790_2_8998 | + | chr4: 105231018-105231038 | UAUCUUGUAGCAUAUUUCUG | 5938 |
| 54790_2_9001 | + | chr4: 105231023-105231043 | UGUAGCAUAUUUCUGUGGUU | 5939 |
| 54790_2_9002 | + | chr4: 105231024-105231044 | GUAGCAUAUUUCUGUGGUUU | 5940 |
| 54790_2_9026 | + | chr4: 105231136-105231156 | CUUUUAAAUAUCUUUUAAUU | 5941 |
| 54790_2_9031 | + | chr4: 105231144-105231164 | UAUCUUUUAAUUUGGCUACU | 5942 |
| 54790_2_9039 | + | chr4: 105231176-105231196 | AUUCUUUUCAGAAUAUUCC | 5943 |
| 54790_2_9050 | + | chr4: 105231212-105231232 | UUAUUUUUCCAAAUGAACUU | 5944 |
| 54790_2_9087 | + | chr4: 105231372-105231392 | UUUUAAAGUUAUAUUAAAAU | 5945 |
| 54790_2_9106 | + | chr4: 105231459-105231479 | AUUCCAGUAAAACUUCUGAC | 5946 |
| 54790_2_9110 | + | chr4: 105231481-105231501 | GUUGAUGCUCUUAUAAAUCA | 5947 |
| 54790_2_9122 | + | chr4: 105231552-105231572 | CAUUUUUACUUGAUUCUCU | 5948 |
| 54790_2_9178 | + | chr4: 105231748-105231768 | AAAUGUAAUGAGAAAGACUG | 5949 |
| 54790_2_9180 | + | chr4: 105231749-105231769 | AAUGUAAUGAGAAAGACUGU | 5950 |
| 54790_2_9183 | + | chr4: 105231777-105231797 | AAAGCAGACACCUUAUACAA | 5951 |
| 54790_2_9186 | + | chr4: 105231806-105231826 | UUUUUUAGUGCCAUUUCUUC | 5952 |
| 54790_2_9195 | + | chr4: 105231822-105231842 | CUUCUGGCUUUCUCUAUUAU | 5953 |
| 54790_2_9197 | + | chr4: 105231823-105231843 | UUCUGGCUUUCUCUAUUAUU | 5954 |
| 54790_2_9211 | + | chr4: 105231886-105231906 | AAUGAAUGCAAUCAGAUUCA | 5955 |
| 54790_2_9212 | + | chr4: 105231887-105231907 | AUGAAUGCAAUCAGAUUCAA | 5956 |
| 54790_2_9213 | + | chr4: 105231899-105231919 | AGAUUCAAGGGUACAAGUGC | 5957 |
| 54790_2_9215 | + | chr4: 105231908-105231928 | GGUACAAGUGCAGGUUAUAU | 5958 |
| 54790_2_9219 | + | chr4: 105231925-105231945 | UAUAGGUGAAUUGCAUGCCU | 5959 |
| 54790_2_9221 | + | chr4: 105231926-105231946 | AUAGGUGAAUUGCAUGCCUU | 5960 |
| 54790_2_9223 | + | chr4: 105231927-105231947 | UAGGUGAAUUGCAUGCCUUG | 5961 |
| 54790_2_9224 | + | chr4: 105231928-105231948 | AGGUGAAUUGCAUGCCUUGG | 5962 |
| 54790_2_9225 | + | chr4: 105231933-105231953 | AAUUGCAUGCCUUGGGGGUU | 5963 |
| 54790_2_9230 | + | chr4: 105231958-105231978 | UACAGACUAUUUUGUCACCC | 5964 |
| 54790_2_9234 | + | chr4: 105231981-105232001 | UAAUAAGCGUAGUACUUAAU | 5965 |
| 54790_2_9252 | + | chr4: 105232096-105232116 | CUGCCACUUAAGAGAACAUG | 5966 |
| 54790_2_9259 | + | chr4: 105232128-105232148 | GUUCCUUUGUUAGUUUGUUU | 5967 |
| 54790_2_9261 | + | chr4: 105232135-105232155 | UGUUAGUUUGUUUAGGAUAA | 5968 |
| 54790_2_9271 | + | chr4: 105232189-105232209 | CACGAUUUUGUGUUUCUUUA | 5969 |
| 54790_2_9277 | + | chr4: 105232207-105232227 | UAUGGCUGUGUAGUAUUCCA | 5970 |
| 54790_2_9284 | + | chr4: 105232248-105232268 | UUUAUCCAGUCUACUACUUA | 5971 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_9287 | + | chr4: 105232257-105232277 | UCUACUACUUACGGACAUUU | 5972 |
| 54790_2_9296 | + | chr4: 105232325-105232345 | ACGUGUGCAAUAUGCCUUUA | 5973 |
| 54790_2_9302 | + | chr4: 105232348-105232368 | UAGAAUGAUUUAUAUCCCUU | 5974 |
| 54790_2_9303 | + | chr4: 105232349-105232369 | AGAAUGAUUUAUAUCCCUUU | 5975 |
| 54790_2_9308 | + | chr4: 105232367-105232387 | UUGGGUAAUAUGCCGAAUAA | 5976 |
| 54790_2_9310 | + | chr4: 105232368-105232388 | UGGGUAAUAUGCCGAAUAAU | 5977 |
| 54790_2_9313 | + | chr4: 105232377-105232397 | UGCCGAAUAAUGGGAUUGCU | 5978 |
| 54790_2_9314 | + | chr4: 105232385-105232405 | AAUGGGAUUGCUCGGUCAGA | 5979 |
| 54790_2_9323 | + | chr4: 105232462-105232482 | UUACAUUCCCACAAGCAAUA | 5980 |
| 54790_2_9325 | + | chr4: 105232463-105232483 | UACAUUCCCACAAGCAAUAA | 5981 |
| 54790_2_9327 | + | chr4: 105232464-105232484 | ACAUUCCCACAAGCAAUAAG | 5982 |
| 54790_2_9332 | + | chr4: 105232489-105232509 | AAGUGUUCCCUUUUCUCUGC | 5983 |
| 54790_2_9343 | + | chr4: 105232521-105232541 | UUCUUUUAGAGAGUCAAAGA | 5984 |
| 54790_2_9350 | + | chr4: 105232530-105232550 | AGAGUCAAAGAUGGAAUCCU | 5985 |
| 54790_2_9351 | + | chr4: 105232531-105232551 | GAGUCAAAGAUGGAAUCCUA | 5986 |
| 54790_2_9354 | + | chr4: 105232547-105232567 | CCUAGGGAAGAUGAUAUCUG | 5987 |
| 54790_2_9355 | + | chr4: 105232551-105232571 | GGGAAGAUGAUAUCUGAGGC | 5988 |
| 54790_2_9358 | + | chr4: 105232565-105232585 | UGAGGCAGGUUUAGAGUCAU | 5989 |
| 54790_2_9359 | + | chr4: 105232566-105232586 | GAGGCAGGUUUAGAGUCAUU | 5990 |
| 54790_2_9362 | + | chr4: 105232575-105232595 | UUAGAGUCAUUGGGCAAAUA | 5991 |
| 54790_2_9364 | + | chr4: 105232576-105232596 | UAGAGUCAUUGGGCAAAUAA | 5992 |
| 54790_2_9365 | + | chr4: 105232577-105232597 | AGAGUCAUUGGGCAAAUAAG | 5993 |
| 54790_2_9370 | + | chr4: 105232587-105232607 | GGCAAAUAAGGGGAUUAAGA | 5994 |
| 54790_2_9371 | + | chr4: 105232596-105232616 | GGGGAUUAAGAAGGCAUUCU | 5995 |
| 54790_2_9375 | + | chr4: 105232614-105232634 | CUAGGCAGACAGAAAACCAA | 5996 |
| 54790_2_9380 | + | chr4: 105232646-105232666 | CUGAAACAGCUUACUAUGUU | 5997 |
| 54790_2_9386 | + | chr4: 105232673-105232693 | UUAUAAGCUGUUGUUAUUGU | 5998 |
| 54790_2_9397 | + | chr4: 105232698-105232718 | UAUAAACUGUAAGAGAGAGU | 5999 |
| 54790_2_9400 | + | chr4: 105232701-105232721 | AAACUGUAAGAGAGAGUAGG | 6000 |
| 54790_2_9404 | + | chr4: 105232725-105232745 | CAGAAAAACAGCCUGUAUG | 6001 |
| 54790_2_9407 | + | chr4: 105232726-105232746 | AGAAAAACAGCCUGUAUGC | 6002 |
| 54790_2_9408 | + | chr4: 105232727-105232747 | GAAAAACAGCCUGUAUGCG | 6003 |
| 54790_2_9411 | + | chr4: 105232728-105232748 | AAAAACAGCCUGUAUGCGG | 6004 |
| 54790_2_9413 | + | chr4: 105232729-105232749 | AAAACAGCCUGUAUGCGGG | 6005 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_9421 | + | chr4: 105232766-105232786 | ACAGAAAUUCUCAAAAGAUU | 6006 |
| 54790_2_9422 | + | chr4: 105232767-105232787 | CAGAAAUUCUCAAAAGAUUU | 6007 |
| 54790_2_9434 | + | chr4: 105232810-105232830 | AAACAUAGAAUCACCUAGAA | 6008 |
| 54790_2_9435 | + | chr4: 105232811-105232831 | AACAUAGAAUCACCUAGAAA | 6009 |
| 54790_2_9445 | + | chr4: 105232856-105232876 | AUCACCCCUAUUCUGUCACC | 6010 |
| 54790_2_9450 | + | chr4: 105232876-105232896 | UGGAAUAUUGAUAACACUGA | 6011 |
| 54790_2_9452 | + | chr4: 105232877-105232897 | GGAAUAUUGAUAACACUGAA | 6012 |
| 54790_2_9454 | + | chr4: 105232897-105232917 | GGGAGUGUGCCUUAUCUCUC | 6013 |
| 54790_2_9456 | + | chr4: 105232906-105232926 | CCUUAUCUCUCAGGUGUAUU | 6014 |
| 54790_2_9463 | + | chr4: 105232932-105232952 | AAAUAGUUUGAGAACCAUGC | 6015 |
| 54790_2_9479 | + | chr4: 105233007-105233027 | AAUCUUCCUUUUGAUAACAA | 6016 |
| 54790_2_9480 | + | chr4: 105233008-105233028 | AUCUUCCUUUUGAUAACAAA | 6017 |
| 54790_2_9486 | + | chr4: 105233019-105233039 | GAUAACAAAGGGAACCUUAA | 6018 |
| 54790_2_9487 | + | chr4: 105233020-105233040 | AUAACAAAGGGAACCUUAAA | 6019 |
| 54790_2_9491 | + | chr4: 105233024-105233044 | CAAAGGGAACCUUAAAGGGC | 6020 |
| 54790_2_9494 | + | chr4: 105233027-105233047 | AGGGAACCUUAAAGGGCUGG | 6021 |
| 54790_2_9496 | + | chr4: 105233028-105233048 | GGGAACCUUAAAGGGCUGGA | 6022 |
| 54790_2_9497 | + | chr4: 105233029-105233049 | GGAACCUUAAAGGGCUGGAG | 6023 |
| 54790_2_9500 | + | chr4: 105233033-105233053 | CCUUAAAGGGCUGGAGGGGA | 6024 |
| 54790_2_9501 | + | chr4: 105233034-105233054 | CUUAAAGGGCUGGAGGGGAA | 6025 |
| 54790_2_9504 | + | chr4: 105233041-105233061 | GGCUGGAGGGGAAGGGCAGA | 6026 |
| 54790_2_9506 | + | chr4: 105233042-105233062 | GCUGGAGGGGAAGGGCAGAC | 6027 |
| 54790_2_9507 | + | chr4: 105233043-105233063 | CUGGAGGGGAAGGGCAGACG | 6028 |
| 54790_2_9509 | + | chr4: 105233048-105233068 | GGGGAAGGGCAGACGGGGCU | 6029 |
| 54790_2_9511 | + | chr4: 105233049-105233069 | GGGAAGGGCAGACGGGGCUA | 6030 |
| 54790_2_9513 | + | chr4: 105233050-105233070 | GGAAGGGCAGACGGGGCUAG | 6031 |
| 54790_2_9516 | + | chr4: 105233053-105233073 | AGGGCAGACGGGGCUAGGGG | 6032 |
| 54790_2_9519 | + | chr4: 105233080-105233100 | CCCUUUUAAAAGCUACUGC | 6033 |
| 54790_2_9522 | + | chr4: 105233083-105233103 | UUUUAAAAGCUACUGCAGG | 6034 |
| 54790_2_9523 | + | chr4: 105233084-105233104 | UUUAAAAGCUACUGCAGGU | 6035 |
| 54790_2_9524 | + | chr4: 105233085-105233105 | UUAAAAGCUACUGCAGGUG | 6036 |
| 54790_2_9528 | + | chr4: 105233090-105233110 | AAGCUACUGCAGGUGGGGUG | 6037 |
| 54790_2_9529 | + | chr4: 105233093-105233113 | CUACUGCAGGUGGGGUGCGG | 6038 |
| 54790_2_9531 | + | chr4: 105233120-105233140 | CACCUGUAAUCCCAGCACUU | 6039 |
| 54790_2_9534 | + | chr4: 105233121-105233141 | ACCUGUAAUCCCAGCACUUU | 6040 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_9535 | + | chr4: 105233124-105233144 | UGUAAUCCCAGCACUUUGGG | 6041 |
| 54790_2_9536 | + | chr4: 105233130-105233150 | CCCAGCACUUUGGGAGGCCA | 6042 |
| 54790_2_9537 | + | chr4: 105233134-105233154 | GCACUUUGGGAGGCCAAGGC | 6043 |
| 54790_2_9541 | + | chr4: 105233148-105233168 | CAAGGCAGGCAGAUCACCUG | 6044 |
| 54790_2_9544 | + | chr4: 105233153-105233173 | CAGGCAGAUCACCUGAGGUC | 6045 |
| 54790_2_9545 | + | chr4: 105233171-105233191 | UCAGGAGUUCAAGACCAGCC | 6046 |
| 54790_2_9547 | + | chr4: 105233220-105233240 | UAAAAAUACAAAAAUUAGCU | 6047 |
| 54790_2_9548 | + | chr4: 105233225-105233245 | AUACAAAAAUUAGCUAGGCA | 6048 |
| 54790_2_9549 | + | chr4: 105233232-105233252 | AAUUAGCUAGGCAUGGUAGC | 6049 |
| 54790_2_9552 | + | chr4: 105233255-105233275 | CACCUGUAAUCUCAGCUACU | 6050 |
| 54790_2_9555 | + | chr4: 105233256-105233276 | ACCUGUAAUCUCAGCUACUU | 6051 |
| 54790_2_9556 | + | chr4: 105233259-105233279 | UGUAAUCUCAGCUACUUGGG | 6052 |
| 54790_2_9558 | + | chr4: 105233265-105233285 | CUCAGCUACUUGGGAGGCUG | 6053 |
| 54790_2_9561 | + | chr4: 105233269-105233289 | GCUACUUGGGAGGCUGAGGC | 6054 |
| 54790_2_9568 | + | chr4: 105233287-105233307 | GCAGGAGAAUUGCUUGAACC | 6055 |
| 54790_2_9570 | + | chr4: 105233288-105233308 | CAGGAGAAUUGCUUGAACCU | 6056 |
| 54790_2_9571 | + | chr4: 105233291-105233311 | GAGAAUUGCUUGAACCUGGG | 6057 |
| 54790_2_9573 | + | chr4: 105233297-105233317 | UGCUUGAACCUGGGAGGCAG | 6058 |
| 54790_2_9579 | + | chr4: 105233337-105233357 | UGUGCCGCUGCACUCCAGCC | 6059 |
| 54790_2_9580 | + | chr4: 105233338-105233358 | GUGCCGCUGCACUCCAGCCU | 6060 |
| 54790_2_9587 | + | chr4: 105233397-105233417 | AAAAGCUACUGCAGUAGAUC | 6061 |
| 54790_2_9590 | + | chr4: 105233400-105233420 | AGCUACUGCAGUAGAUCAGG | 6062 |
| 54790_2_9591 | + | chr4: 105233403-105233423 | UACUGCAGUAGAUCAGGAGG | 6063 |
| 54790_2_9596 | + | chr4: 105233439-105233459 | AGAAGAUCUGAGCUAUGAAG | 6064 |
| 54790_2_9599 | + | chr4: 105233458-105233478 | GUGGCAGUCAAGAUGAUUAA | 6065 |
| 54790_2_9602 | + | chr4: 105233468-105233488 | AGAUGAUUAAAGGAAUAUAU | 6066 |
| 54790_2_9606 | + | chr4: 105233502-105233522 | AUAGAACUUAGCAAGUGAUU | 6067 |
| 54790_2_9615 | + | chr4: 105233529-105233549 | UGAAGUGCUAGAGAAAAUAA | 6068 |
| 54790_2_9616 | + | chr4: 105233530-105233550 | GAAGUGCUAGAGAAAAUAAA | 6069 |
| 54790_2_9618 | + | chr4: 105233531-105233551 | AAGUGCUAGAGAAAAUAAAG | 6070 |
| 54790_2_9620 | + | chr4: 105233560-105233580 | UUCAAUUGUUUUUAGCAUUU | 6071 |
| 54790_2_9630 | + | chr4: 105233576-105233596 | AUUUUGGCAAAAAUUAUUU | 6072 |
| 54790_2_9642 | + | chr4: 105233626-105233646 | UAUGAACUUCCCACAUUAGC | 6073 |
| 54790_2_9666 | + | chr4: 105233761-105233781 | AAUAUCAGUUUGCUAUGUCU | 6074 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_9688 | − | chr4: 105190557-105190577 | AGAGAGAUUACCAUUACAUU | 6075 |
| 54790_2_9696 | − | chr4: 105190580-105190600 | GUAACUUGAAGUUGAAGUUU | 6076 |
| 54790_2_9699 | − | chr4: 105190581-105190601 | GGUAACUUGAAGUUGAAGUU | 6077 |
| 54790_2_9705 | − | chr4: 105190602-105190622 | AAAGUAUUUGAGAGGGUGCA | 6078 |
| 54790_2_9706 | − | chr4: 105190603-105190623 | AAAAGUAUUUGAGAGGGUGC | 6079 |
| 54790_2_9708 | − | chr4: 105190609-105190629 | AUAAAGAAAAGUAUUUGAGA | 6080 |
| 54790_2_9709 | − | chr4: 105190610-105190630 | AAUAAAGAAAAGUAUUUGAG | 6081 |
| 54790_2_9741 | − | chr4: 105190827-105190847 | GCGAUAAAUACUCUAACAAC | 6082 |
| 54790_2_9742 | − | chr4: 105190849-105190869 | CUACAAGUGAAGCAAAAUGG | 6083 |
| 54790_2_9744 | − | chr4: 105190852-105190872 | UGGCUACAAGUGAAGCAAAA | 6084 |
| 54790_2_9749 | − | chr4: 105190872-105190892 | UUAACAAGAUUGAGACGAAG | 6085 |
| 54790_2_9756 | − | chr4: 105190898-105190918 | AACCACAAAUACCAUUUAUU | 6086 |
| 54790_2_9760 | − | chr4: 105190945-105190965 | ACUGACUAGCCAGGUGCAGG | 6087 |
| 54790_2_9761 | − | chr4: 105190948-105190968 | AAGACUGACUAGCCAGGUGC | 6088 |
| 54790_2_9765 | − | chr4: 105190954-105190974 | UGUCACAAGACUGACUAGCC | 6089 |
| 54790_2_9770 | − | chr4: 105190985-105191005 | UUAGUUCUCUGCUAGUUCUA | 6090 |
| 54790_2_9776 | − | chr4: 105191095-105191115 | GUCCUCAAAGUCUCGUCGGA | 6091 |
| 54790_2_9777 | − | chr4: 105191096-105191116 | GGUCCUCAAAGUCUCGUCGG | 6092 |
| 54790_2_9781 | − | chr4: 105191114-105191134 | GUCCUACUACCGAACUUGGG | 6093 |
| 54790_2_9786 | − | chr4: 105191126-105191146 | UUCUCCGAUUCCGUCCUACU | 6094 |
| 54790_2_9787 | − | chr4: 105191133-105191153 | CGAGGAAUUCUCCGAUUCCG | 6095 |
| 54790_2_9789 | − | chr4: 105191137-105191157 | GGGUCGAGGAAUUCUCCGAU | 6096 |
| 54790_2_9790 | − | chr4: 105191143-105191163 | ACAUUAGGGUCGAGGAAUUC | 6097 |
| 54790_2_9792 | − | chr4: 105191174-105191194 | AUCAUAUGAAGACCCGGACC | 6098 |
| 54790_2_9793 | − | chr4: 105191175-105191195 | AAUCAUAUGAAGACCCGGAC | 6099 |
| 54790_2_9795 | − | chr4: 105191176-105191196 | AAAUCAUAUGAAGACCCGGA | 6100 |
| 54790_2_9797 | − | chr4: 105191177-105191197 | AAAAUCAUAUGAAGACCCGG | 6101 |
| 54790_2_9802 | − | chr4: 105191182-105191202 | UUCAGAAAAUCAUAUGAAGA | 6102 |
| 54790_2_9804 | − | chr4: 105191183-105191203 | UUUCAGAAAAUCAUAUGAAG | 6103 |
| 54790_2_9829 | − | chr4: 105191290-105191310 | UUGGGACACUCAGCAGGUCA | 6104 |
| 54790_2_9830 | − | chr4: 105191296-105191316 | CUUAGGUUGGGACACUCAGC | 6105 |
| 54790_2_9831 | − | chr4: 105191308-105191328 | GGUCUGACAACCCUUAGGUU | 6106 |
| 54790_2_9832 | − | chr4: 105191309-105191329 | UGGUCUGACAACCCUUAGGU | 6107 |
| 54790_2_9835 | − | chr4: 105191313-105191333 | AAAUGGUCUGACAACCCUU | 6108 |
| 54790_2_9837 | − | chr4: 105191329-105191349 | UACAUGCAUAUAUGAGAAAA | 6109 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_9857 | − | chr4: 105191431-105191451 | UUAACUGUCUUAUAUAGUUC | 6110 |
| 54790_2_9868 | − | chr4: 105191531-105191551 | AAGCUGAAUUACCUACUAAA | 6111 |
| 54790_2_9884 | − | chr4: 105191606-105191626 | GGCAGAGAUUAGAGCUAUAC | 6112 |
| 54790_2_9888 | − | chr4: 105191627-105191647 | AUCCUCAGGUGUCUGCAGUA | 6113 |
| 54790_2_9889 | − | chr4: 105191641-105191661 | GAGUGGAUACUUAUAUCCUC | 6114 |
| 54790_2_9890 | − | chr4: 105191658-105191678 | AGAAGUAUCAAGUGGCAGAG | 6115 |
| 54790_2_9893 | − | chr4: 105191666-105191686 | AGUCUCUGAGAAGUAUCAAG | 6116 |
| 54790_2_9902 | − | chr4: 105191707-105191727 | CAACUGAGGACACACUGGAA | 6117 |
| 54790_2_9904 | − | chr4: 105191712-105191732 | GAGUUCAACUGAGGACACAC | 6118 |
| 54790_2_9907 | − | chr4: 105191721-105191741 | GAAUCAUGGGAGUUCAACUG | 6119 |
| 54790_2_9910 | − | chr4: 105191734-105191754 | UGGCAACAUCCAGGAAUCAU | 6120 |
| 54790_2_9913 | − | chr4: 105191735-105191755 | AUGGCAACAUCCAGGAAUCA | 6121 |
| 54790_2_9916 | − | chr4: 105191743-105191763 | UCUUGAAAAUGGCAACAUCC | 6122 |
| 54790_2_9920 | − | chr4: 105191754-105191774 | CUUGCCCUGUGUCUUGAAAA | 6123 |
| 54790_2_9924 | − | chr4: 105191794-105191814 | UUAAAAUUCCCAAGGUAGAG | 6124 |
| 54790_2_9927 | − | chr4: 105191802-105191822 | AGAGUGACUUAAAAUUCCCA | 6125 |
| 54790_2_9941 | − | chr4: 105191875-105191895 | UAAAAAUAUUAACAUGCAAG | 6126 |
| 54790_2_9944 | − | chr4: 105191876-105191896 | CUAAAAAUAUUAACAUGCAA | 6127 |
| 54790_2_9947 | − | chr4: 105191877-105191897 | UCUAAAAAUAUUAACAUGCA | 6128 |
| 54790_2_9956 | − | chr4: 105191927-105191947 | UCCAGCAUGAGAGGGGAAAG | 6129 |
| 54790_2_9960 | − | chr4: 105191934-105191954 | AAGAUUUCCAGCAUGAGAG | 6130 |
| 54790_2_9962 | − | chr4: 105191935-105191955 | UAAGAUUUCCAGCAUGAGA | 6131 |
| 54790_2_9965 | − | chr4: 105191936-105191956 | CUAAGAUUUCCAGCAUGAG | 6132 |
| 54790_2_9973 | − | chr4: 105191989-105192009 | AGCAAUCAUCAAGGGAGGAG | 6133 |
| 54790_2_9976 | − | chr4: 105191990-105192010 | AAGCAAUCAUCAAGGGAGGA | 6134 |
| 54790_2_9978 | − | chr4: 105191991-105192011 | AAAGCAAUCAUCAAGGGAGG | 6135 |
| 54790_2_9980 | − | chr4: 105191994-105192014 | GGUAAAGCAAUCAUCAAGGG | 6136 |
| 54790_2_9983 | − | chr4: 105191997-105192017 | UGAGGUAAAGCAAUCAUCAA | 6137 |
| 54790_2_9985 | − | chr4: 105191998-105192018 | GUGAGGUAAAGCAAUCAUCA | 6138 |
| 54790_2_9989 | − | chr4: 105192015-105192035 | GUCACAGUUCUCACAGAGUG | 6139 |
| 54790_2_10002 | − | chr4: 105192099-105192119 | AUGUUAUGACUUCAUUAAGG | 6140 |
| 54790_2_10005 | − | chr4: 105192102-105192122 | CUAAUGUUAUGACUUCAUUA | 6141 |
| 54790_2_10019 | − | chr4: 105192155-105192175 | CUGCACUUUAUUCCUUACCC | 6142 |
| 54790_2_10044 | − | chr4: 105192241-105192261 | UGUAAAACCUUUUCCCUCAA | 6143 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_10054 | - | chr4: 105192286-105192306 | AGAUUUUUGAGGAGAUAUGA | 6144 |
| 54790_2_10055 | - | chr4: 105192287-105192307 | AAGAUUUUUGAGGAGAUAUG | 6145 |
| 54790_2_10060 | - | chr4: 105192297-105192317 | AAUGCAAAACAAGAUUUUUG | 6146 |
| 54790_2_10070 | - | chr4: 105192347-105192367 | UGCUAUUGAAAAUAUGUCAA | 6147 |
| 54790_2_10071 | - | chr4: 105192348-105192368 | UUGCUAUUGAAAAUAUGUCA | 6148 |
| 54790_2_10074 | - | chr4: 105192376-105192396 | UACUACUAAAAAUAAACUCU | 6149 |
| 54790_2_10086 | - | chr4: 105192433-105192453 | UAAAUUUCGUCCCGAAUGUC | 6150 |
| 54790_2_10092 | - | chr4: 105192443-105192463 | GAAGAAACGGUAAAUUUCGU | 6151 |
| 54790_2_10093 | - | chr4: 105192444-105192464 | AGAAGAAACGGUAAAUUUCG | 6152 |
| 54790_2_10101 | - | chr4: 105192510-105192530 | GAUAUACAACCCGUUACAUG | 6153 |
| 54790_2_10103 | - | chr4: 105192521-105192541 | AACUCUUGAAUGAUAUACAA | 6154 |
| 54790_2_10104 | - | chr4: 105192522-105192542 | UAACUCUUGAAUGAUAUACA | 6155 |
| 54790_2_10111 | - | chr4: 105192573-105192593 | AAAAGCAACAUUAAUAAAAG | 6156 |
| 54790_2_10124 | - | chr4: 105192638-105192658 | UUCUCACGGACCAUAAACCG | 6157 |
| 54790_2_10126 | - | chr4: 105192642-105192662 | GAUCUUCUCACGGACCAUAA | 6158 |
| 54790_2_10127 | - | chr4: 105192649-105192669 | GAUCAAGGAUCUUCUCACGG | 6159 |
| 54790_2_10140 | - | chr4: 105192706-105192726 | UACCUAAGAUUCGAGUUGUU | 6160 |
| 54790_2_10142 | - | chr4: 105192707-105192727 | UUACCUAAGAUUCGAGUUGU | 6161 |
| 54790_2_10145 | - | chr4: 105192725-105192745 | CACAGACAGAGAAUGAGAUU | 6162 |
| 54790_2_10164 | - | chr4: 105192779-105192799 | AAAAUUUUGAAUCGUGAAGA | 6163 |
| 54790_2_10195 | - | chr4: 105192929-105192949 | UUAAGGAAGUCUAUUGAAGU | 6164 |
| 54790_2_10203 | - | chr4: 105192970-105192990 | UUUUAGAUGAGGUCCAGAAA | 6165 |
| 54790_2_10204 | - | chr4: 105192978-105192998 | AUAAAACCUUUUAGAUGAGG | 6166 |
| 54790_2_10220 | - | chr4: 105193108-105193128 | CUCCUCUGUUAUAGUCCAGA | 6167 |
| 54790_2_10229 | - | chr4: 105193160-105193180 | CUUCCUGUCCUUCAGGAUCC | 6168 |
| 54790_2_10230 | - | chr4: 105193167-105193187 | CCCAAUUCUUCCUGUCCUUC | 6169 |
| 54790_2_10239 | - | chr4: 105193211-105193231 | CCCCUCCACUUCUCUCCACU | 6170 |
| 54790_2_10240 | - | chr4: 105193212-105193232 | UCCCCUCCACUUCUCUCCAC | 6171 |
| 54790_2_10250 | - | chr4: 105193269-105193289 | CUGGCCCAUUCCUGCCCUAA | 6172 |
| 54790_2_10253 | - | chr4: 105193288-105193308 | CUUCCCACUUGCCCUCUGCC | 6173 |
| 54790_2_10262 | - | chr4: 105193325-105193345 | GCCAACAUGAACUUUAUACA | 6174 |
| 54790_2_10276 | - | chr4: 105193380-105193400 | CUUUAGGAUUUUACUAAAUU | 6175 |
| 54790_2_10279 | - | chr4: 105193396-105193416 | AUAAUCUUUAGCUUGACUUU | 6176 |
| 54790_2_10286 | - | chr4: 105193429-105193449 | AAUUAUUCCCCAAUAUUUUC | 6177 |
| 54790_2_10358 | - | chr4: 105193876-105193896 | UGUACUAUGUUAGUAUUACA | 6178 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_10364 | - | chr4: 105193914-105193934 | UAUUAUAAAAAUACAAAAUU | 6179 |
| 54790_2_10374 | - | chr4: 105193977-105193997 | AACCUGAUCGACUACAGAUU | 6180 |
| 54790_2_10379 | - | chr4: 105193996-105194016 | GAAGGUGUUUUACUUGAUUA | 6181 |
| 54790_2_10383 | - | chr4: 105194030-105194050 | AUUUCAGUACAUUGUAGAGA | 6182 |
| 54790_2_10384 | - | chr4: 105194031-105194051 | UAUUUCAGUACAUUGUAGAG | 6183 |
| 54790_2_10387 | - | chr4: 105194056-105194076 | AAUCUAUGAUCGAUCUCCGU | 6184 |
| 54790_2_10388 | - | chr4: 105194061-105194081 | GGUUCAAUCUAUGAUCGAUC | 6185 |
| 54790_2_10390 | - | chr4: 105194089-105194109 | GAGUCUCAGUAUCCUCUGGA | 6186 |
| 54790_2_10391 | - | chr4: 105194090-105194110 | AGAGUCUCAGUAUCCUCUGG | 6187 |
| 54790_2_10396 | - | chr4: 105194098-105194118 | GCAGGAGGAGAGUCUCAGUA | 6188 |
| 54790_2_10411 | - | chr4: 105194113-105194133 | AUUAUUUUUUAUUAGCAGG | 6189 |
| 54790_2_10414 | - | chr4: 105194116-105194136 | UUUAUUAUUUUUUAUUAGC | 6190 |
| 54790_2_10418 | - | chr4: 105194204-105194224 | GGCUACAAGAGAGUGCUAAC | 6191 |
| 54790_2_10423 | - | chr4: 105194225-105194245 | GUGUAUGUUAAUUAGAAAAA | 6192 |
| 54790_2_10428 | - | chr4: 105194254-105194274 | UAGAUCUGUUUCAUGAGAAA | 6193 |
| 54790_2_10429 | - | chr4: 105194255-105194275 | UUAGAUCUGUUUCAUGAGAA | 6194 |
| 54790_2_10441 | - | chr4: 105194323-105194343 | CUUCAACAAUGACUAAAGGU | 6195 |
| 54790_2_10444 | - | chr4: 105194324-105194344 | ACUUCAACAAUGACUAAAGG | 6196 |
| 54790_2_10446 | - | chr4: 105194327-105194347 | GAAACUUCAACAAUGACUAA | 6197 |
| 54790_2_10449 | - | chr4: 105194349-105194369 | AAAAGAUAACAUUGUAAAUC | 6198 |
| 54790_2_10470 | - | chr4: 105194464-105194484 | CUGUAGGGUGAUGGUUUUUU | 6199 |
| 54790_2_10472 | - | chr4: 105194465-105194485 | CCUGUAGGGUGAUGGUUUUU | 6200 |
| 54790_2_10475 | - | chr4: 105194473-105194493 | AUUUAUUUCCUGUAGGGUGA | 6201 |
| 54790_2_10476 | - | chr4: 105194479-105194499 | AGUGUGAUUUAUUUCCUGUA | 6202 |
| 54790_2_10477 | - | chr4: 105194480-105194500 | GAGUGUGAUUUAUUUCCUGU | 6203 |
| 54790_2_10482 | - | chr4: 105194516-105194536 | GAGAAAUCAGUAGCCAGAUC | 6204 |
| 54790_2_10491 | - | chr4: 105194551-105194571 | AAGUCUUAAAGUCUAAGUAU | 6205 |
| 54790_2_10498 | - | chr4: 105194585-105194605 | GUUCAUAAGAAUGACCUGUA | 6206 |
| 54790_2_10502 | - | chr4: 105194614-105194634 | GCUUGCUAGAACAAUGACUA | 6207 |
| 54790_2_10506 | - | chr4: 105194636-105194656 | ACUCAAAGAAUAAACUGCUC | 6208 |
| 54790_2_10517 | - | chr4: 105194685-105194705 | GCACUGUAUUAUGAUCUCUA | 6209 |
| 54790_2_10533 | - | chr4: 105194777-105194797 | UACAUGUCUGCUCACUUGCU | 6210 |
| 54790_2_10541 | - | chr4: 105194843-105194863 | AUACCAUGUGGCAUGUGUAA | 6211 |
| 54790_2_10545 | - | chr4: 105194855-105194875 | AUGACUUGUAUCAUACCAUG | 6212 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_10553 | - | chr4: 105194901-105194921 | CAAGACACCAUGUAUAAGAG | 6213 |
| 54790_2_10556 | - | chr4: 105194938-105194958 | GAGACUACUGAUACCACUCU | 6214 |
| 54790_2_10557 | - | chr4: 105194939-105194959 | AGAGACUACUGAUACCACUC | 6215 |
| 54790_2_10565 | - | chr4: 105194966-105194986 | GAUGUUUAAUUCAGUCUCUU | 6216 |
| 54790_2_10566 | - | chr4: 105194967-105194987 | AGAUGUUUAAUUCAGUCUCU | 6217 |
| 54790_2_10570 | - | chr4: 105194997-105195017 | CAGUCUAUUUACGGUGUUCU | 6218 |
| 54790_2_10578 | - | chr4: 105195022-105195042 | ACACUUAAAUCCCUAACGGU | 6219 |
| 54790_2_10579 | - | chr4: 105195032-105195052 | AUGUCGAUAAACACUUAAAU | 6220 |
| 54790_2_10581 | - | chr4: 105195033-105195053 | UAUGUCGAUAAACACUUAAA | 6221 |
| 54790_2_10585 | - | chr4: 105195081-105195101 | AUCAAAGGACACAUCAUAUG | 6222 |
| 54790_2_10591 | - | chr4: 105195096-105195116 | UUUACUUGUUCUAAAAUCAA | 6223 |
| 54790_2_10598 | - | chr4: 105195139-105195159 | AUCACUUUUACUGAAAGUAU | 6224 |
| 54790_2_10607 | - | chr4: 105195179-105195199 | ACUAUAAAGUGGAAAACUAC | 6225 |
| 54790_2_10612 | - | chr4: 105195206-105195226 | UUUCUAGGACUCUAGUUGUC | 6226 |
| 54790_2_10642 | - | chr4: 105195339-105195359 | CACAUUUGAGAAAAAUGUC | 6227 |
| 54790_2_10661 | - | chr4: 105195460-105195480 | GUUAGAGGGUGUCUAUGACU | 6228 |
| 54790_2_10668 | - | chr4: 105195486-105195506 | AACUAUAGGUACCCCCCAGG | 6229 |
| 54790_2_10670 | - | chr4: 105195492-105195512 | GUCUAAAACUAUAGGUACCC | 6230 |
| 54790_2_10671 | - | chr4: 105195493-105195513 | UGUCUAAAACUAUAGGUACC | 6231 |
| 54790_2_10672 | - | chr4: 105195494-105195514 | GUGUCUAAAACUAUAGGUAC | 6232 |
| 54790_2_10675 | - | chr4: 105195495-105195515 | GGUGUCUAAAACUAUAGGUA | 6233 |
| 54790_2_10677 | - | chr4: 105195496-105195516 | AGGUGUCUAAAACUAUAGGU | 6234 |
| 54790_2_10683 | - | chr4: 105195520-105195540 | AUAAAAUAUAUUCUCUGAAC | 6235 |
| 54790_2_10688 | - | chr4: 105195572-105195592 | UACUAAGCUUCAUAUACCCU | 6236 |
| 54790_2_10689 | - | chr4: 105195573-105195593 | CUACUAAGCUUCAUAUACCC | 6237 |
| 54790_2_10691 | - | chr4: 105195576-105195596 | UCUCUACUAAGCUUCAUAUA | 6238 |
| 54790_2_10694 | - | chr4: 105195577-105195597 | CUCUCUACUAAGCUUCAUAU | 6239 |
| 54790_2_10702 | - | chr4: 105195623-105195643 | AUUAUUGAUGAAUGUAUCGU | 6240 |
| 54790_2_10714 | - | chr4: 105195713-105195733 | GUUUUAUGAGUCUUUUUUUU | 6241 |
| 54790_2_10720 | - | chr4: 105195754-105195774 | AAGUACCUAAGGUCGUAGAC | 6242 |
| 54790_2_10722 | - | chr4: 105195770-105195790 | GUCGGGGGUACCCAUAAGU | 6243 |
| 54790_2_10725 | - | chr4: 105195779-105195799 | CAUUAUUCAGUCGGGGGUA | 6244 |
| 54790_2_10726 | - | chr4: 105195780-105195800 | ACAUUAUUCAGUCGGGGGU | 6245 |
| 54790_2_10735 | - | chr4: 105195836-105195856 | UCAAGGACUAUACGUGUCCU | 6246 |
| 54790_2_10736 | - | chr4: 105195853-105195873 | AAGACUCCUACCAAGAUUCA | 6247 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_10743 | - | chr4: 105195901-105195921 | GAGUCAAGAUCUUGAGAAGA | 6248 |
| 54790_2_10747 | - | chr4: 105195923-105195943 | GCACGUGUACAAGUGGGGGU | 6249 |
| 54790_2_10750 | - | chr4: 105195927-105195947 | AUGUGCACGUGUACAAGUGG | 6250 |
| 54790_2_10751 | - | chr4: 105195928-105195948 | UAUGUGCACGUGUACAAGUG | 6251 |
| 54790_2_10753 | - | chr4: 105195929-105195949 | GUAUGUGCACGUGUACAAGU | 6252 |
| 54790_2_10755 | - | chr4: 105195930-105195950 | AGUAUGUGCACGUGUACAAG | 6253 |
| 54790_2_10760 | - | chr4: 105195974-105195994 | CCACUCGUCCUGAAUUCCUU | 6254 |
| 54790_2_10761 | - | chr4: 105195975-105195995 | ACCACUCGUCCUGAAUUCCU | 6255 |
| 54790_2_10763 | - | chr4: 105195979-105195999 | UUCGACCACUCGUCCUGAAU | 6256 |
| 54790_2_10766 | - | chr4: 105195987-105196007 | AUCCUUCGUUCGACCACUCG | 6257 |
| 54790_2_10769 | - | chr4: 105195995-105196015 | GUUACGUUAUCCUUCGUUCG | 6258 |
| 54790_2_10772 | - | chr4: 105196006-105196026 | AACUUACGAGAGUUACGUUA | 6259 |
| 54790_2_10777 | - | chr4: 105196029-105196049 | CCAUCUUCAAGAACCAGAUG | 6260 |
| 54790_2_10778 | - | chr4: 105196037-105196057 | UUUUUAUACCAUCUUCAAGA | 6261 |
| 54790_2_10784 | - | chr4: 105196050-105196070 | GCCCAUCUCCACCUUUUUAU | 6262 |
| 54790_2_10786 | - | chr4: 105196060-105196080 | ACUGUGUUUGCCCAUCUCC | 6263 |
| 54790_2_10788 | - | chr4: 105196063-105196083 | UAAACUGUGUUUGCCCAUC | 6264 |
| 54790_2_10790 | - | chr4: 105196069-105196089 | UAUGUCUAAACUGUGUUUUG | 6265 |
| 54790_2_10791 | - | chr4: 105196070-105196090 | AUAUGUCUAAACUGUGUUUU | 6266 |
| 54790_2_10792 | - | chr4: 105196071-105196091 | GAUAUGUCUAAACUGUGUUU | 6267 |
| 54790_2_10795 | - | chr4: 105196093-105196113 | ACUCUGAAGAAUGAAAAGAA | 6268 |
| 54790_2_10805 | - | chr4: 105196123-105196143 | UAGGAAAUAAUUUAUGGAAG | 6269 |
| 54790_2_10807 | - | chr4: 105196129-105196149 | AACAAUUAGGAAAUAAUUUA | 6270 |
| 54790_2_10809 | - | chr4: 105196142-105196162 | CAGAGGCAGAGGGAACAAUU | 6271 |
| 54790_2_10812 | - | chr4: 105196152-105196172 | AAAAAAGAACAGAGGCAGA | 6272 |
| 54790_2_10814 | - | chr4: 105196153-105196173 | AAAAAAAGAACAGAGGCAG | 6273 |
| 54790_2_10818 | - | chr4: 105196159-105196179 | AGAAAAAAAAAAAGAACAG | 6274 |
| 54790_2_10829 | - | chr4: 105196200-105196220 | ACUUAAGAAUGGGCAUACAG | 6275 |
| 54790_2_10831 | - | chr4: 105196210-105196230 | UCAGAUUUGCACUUAAGAAU | 6276 |
| 54790_2_10832 | - | chr4: 105196211-105196231 | GUCAGAUUUGCACUUAAGAA | 6277 |
| 54790_2_10836 | - | chr4: 105196233-105196253 | AUAUUAAGAAGGGGUAUAGA | 6278 |
| 54790_2_10837 | - | chr4: 105196242-105196262 | AAAGAAGGAUAUUAAGAAG | 6279 |
| 54790_2_10838 | - | chr4: 105196243-105196263 | AAAAGAAAGGAUAUUAAGAA | 6280 |
| 54790_2_10839 | - | chr4: 105196244-105196264 | UAAAAGAAAGGAUAUUAAGA | 6281 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_10844 | - | chr4: 105196256-105196276 | AAUGGGUAUCCAUAAAAGAA | 6282 |
| 54790_2_10849 | - | chr4: 105196273-105196293 | CCUUUAAUAAAGUCUGAAAU | 6283 |
| 54790_2_10850 | - | chr4: 105196274-105196294 | UCCUUUAAUAAAGUCUGAAA | 6284 |
| 54790_2_10855 | - | chr4: 105196307-105196327 | CAAGUGGUGAGGUGGGGAGG | 6285 |
| 54790_2_10858 | - | chr4: 105196308-105196328 | UCAAGUGGUGAGGUGGGGAG | 6286 |
| 54790_2_10859 | - | chr4: 105196309-105196329 | UUCAAGUGGUGAGGUGGGGA | 6287 |
| 54790_2_10862 | - | chr4: 105196310-105196330 | CUUCAAGUGGUGAGGUGGGG | 6288 |
| 54790_2_10864 | - | chr4: 105196313-105196333 | AAACUUCAAGUGGUGAGGUG | 6289 |
| 54790_2_10868 | - | chr4: 105196314-105196334 | AAAACUUCAAGUGGUGAGGU | 6290 |
| 54790_2_10870 | - | chr4: 105196315-105196335 | AAAAACUUCAAGUGGUGAGG | 6291 |
| 54790_2_10872 | - | chr4: 105196318-105196338 | UGCAAAAACUUCAAGUGGUG | 6292 |
| 54790_2_10875 | - | chr4: 105196323-105196343 | CUAAUUGCAAAAACUUCAAG | 6293 |
| 54790_2_10883 | - | chr4: 105196402-105196422 | ACUCUGAAAGGGGAUAAGU | 6294 |
| 54790_2_10885 | - | chr4: 105196411-105196431 | UUCAGGGCCACUCUGAAAAG | 6295 |
| 54790_2_10886 | - | chr4: 105196412-105196432 | AUUCAGGGCCACUCUGAAAA | 6296 |
| 54790_2_10888 | - | chr4: 105196413-105196433 | UAUUCAGGGCCACUCUGAAA | 6297 |
| 54790_2_10894 | - | chr4: 105196427-105196447 | UGGGUUCACAGAGCUAUUCA | 6298 |
| 54790_2_10895 | - | chr4: 105196428-105196448 | CUGGGUUCACAGAGCUAUUC | 6299 |
| 54790_2_10900 | - | chr4: 105196446-105196466 | ACUGAGUUCUUCAGAUUCCU | 6300 |
| 54790_2_10903 | - | chr4: 105196447-105196467 | UACUGAGUUCUUCAGAUUCC | 6301 |
| 54790_2_10911 | - | chr4: 105196477-105196497 | AUCUACUUUCUGUAGGCUGA | 6302 |
| 54790_2_10912 | - | chr4: 105196484-105196504 | GAGUUUGAUCUACUUUCUGU | 6303 |
| 54790_2_10915 | - | chr4: 105196520-105196540 | GAGUAACCAGGAGCCAGAUC | 6304 |
| 54790_2_10920 | - | chr4: 105196532-105196552 | GAGGAAUUUGAAGAGUAACC | 6305 |
| 54790_2_10925 | - | chr4: 105196551-105196571 | GAAGGGACAAUAUAGUAAGG | 6306 |
| 54790_2_10928 | - | chr4: 105196554-105196574 | UCUGAAGGGACAAUAUAGUA | 6307 |
| 54790_2_10932 | - | chr4: 105196568-105196588 | UAAAGAUUUACAAAUCUGAA | 6308 |
| 54790_2_10933 | - | chr4: 105196569-105196589 | GUAAAGAUUUACAAAUCUGA | 6309 |
| 54790_2_10938 | - | chr4: 105196591-105196611 | GUGUGUAAAAUACGAUGUCA | 6310 |
| 54790_2_10939 | - | chr4: 105196618-105196638 | GGAGAGGAACAGCGGUACAA | 6311 |
| 54790_2_10941 | - | chr4: 105196626-105196646 | GUUCAUCAGGAGAGGAACAG | 6312 |
| 54790_2_10943 | - | chr4: 105196634-105196654 | AAAGGGAAGUUCAUCAGGAG | 6313 |
| 54790_2_10948 | - | chr4: 105196639-105196659 | AGAGAAAGGGAAGUUCAUC | 6314 |
| 54790_2_10950 | - | chr4: 105196651-105196671 | GCUGUGUAGUUAAGAGAAAA | 6315 |
| 54790_2_10952 | - | chr4: 105196652-105196672 | AGCUGUGUAGUUAAGAGAAA | 6316 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_10965 | - | chr4: 105196722-105196742 | AUGUCAUUCAUCCUACAAAC | 6317 |
| 54790_2_10969 | - | chr4: 105196732-105196752 | UUGUUUACUGAUGUCAUUCA | 6318 |
| 54790_2_10973 | - | chr4: 105196766-105196786 | UCCUUAAAGUCUUAGACGUU | 6319 |
| 54790_2_10979 | - | chr4: 105196786-105196806 | GUUCUACGUCGGAAACGGGA | 6320 |
| 54790_2_10995 | - | chr4: 105196917-105196937 | AAGUUGCCAGUAGGGGGAGA | 6321 |
| 54790_2_10996 | - | chr4: 105196918-105196938 | GAAGUUGCCAGUAGGGGGAG | 6322 |
| 54790_2_11000 | - | chr4: 105196923-105196943 | AGGAAGAAGUUGCCAGUAGG | 6323 |
| 54790_2_11003 | - | chr4: 105196924-105196944 | UAGGAAGAAGUUGCCAGUAG | 6324 |
| 54790_2_11005 | - | chr4: 105196925-105196945 | GUAGGAAGAAGUUGCCAGUA | 6325 |
| 54790_2_11008 | - | chr4: 105196926-105196946 | AGUAGGAAGAAGUUGCCAGU | 6326 |
| 54790_2_11014 | - | chr4: 105196943-105196963 | CUGUAUCUAUUUUAAGAAGU | 6327 |
| 54790_2_11021 | - | chr4: 105196972-105196992 | ACCUCUUCCCUCCACUUAGU | 6328 |
| 54790_2_11022 | - | chr4: 105196973-105196993 | CACCUCUUCCCUCCACUUAG | 6329 |
| 54790_2_11038 | - | chr4: 105197075-105197095 | CUUAUAAUUAAGUAUCUCUG | 6330 |
| 54790_2_11043 | - | chr4: 105197121-105197141 | UACUUUAGUGAAAAAAAUGU | 6331 |
| 54790_2_11050 | - | chr4: 105197145-105197165 | GCAACACAUUUAAUUUUGAU | 6332 |
| 54790_2_11076 | - | chr4: 105197346-105197366 | UAUUCAUGUAUUUCUCACUA | 6333 |
| 54790_2_11083 | - | chr4: 105197424-105197444 | AGAACACAACCAAAAACUGC | 6334 |
| 54790_2_11093 | - | chr4: 105197512-105197532 | GGACAGCACUCUCAAACAUA | 6335 |
| 54790_2_11095 | - | chr4: 105197533-105197553 | CAGCCACAUCACAAAGCACC | 6336 |
| 54790_2_11115 | - | chr4: 105197639-105197659 | CACUUUUUACUCUUUGGUCA | 6337 |
| 54790_2_11117 | - | chr4: 105197640-105197660 | UCACUUUUUACUCUUUGGUC | 6338 |
| 54790_2_11120 | - | chr4: 105197645-105197665 | AAGAAUCACUUUUUACUCUU | 6339 |
| 54790_2_11126 | - | chr4: 105197673-105197693 | UUUACUUUCCUCUAUAGCUA | 6340 |
| 54790_2_11134 | - | chr4: 105197703-105197723 | UUUAAUUCUACAUUUGAUGU | 6341 |
| 54790_2_11135 | - | chr4: 105197704-105197724 | AUUUAAUUCUACAUUUGAUG | 6342 |
| 54790_2_11157 | - | chr4: 105197796-105197816 | AAAACCUUUCAGAGACCAUC | 6343 |
| 54790_2_11161 | - | chr4: 105197820-105197840 | UUACUCUGAAAGUGAGUAAA | 6344 |
| 54790_2_11163 | - | chr4: 105197821-105197841 | CUUACUCUGAAAGUGAGUAA | 6345 |
| 54790_2_11174 | - | chr4: 105197887-105197907 | AACUUUGGAAAAACAGAAA | 6346 |
| 54790_2_11175 | - | chr4: 105197888-105197908 | AAACUUUGGAAAAACAGAA | 6347 |
| 54790_2_11181 | - | chr4: 105197901-105197921 | CUUUCAAAAAUAAAACUUU | 6348 |
| 54790_2_11189 | - | chr4: 105197931-105197951 | UAAUUUUCAAAUGUCUAAA | 6349 |
| 54790_2_11195 | - | chr4: 105197989-105198009 | CUUUUCUACGUUGCUACUCU | 6350 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_11204 | - | chr4: 105198024-105198044 | UUAUUAAAUACUUACUAUGU | 6351 |
| 54790_2_11206 | - | chr4: 105198059-105198079 | GUCCUCACUCGAUGGAGUGG | 6352 |
| 54790_2_11210 | - | chr4: 105198078-105198098 | AGGGUUUAACGACCCUAAUG | 6353 |
| 54790_2_11212 | - | chr4: 105198086-105198106 | GGAGCCGGAGGGUUUAACGA | 6354 |
| 54790_2_11213 | - | chr4: 105198087-105198107 | CGGAGCCGGAGGGUUUAACG | 6355 |
| 54790_2_11217 | - | chr4: 105198103-105198123 | GAGUCCACUAGGUGGCGGA | 6356 |
| 54790_2_11218 | - | chr4: 105198120-105198140 | CCAGAGUUUGAGAACUGGAG | 6357 |
| 54790_2_11221 | - | chr4: 105198141-105198161 | AAAGUGGUAUGACCAGUCCG | 6358 |
| 54790_2_11222 | - | chr4: 105198145-105198165 | CCCCAAAGUGGUAUGACCAG | 6359 |
| 54790_2_11224 | - | chr4: 105198150-105198170 | CUCUACCCCAAAGUGGUAUG | 6360 |
| 54790_2_11231 | - | chr4: 105198164-105198184 | AACGUAAAAAUCAUCUCUAC | 6361 |
| 54790_2_11232 | - | chr4: 105198165-105198185 | AAACGUAAAAAUCAUCUCUA | 6362 |
| 54790_2_11233 | - | chr4: 105198166-105198186 | AAAACGUAAAAAUCAUCUCU | 6363 |
| 54790_2_11238 | - | chr4: 105198212-105198232 | AGGGCUCAUCGACCAUAAUA | 6364 |
| 54790_2_11239 | - | chr4: 105198221-105198241 | CGGAGUCGGAGGGCUCAUCG | 6365 |
| 54790_2_11244 | - | chr4: 105198285-105198305 | CCUCACGUUGCCGUGCUAGA | 6366 |
| 54790_2_11247 | - | chr4: 105198296-105198316 | AACGAGUCCGACCUCACGUU | 6367 |
| 54790_2_11250 | - | chr4: 105198306-105198326 | AAGUGAGAACAACGAGUCCG | 6368 |
| 54790_2_11253 | - | chr4: 105198310-105198330 | CUCAAAGUGAGAACAACGAG | 6369 |
| 54790_2_11283 | - | chr4: 105198404-105198424 | UUGAUAGUUUUCCUUUUCAU | 6370 |
| 54790_2_11300 | - | chr4: 105198486-105198506 | CAUAUUUAGUUUCUGACUU | 6371 |
| 54790_2_11311 | - | chr4: 105198539-105198559 | UUCCUUCUGUCUCCUUUAAC | 6372 |
| 54790_2_11323 | - | chr4: 105198584-105198604 | AUUUUCUUGCCCUUAUUUUC | 6373 |
| 54790_2_11343 | - | chr4: 105198674-105198694 | GUUCAUUUUUCAGCCUACA | 6374 |
| 54790_2_11346 | - | chr4: 105198700-105198720 | CAAGGACGUACCAUACCUUU | 6375 |
| 54790_2_11347 | - | chr4: 105198701-105198721 | CCAAGGACGUACCAUACCUU | 6376 |
| 54790_2_11351 | - | chr4: 105198706-105198726 | UUCUUCCAAGGACGUACCAU | 6377 |
| 54790_2_11353 | - | chr4: 105198711-105198731 | GUCAUUUCUUCCAAGGACGU | 6378 |
| 54790_2_11355 | - | chr4: 105198722-105198742 | AGAAUCCUUACGUCAUUUCU | 6379 |
| 54790_2_11359 | - | chr4: 105198738-105198758 | CCACGAUCUGAUCAGGAGAA | 6380 |
| 54790_2_11363 | - | chr4: 105198759-105198779 | UAAUGGUGUUCAUAGGUUAA | 6381 |
| 54790_2_11378 | - | chr4: 105198893-105198913 | AUUAUAAUUAAGUAUCUCUG | 6382 |
| 54790_2_11389 | - | chr4: 105198965-105198985 | GCAACACAUUUAAUUUUGGU | 6383 |
| 54790_2_11391 | - | chr4: 105198969-105198989 | AACUGCAACACAUUUAAUUU | 6384 |
| 54790_2_11401 | - | chr4: 105199050-105199070 | UUUAUGUUCAUCAAUACUAU | 6385 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_11423 | - | chr4: 105199181-105199201 | CACCAAACUUUAAUAUUUAA | 6386 |
| 54790_2_11425 | - | chr4: 105199182-105199202 | ACACCAAACUUUAAUAUUUA | 6387 |
| 54790_2_11430 | - | chr4: 105199229-105199249 | AAUUAGAAGAGAGCCCUAUA | 6388 |
| 54790_2_11437 | - | chr4: 105199253-105199273 | AAUUAUCUACACGUCAUAGG | 6389 |
| 54790_2_11446 | - | chr4: 105199343-105199363 | UUUUUUCUGUUUUUGGAAAC | 6390 |
| 54790_2_11455 | - | chr4: 105199400-105199420 | UUUAGUGUCAGUGUUUCACU | 6391 |
| 54790_2_11466 | - | chr4: 105199466-105199486 | UCCCUGAACUUCUUUGUUCU | 6392 |
| 54790_2_11475 | - | chr4: 105199485-105199505 | GGUAUUUAAAGGAAUUUCCU | 6393 |
| 54790_2_11477 | - | chr4: 105199486-105199506 | AGGUAUUUAAAGGAAUUUCC | 6394 |
| 54790_2_11480 | - | chr4: 105199489-105199509 | UAAAGGUAUUUAAAGGAAUU | 6395 |
| 54790_2_11483 | - | chr4: 105199518-105199538 | UUUUAAGCCACUUGAUGGUA | 6396 |
| 54790_2_11487 | - | chr4: 105199523-105199543 | UUUUCUUUUAAGCCACUUGA | 6397 |
| 54790_2_11490 | - | chr4: 105199556-105199576 | GUGCACAUGAGGACUUGAAU | 6398 |
| 54790_2_11495 | - | chr4: 105199599-105199619 | GUUGUUUGAGGGUACUGGGU | 6399 |
| 54790_2_11498 | - | chr4: 105199639-105199659 | CCCAUGAUCCGAAUUAUGGA | 6400 |
| 54790_2_11499 | - | chr4: 105199640-105199660 | ACCCAUGAUCCGAAUUAUGG | 6401 |
| 54790_2_11501 | - | chr4: 105199652-105199672 | UUUUUAUUGAUUACCCAUGA | 6402 |
| 54790_2_11502 | - | chr4: 105199659-105199679 | CUAGUCCUUUUUAUUGAUUA | 6403 |
| 54790_2_11503 | - | chr4: 105199660-105199680 | CCUAGUCCUUUUUAUUGAUU | 6404 |
| 54790_2_11505 | - | chr4: 105199675-105199695 | CACCCUCCUCCCUCUCCUAG | 6405 |
| 54790_2_11508 | - | chr4: 105199681-105199701 | ACCUCCCACCCUCCUCCCUC | 6406 |
| 54790_2_11511 | - | chr4: 105199686-105199706 | CUCCCACCUCCCACCCUCCU | 6407 |
| 54790_2_11513 | - | chr4: 105199687-105199707 | UCUCCCACCUCCCACCCUCC | 6408 |
| 54790_2_11516 | - | chr4: 105199690-105199710 | UAGUCUCCCACCUCCCACCC | 6409 |
| 54790_2_11520 | - | chr4: 105199693-105199713 | GGAUAGUCUCCCACCUCCCA | 6410 |
| 54790_2_11521 | - | chr4: 105199694-105199714 | CGGAUAGUCUCCCACCUCCC | 6411 |
| 54790_2_11524 | - | chr4: 105199697-105199717 | CCCCGGAUAGUCUCCCACCU | 6412 |
| 54790_2_11525 | - | chr4: 105199698-105199718 | GCCCCGGAUAGUCUCCCACC | 6413 |
| 54790_2_11527 | - | chr4: 105199701-105199721 | GUGGCCCCGGAUAGUCUCCC | 6414 |
| 54790_2_11530 | - | chr4: 105199704-105199724 | UGUGUGGCCCCGGAUAGUCU | 6415 |
| 54790_2_11531 | - | chr4: 105199705-105199725 | GUGUGUGGCCCCGGAUAGUC | 6416 |
| 54790_2_11534 | - | chr4: 105199716-105199736 | CUCCCCUUGUUGUGUGUGGC | 6417 |
| 54790_2_11535 | - | chr4: 105199717-105199737 | UCUCCCCUUGUUGUGUGUGG | 6418 |
| 54790_2_11536 | - | chr4: 105199718-105199738 | GUCUCCCCUUGUUGUGUGUG | 6419 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_11540 | - | chr4: 105199733-105199753 | CUCCUGUAUACCUGUGUCUC | 6420 |
| 54790_2_11541 | - | chr4: 105199734-105199754 | ACUCCUGUAUACCUGUGUCU | 6421 |
| 54790_2_11543 | - | chr4: 105199735-105199755 | UACUCCUGUAUACCUGUGUC | 6422 |
| 54790_2_11547 | - | chr4: 105199744-105199764 | UCGAUUUACUACUCCUGUAU | 6423 |
| 54790_2_11550 | - | chr4: 105199752-105199772 | AUUCACCCUCGAUUUACUAC | 6424 |
| 54790_2_11555 | - | chr4: 105199767-105199787 | CGUACAAGAGUGAAUAUUCA | 6425 |
| 54790_2_11556 | - | chr4: 105199768-105199788 | ACGUACAAGAGUGAAUAUUC | 6426 |
| 54790_2_11561 | - | chr4: 105199808-105199828 | AUAGGUAUCGUUUGAUUGUA | 6427 |
| 54790_2_11567 | - | chr4: 105199835-105199855 | UACCUGUACCUACCUCGACC | 6428 |
| 54790_2_11570 | - | chr4: 105199838-105199858 | ACGUACCUGUACCUACCUCG | 6429 |
| 54790_2_11573 | - | chr4: 105199844-105199864 | CAAAAACGUACCUGUACCU | 6430 |
| 54790_2_11576 | - | chr4: 105199848-105199868 | AGUACAAAAACGUACCUGU | 6431 |
| 54790_2_11578 | - | chr4: 105199854-105199874 | UAUUCAGUACAAAAACGU | 6432 |
| 54790_2_11583 | - | chr4: 105199901-105199921 | UGACACAAUAUAUAUGUGGU | 6433 |
| 54790_2_11586 | - | chr4: 105199934-105199954 | UUACGGGUGGUUAUUAUCUG | 6434 |
| 54790_2_11590 | - | chr4: 105199967-105199987 | AUAAGUGUUAUCGUUUCUGU | 6435 |
| 54790_2_11599 | - | chr4: 105200045-105200065 | GUGAUGACCCAUAUAUGGUU | 6436 |
| 54790_2_11602 | - | chr4: 105200058-105200078 | UUGGGUCGUUGGGGUGAUGA | 6437 |
| 54790_2_11603 | - | chr4: 105200059-105200079 | GUUGGGUCGUUGGGGUGAUG | 6438 |
| 54790_2_11610 | - | chr4: 105200129-105200149 | CAUUUAAUCAAGUUGGUAAC | 6439 |
| 54790_2_11616 | - | chr4: 105200155-105200175 | UUGUGAAUAUACGAUAACCA | 6440 |
| 54790_2_11618 | - | chr4: 105200156-105200176 | CUUGUGAAUAUACGAUAACC | 6441 |
| 54790_2_11620 | - | chr4: 105200159-105200179 | UUCCUUGUGAAUAUACGAUA | 6442 |
| 54790_2_11624 | - | chr4: 105200178-105200198 | AUCACUCCAACGCCUCUUUU | 6443 |
| 54790_2_11627 | - | chr4: 105200187-105200207 | UAUUGUGCAAUCACUCCAAC | 6444 |
| 54790_2_11630 | - | chr4: 105200193-105200213 | GUUUUUAUUGUGCAAUCAC | 6445 |
| 54790_2_11634 | - | chr4: 105200231-105200251 | GGUAGAGUGUGGUCAGUCCU | 6446 |
| 54790_2_11635 | - | chr4: 105200235-105200255 | CUAUGGUAGAGUGUGGUCAG | 6447 |
| 54790_2_11644 | - | chr4: 105200327-105200347 | AUGUUUCUUCUGUAUGUAC | 6448 |
| 54790_2_11649 | - | chr4: 105200366-105200386 | GGGUAACUUUUUCACCCGUU | 6449 |
| 54790_2_11651 | - | chr4: 105200372-105200392 | UUGUAGGGGUAACUUUUUCA | 6450 |
| 54790_2_11652 | - | chr4: 105200373-105200393 | UUUGUAGGGGUAACUUUUUC | 6451 |
| 54790_2_11658 | - | chr4: 105200414-105200434 | AUAUUCCUAGAAUUUAAAUG | 6452 |
| 54790_2_11661 | - | chr4: 105200430-105200450 | UUAUCAUAGGUCUAGAUAU | 6453 |
| 54790_2_11669 | - | chr4: 105200482-105200502 | UUUGUCUGUUGGAUGUCUUA | 6454 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_11672 | − | chr4: 105200483-105200503 | UUUUGUCUGUUGGAUGUCUU | 6455 |
| 54790_2_11682 | − | chr4: 105200557-105200577 | CAUUCGUUUUUAAGUGUUUA | 6456 |
| 54790_2_11684 | − | chr4: 105200558-105200578 | UCAUUCGUUUUUAAGUGUUU | 6457 |
| 54790_2_11689 | − | chr4: 105200617-105200637 | AAAAAAAAACAGUGUGACCU | 6458 |
| 54790_2_11692 | − | chr4: 105200618-105200638 | CAAAAAAAACAGUGUGACC | 6459 |
| 54790_2_11696 | − | chr4: 105200704-105200724 | ACAUAGUGGUGUGAGGUCUG | 6460 |
| 54790_2_11701 | − | chr4: 105200744-105200764 | ACGAACUUGGGCCUUACACC | 6461 |
| 54790_2_11702 | − | chr4: 105200747-105200767 | UUAACGAACUUGGGCCUUAC | 6462 |
| 54790_2_11706 | − | chr4: 105200754-105200774 | CGUCUUCUUAACGAACUUGG | 6463 |
| 54790_2_11712 | − | chr4: 105200776-105200796 | GGGUCGAUGAGUCCUCCGAC | 6464 |
| 54790_2_11714 | − | chr4: 105200782-105200802 | ACAUCAGGGUCGAUGAGUCC | 6465 |
| 54790_2_11716 | − | chr4: 105200785-105200805 | CGGACAUCAGGGUCGAUGAG | 6466 |
| 54790_2_11719 | − | chr4: 105200813-105200833 | GUUUUUAAUCGACCCGUACC | 6467 |
| 54790_2_11720 | − | chr4: 105200816-105200836 | UAUGUUUUUAAUCGACCCGU | 6468 |
| 54790_2_11723 | − | chr4: 105200821-105200841 | AUUUUUAUGUUUUUAAUCGA | 6469 |
| 54790_2_11724 | − | chr4: 105200822-105200842 | GAUUUUUAUGUUUUUAAUCG | 6470 |
| 54790_2_11727 | − | chr4: 105200861-105200881 | UCUCUGGUAGGACCGGUUGU | 6471 |
| 54790_2_11728 | − | chr4: 105200870-105200890 | AGUUCUCUAUCUCUGGUAGG | 6472 |
| 54790_2_11734 | − | chr4: 105200905-105200925 | CGUGAAACCCUCCGACUCCG | 6473 |
| 54790_2_11735 | − | chr4: 105200906-105200926 | UCGUGAAACCCUCCGACUCC | 6474 |
| 54790_2_11737 | − | chr4: 105200909-105200929 | GGGUCGUGAAACCCUCCGAC | 6475 |
| 54790_2_11739 | − | chr4: 105200915-105200935 | ACAUUAGGGUCGUGAAACCC | 6476 |
| 54790_2_11740 | − | chr4: 105200918-105200938 | CGGACAUUAGGGUCGUGAAA | 6477 |
| 54790_2_11743 | − | chr4: 105200919-105200939 | UCGGACAUUAGGGUCGUGAA | 6478 |
| 54790_2_11745 | − | chr4: 105200946-105200966 | UGACCUGGCCGGUCCACACC | 6479 |
| 54790_2_11746 | − | chr4: 105200949-105200969 | GUAUGACCUGGCCGGUCCAC | 6480 |
| 54790_2_11749 | − | chr4: 105200954-105200974 | UAAAGUAUGACCUGGCCGG | 6481 |
| 54790_2_11752 | − | chr4: 105200959-105200979 | UUGAUUAAAGUAUGACCUG | 6482 |
| 54790_2_11753 | − | chr4: 105200960-105200980 | UUUGAUUAAAAGUAUGACCU | 6483 |
| 54790_2_11754 | − | chr4: 105200961-105200981 | UUUUGAUUAAAAGUAUGACC | 6484 |
| 54790_2_11773 | − | chr4: 105201087-105201107 | AACAACAUGGAUUUCAACCG | 6485 |
| 54790_2_11775 | − | chr4: 105201100-105201120 | GGUUGAAGGAUUCAACAACA | 6486 |
| 54790_2_11778 | − | chr4: 105201114-105201134 | CUCAGUCCUCAAGGGGUUGA | 6487 |
| 54790_2_11782 | − | chr4: 105201121-105201141 | GGGAAUUCUCAGUCCUCAAG | 6488 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_11783 | - | chr4: 105201122-105201142 | AGGGAAUUCUCAGUCCUCAA | 6489 |
| 54790_2_11785 | - | chr4: 105201123-105201143 | AAGGGAAUUCUCAGUCCUCA | 6490 |
| 54790_2_11790 | - | chr4: 105201141-105201161 | GAUUCAGACAGAUAAUUAAA | 6491 |
| 54790_2_11793 | - | chr4: 105201142-105201162 | UGAUUCAGACAGAUAAUUAA | 6492 |
| 54790_2_11812 | - | chr4: 105201239-105201259 | AAGAGAUAAUUUGUUUAAU | 6493 |
| 54790_2_11829 | - | chr4: 105201284-105201304 | CCUAAAUUACACAUUUGUGG | 6494 |
| 54790_2_11830 | - | chr4: 105201285-105201305 | UCCUAAAUUACACAUUUGUG | 6495 |
| 54790_2_11833 | - | chr4: 105201286-105201306 | UUCCUAAAUUACACAUUUGU | 6496 |
| 54790_2_11834 | - | chr4: 105201287-105201307 | AUUCCUAAAUUACACAUUUG | 6497 |
| 54790_2_11851 | - | chr4: 105201369-105201389 | AUACUUUCCUAAACUUUUU | 6498 |
| 54790_2_11859 | - | chr4: 105201461-105201481 | CAGUAAUUGAGCACUGAAAU | 6499 |
| 54790_2_11861 | - | chr4: 105201462-105201482 | ACAGUAAUUGAGCACUGAAA | 6500 |
| 54790_2_11882 | - | chr4: 105201535-105201555 | AUAAGCAAUACUUCCACUUG | 6501 |
| 54790_2_11888 | - | chr4: 105201587-105201607 | GUCCUUAAAACCCCUCAGUA | 6502 |
| 54790_2_11900 | - | chr4: 105201658-105201678 | AUUGAAUUCUAGCCUCAACU | 6503 |
| 54790_2_11907 | - | chr4: 105201686-105201706 | UGAUACCAUUUAACUGUAU | 6504 |
| 54790_2_11910 | - | chr4: 105201727-105201747 | UUUUUUUUUUUUUUGGUCC | 6505 |
| 54790_2_11912 | - | chr4: 105201733-105201753 | UUUUUUUUUUUUUUUUUUU | 6506 |
| 54790_2_11916 | - | chr4: 105201777-105201797 | ACGUGGCGUCAGACCCGUUG | 6507 |
| 54790_2_11918 | - | chr4: 105201784-105201804 | UCCGGUGACGUGGCGUCAGA | 6508 |
| 54790_2_11919 | - | chr4: 105201785-105201805 | GUCCGGUGACGUGGCGUCAG | 6509 |
| 54790_2_11922 | - | chr4: 105201804-105201824 | CCGACGUCACUCGGAGUUAG | 6510 |
| 54790_2_11924 | - | chr4: 105201825-105201845 | GUGGACUCGGACCCUUCAAC | 6511 |
| 54790_2_11927 | - | chr4: 105201834-105201854 | ACCCUCCUAGUGGACUCGGA | 6512 |
| 54790_2_11929 | - | chr4: 105201835-105201855 | CACCCUCCUAGUGGACUCGG | 6513 |
| 54790_2_11932 | - | chr4: 105201850-105201870 | UGAGACCUUCGACUCCACCC | 6514 |
| 54790_2_11934 | - | chr4: 105201853-105201873 | CGAUGAGACCUUCGACUCCA | 6515 |
| 54790_2_11937 | - | chr4: 105201854-105201874 | UCGAUGAGACCUUCGACUCC | 6516 |
| 54790_2_11939 | - | chr4: 105201857-105201877 | GAGUCGAUGAGACCUUCGAC | 6517 |
| 54790_2_11941 | - | chr4: 105201866-105201886 | GGGACACCAGAGUCGAUGAG | 6518 |
| 54790_2_11944 | - | chr4: 105201881-105201901 | CCCCACCACCGUACGGGGAC | 6519 |
| 54790_2_11946 | - | chr4: 105201894-105201914 | UUUUUUAAUCGGUCCCCACC | 6520 |
| 54790_2_11947 | - | chr4: 105201897-105201917 | AUGUUUUUAAUCGGUCCCC | 6521 |
| 54790_2_11948 | - | chr4: 105201900-105201920 | UUUAUGUUUUUAAUCGGUC | 6522 |
| 54790_2_11949 | - | chr4: 105201901-105201921 | UUUUAUGUUUUUAAUCGGU | 6523 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_2_11950 | - | chr4: 105201902-105201922 | UUUUUAUGUUUUUAAUCGG | 6524 |
| 54790_2_11955 | - | chr4: 105201943-105201963 | ACGCUUGUCGGACCCGUUGU | 6525 |
| 54790_2_11956 | - | chr4: 105201951-105201971 | GUCCUCAAACGCUUGUCGGA | 6526 |
| 54790_2_11957 | - | chr4: 105201952-105201972 | GGUCCUCAAACGCUUGUCGG | 6527 |
| 54790_2_11963 | - | chr4: 105201970-105201990 | GUCCACCUAACGAACUCCGG | 6528 |
| 54790_2_11965 | - | chr4: 105201975-105201995 | GCUCCGUCCACCUAACGAAC | 6529 |
| 54790_2_11969 | - | chr4: 105201986-105202006 | GAAACCCUUCGGCUCCGUCC | 6530 |
| 54790_2_11972 | - | chr4: 105201989-105202009 | CGUGAAACCCUUCGGCUCCG | 6531 |
| 54790_2_11973 | - | chr4: 105201993-105202013 | AGGUCGUGAAACCCUUCGGC | 6532 |
| 54790_2_11977 | - | chr4: 105202002-105202022 | AGGGUAUUAAGGUCGUGAAA | 6533 |
| 54790_2_11978 | - | chr4: 105202003-105202023 | AAGGGUAUUAAGGUCGUGAA | 6534 |
| 54790_2_11982 | - | chr4: 105202033-105202053 | GAUUCCGGAGGCCGACCCAC | 6535 |
| 54790_2_11983 | - | chr4: 105202038-105202058 | CUAAAGAUUCCGGAGGCCGA | 6536 |
| 54790_2_11984 | - | chr4: 105202039-105202059 | UCUAAAGAUUCCGGAGGCCG | 6537 |
| 54790_2_11987 | - | chr4: 105202043-105202063 | GUAAUCUAAAGAUUCCGGAG | 6538 |
| 54790_2_11988 | - | chr4: 105202044-105202064 | GGUAAUCUAAAGAUUCCGGA | 6539 |
| 54790_2_11989 | - | chr4: 105202045-105202065 | UGGUAAUCUAAAGAUUCCGG | 6540 |
| 54790_2_11992 | - | chr4: 105202048-105202068 | AGUUGGUAAUCUAAAGAUUC | 6541 |
| 54790_2_11995 | - | chr4: 105202065-105202085 | AAAACCUGGAAGACAGAAGU | 6542 |
| 54790_2_12001 | - | chr4: 105202079-105202099 | UUUCCAAGGACAUAAAAACC | 6543 |
| 54790_2_12003 | - | chr4: 105202093-105202113 | AAAAUAUGCAUAAAUUUCCA | 6544 |
| 54790_2_12007 | - | chr4: 105202127-105202147 | AUUAGGAAGAAGAUGAGGAU | 6545 |
| 54790_2_12008 | - | chr4: 105202128-105202148 | GAUUAGGAAGAAGAUGAGGA | 6546 |
| 54790_2_12010 | - | chr4: 105202132-105202152 | CAAGGAUUAGGAAGAAGAUG | 6547 |
| 54790_2_12016 | - | chr4: 105202144-105202164 | UUCACAAUAUGUCAAGGAUU | 6548 |
| 54790_2_12019 | - | chr4: 105202150-105202170 | UCUGUGUUCACAAUAUGUCA | 6549 |
| 54790_2_12027 | - | chr4: 105202194-105202214 | UUAAGUAUAUUUGUAACUCA | 6550 |
| 54790_2_12029 | - | chr4: 105202195-105202215 | UUUAAGUAUAUUUGUAACUC | 6551 |
| 54790_2_12058 | - | chr4: 105202342-105202362 | GAGUCCGAAAAGUUUCCACU | 6552 |
| 54790_2_12059 | - | chr4: 105202343-105202363 | CGAGUCCGAAAAGUUUCCAC | 6553 |
| 54790_2_12062 | - | chr4: 105202348-105202368 | GUCUCCGAGUCCGAAAAGUU | 6554 |
| 54790_2_12063 | - | chr4: 105202359-105202379 | UAGAGUGUAGAGUCUCCGAG | 6555 |
| 54790_2_12065 | - | chr4: 105202365-105202385 | CGUCAGUAGAGUGUAGAGUC | 6556 |
| 54790_2_12075 | - | chr4: 105202436-105202456 | CCUUCGCUGGAUCCUAAAUC | 6557 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_12078 | − | chr4: 105202445-105202465 | GUUCAUCACCCUUCGCUGGA | 6558 |
| 54790_2_12086 | − | chr4: 105202457-105202477 | UUAGGGUAGUAUGUUCAUCA | 6559 |
| 54790_2_12087 | − | chr4: 105202458-105202478 | UUUAGGGUAGUAUGUUCAUC | 6560 |
| 54790_2_12093 | − | chr4: 105202474-105202494 | UGCGAAUUACAGAUUUUUUA | 6561 |
| 54790_2_12094 | − | chr4: 105202475-105202495 | UUGCGAAUUACAGAUUUUUU | 6562 |
| 54790_2_12121 | − | chr4: 105202623-105202643 | CCAAAAAUGACUGCCUUUA | 6563 |
| 54790_2_12132 | − | chr4: 105202696-105202716 | UGCAAAAUGAGGGCUCACUG | 6564 |
| 54790_2_12133 | − | chr4: 105202706-105202726 | AGGCAUAUGUUGCAAAAUGA | 6565 |
| 54790_2_12134 | − | chr4: 105202707-105202727 | UAGGCAUAUGUUGCAAAAUG | 6566 |
| 54790_2_12137 | − | chr4: 105202726-105202746 | GCAAGCCAGAUAUGAAAAGU | 6567 |
| 54790_2_12144 | − | chr4: 105202748-105202768 | AUUAAAUUAUAAAUAAUAAA | 6568 |
| 54790_2_12149 | − | chr4: 105202783-105202803 | UUACAAAACUAUGGAAAGAG | 6569 |
| 54790_2_12152 | − | chr4: 105202792-105202812 | GCAAUUCUAUUACAAAACUA | 6570 |
| 54790_2_12180 | − | chr4: 105202923-105202943 | CUCAUACUCUGCCCUGUUCC | 6571 |
| 54790_2_12191 | − | chr4: 105202973-105202993 | ACAUUUAAAAAUAUUUGGUC | 6572 |
| 54790_2_12194 | − | chr4: 105202978-105202998 | UUAAGACAUUUAAAAAUAUU | 6573 |
| 54790_2_12201 | − | chr4: 105203058-105203078 | GUACACGGUUCGUGUCACAA | 6574 |
| 54790_2_12220 | − | chr4: 105203175-105203195 | CUUACGUAAAAAUGUCUUAA | 6575 |
| 54790_2_12230 | − | chr4: 105203222-105203242 | CUUAGUAAAGCAUAAUCAUA | 6576 |
| 54790_2_12232 | − | chr4: 105203253-105203273 | CCACAUGGUCAAUGUAGGAA | 6577 |
| 54790_2_12234 | − | chr4: 105203258-105203278 | UGAGUCCACAUGGUCAAUGU | 6578 |
| 54790_2_12237 | − | chr4: 105203268-105203288 | AGGCCAAAUAUGAGUCCACA | 6579 |
| 54790_2_12245 | − | chr4: 105203288-105203308 | UUAUUCUAAUGUAAUUAUAU | 6580 |
| 54790_2_12253 | − | chr4: 105203319-105203339 | CUACUUCCUUUUCCAACUUU | 6581 |
| 54790_2_12278 | − | chr4: 105203496-105203516 | UUCUGUGUAAUGUAAUGUAU | 6582 |
| 54790_2_12280 | − | chr4: 105203526-105203546 | AAUGUAUUGUAUACAAAGCC | 6583 |
| 54790_2_12283 | − | chr4: 105203561-105203581 | UUCUGUGUAAUGUAAUGUAU | 6584 |
| 54790_2_12285 | − | chr4: 105203591-105203611 | AAUGUAUUGUAUACAAAGCC | 6585 |
| 54790_2_12288 | − | chr4: 105203626-105203646 | UUCUGUGUAAUGUAAUGUAU | 6586 |
| 54790_2_12293 | − | chr4: 105203656-105203676 | UAGAUGUGUUUCCCAAAGCC | 6587 |
| 54790_2_12296 | − | chr4: 105203679-105203699 | UUGUGCUAUGUUAAGAGUUU | 6588 |
| 54790_2_12302 | − | chr4: 105203707-105203727 | UCUUGGUAUUACCUACCGUA | 6589 |
| 54790_2_12304 | − | chr4: 105203724-105203744 | AUAACGGCCCUGAUUUGUCU | 6590 |
| 54790_2_12308 | − | chr4: 105203740-105203760 | UUCCUCAAGGUUGUUAAUAA | 6591 |
| 54790_2_12311 | − | chr4: 105203753-105203773 | UUUCCCAAGACAUUUCCUCA | 6592 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_12322 | - | chr4: 105203818-105203838 | AGUUUGGGAUGACUUCACAG | 6593 |
| 54790_2_12326 | - | chr4: 105203833-105203853 | AAAUUUGCCUCGAAGAGUUU | 6594 |
| 54790_2_12327 | - | chr4: 105203834-105203854 | UAAAUUUGCCUCGAAGAGUU | 6595 |
| 54790_2_12334 | - | chr4: 105203861-105203881 | CAUUAAAAAACAGGGGUGGG | 6596 |
| 54790_2_12339 | - | chr4: 105203864-105203884 | AAACAUUAAAAAACAGGGGU | 6597 |
| 54790_2_12341 | - | chr4: 105203865-105203885 | GAAACAUUAAAAAACAGGGG | 6598 |
| 54790_2_12343 | - | chr4: 105203868-105203888 | UUAGAAACAUUAAAAAACAG | 6599 |
| 54790_2_12344 | - | chr4: 105203869-105203889 | UUUAGAAACAUUAAAAAACA | 6600 |
| 54790_2_12345 | - | chr4: 105203870-105203890 | CUUUAGAAACAUUAAAAAAC | 6601 |
| 54790_2_12355 | - | chr4: 105203923-105203943 | GUCCGUACUCGGUGACGUGA | 6602 |
| 54790_2_12358 | - | chr4: 105203942-105203962 | AGGGUUUCACGACGCUAAUG | 6603 |
| 54790_2_12359 | - | chr4: 105203967-105203987 | GAGUCCAUUAGAUGGGCGGA | 6604 |
| 54790_2_12360 | - | chr4: 105203984-105204004 | CCAGAGUUUGAGGACUGGAG | 6605 |
| 54790_2_12364 | - | chr4: 105204005-105204025 | AAAGCGGUAUAACCGAUCCG | 6606 |
| 54790_2_12365 | - | chr4: 105204009-105204029 | UCCCAAAGCGGUAUAACCGA | 6607 |
| 54790_2_12369 | - | chr4: 105204014-105204034 | AUCUCUCCCAAAGCGGUAUA | 6608 |
| 54790_2_12375 | - | chr4: 105204028-105204048 | AAAACAUAAAAUCAUCUCU | 6609 |
| 54790_2_12376 | - | chr4: 105204029-105204049 | AAAAACAUAAAAAUCAUCUC | 6610 |
| 54790_2_12382 | - | chr4: 105204056-105204076 | GUCCGUGAACGGUGAUGCGG | 6611 |
| 54790_2_12383 | - | chr4: 105204075-105204095 | AGGACUCAUCGACCCUAAUG | 6612 |
| 54790_2_12384 | - | chr4: 105204083-105204103 | GGAGUCGGAGGACUCAUCGA | 6613 |
| 54790_2_12385 | - | chr4: 105204084-105204104 | CGGAGUCGGAGGACUCAUCG | 6614 |
| 54790_2_12392 | - | chr4: 105204123-105204143 | AGUGACGUUGGAGCGGAGGG | 6615 |
| 54790_2_12393 | - | chr4: 105204124-105204144 | GAGUGACGUUGGAGCGGAGG | 6616 |
| 54790_2_12396 | - | chr4: 105204168-105204188 | AGAGUGAGGCAGCGGGUCCG | 6617 |
| 54790_2_12399 | - | chr4: 105204172-105204192 | CCUCAGAGUGAGGCAGCGGG | 6618 |
| 54790_2_12413 | - | chr4: 105204193-105204213 | AAACAAAACAAAAACUCU | 6619 |
| 54790_2_12428 | - | chr4: 105204216-105204236 | CAAUAUAAAAAAAAAAAAAA | 6620 |
| 54790_2_12445 | - | chr4: 105204334-105204354 | AUUCAAGAUUCUUGUCCUUG | 6621 |
| 54790_2_12449 | - | chr4: 105204357-105204377 | UAAGUACCUCAUAUGCACUA | 6622 |
| 54790_2_12459 | - | chr4: 105204413-105204433 | ACAUGAUGUCUAAUAUUUUU | 6623 |
| 54790_2_12465 | - | chr4: 105204445-105204465 | AUACUUUUCUAUCAACUGU | 6624 |
| 54790_2_12475 | - | chr4: 105204488-105204508 | UUUGAAACAGUUUUCUCCAU | 6625 |
| 54790_2_12480 | - | chr4: 105204512-105204532 | AUAUUUCGUUUCUUUUUCUU | 6626 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_12482 | - | chr4: 105204513-105204533 | AAUAUUUCGUUUCUUUUUCU | 6627 |
| 54790_2_12512 | - | chr4: 105204681-105204701 | UGACGAUUUCAGUAGAGUUC | 6628 |
| 54790_2_12518 | - | chr4: 105204712-105204732 | GAUCUCACGUACCACAAGGU | 6629 |
| 54790_2_12519 | - | chr4: 105204713-105204733 | GGAUCUCACGUACCACAAGG | 6630 |
| 54790_2_12523 | - | chr4: 105204722-105204742 | UAAUCUUUUGGAUCUCACGU | 6631 |
| 54790_2_12534 | - | chr4: 105204808-105204828 | GUGAUUGAAUCACAUGUGUC | 6632 |
| 54790_2_12539 | - | chr4: 105204851-105204871 | AGAUCACUUAUCGUUUUGAU | 6633 |
| 54790_2_12544 | - | chr4: 105204881-105204901 | UUUAGAUUCUCAUCCAAGGA | 6634 |
| 54790_2_12547 | - | chr4: 105204889-105204909 | CCGAAUUAUUUAGAUUCUCA | 6635 |
| 54790_2_12550 | - | chr4: 105204910-105204930 | UUAUGUUUUAUAUAUAUCA | 6636 |
| 54790_2_12561 | - | chr4: 105204965-105204985 | UUCGUUUAAAUUCGUUUCUU | 6637 |
| 54790_2_12568 | - | chr4: 105204994-105205014 | CAUAAGGUUUAGUGAUUAAA | 6638 |
| 54790_2_12578 | - | chr4: 105205088-105205108 | UUCGUGGAGAGUUUUACGUA | 6639 |
| 54790_2_12586 | - | chr4: 105205137-105205157 | CUUUCGUUUCGAAACUUUAU | 6640 |
| 54790_2_12607 | - | chr4: 105205214-105205234 | AAAUAAUAAAGCUAGUCAAG | 6641 |
| 54790_2_12620 | - | chr4: 105205298-105205318 | AAGUUAAGGAAAAUAUUGUU | 6642 |
| 54790_2_12622 | - | chr4: 105205312-105205332 | AGGCUAAAAUUAAGAAGUUA | 6643 |
| 54790_2_12628 | - | chr4: 105205332-105205352 | AAAUGAUUAACUUGGAAAAC | 6644 |
| 54790_2_12630 | - | chr4: 105205340-105205360 | CAACAGAUAAAUGAUUAACU | 6645 |
| 54790_2_12640 | - | chr4: 105205375-105205395 | CUGACAAAGAAAAUUUUCUU | 6646 |
| 54790_2_12660 | - | chr4: 105205510-105205530 | UAGUACCUAUUGGGUUGGGG | 6647 |
| 54790_2_12662 | - | chr4: 105205511-105205531 | AUAGUACCUAUUGGGUUGGG | 6648 |
| 54790_2_12663 | - | chr4: 105205512-105205532 | AAUAGUACCUAUUGGGUUGG | 6649 |
| 54790_2_12665 | - | chr4: 105205513-105205533 | GAAUAGUACCUAUUGGGUUG | 6650 |
| 54790_2_12667 | - | chr4: 105205514-105205534 | AGAAUAGUACCUAUUGGGUU | 6651 |
| 54790_2_12670 | - | chr4: 105205515-105205535 | CAGAAUAGUACCUAUUGGGU | 6652 |
| 54790_2_12672 | - | chr4: 105205519-105205539 | AAAUCAGAAUAGUACCUAUU | 6653 |
| 54790_2_12673 | - | chr4: 105205520-105205540 | CAAAUCAGAAUAGUACCUAU | 6654 |
| 54790_2_12680 | - | chr4: 105205547-105205567 | UCCUUCAAGAAUGUGUGAAU | 6655 |
| 54790_2_12689 | - | chr4: 105205587-105205607 | AAAUUAUAUUAUAAUUUUGU | 6656 |
| 54790_2_12690 | - | chr4: 105205588-105205608 | AAAAUUAUAUUAUAAUUUUG | 6657 |
| 54790_2_12702 | - | chr4: 105205674-105205694 | GACGGUAACGUGAGGUCGGA | 6658 |
| 54790_2_12707 | - | chr4: 105205715-105205735 | GAGAACUUUGGCCCUCCGCC | 6659 |
| 54790_2_12708 | - | chr4: 105205718-105205738 | UUAGAGAACUUUGGCCCUCC | 6660 |
| 54790_2_12711 | - | chr4: 105205721-105205741 | CUCUUAGAGAACUUUGGCCC | 6661 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_12713 | - | chr4: 105205724-105205744 | GUCCUCUUAGAGAACUUUGG | 6662 |
| 54790_2_12714 | - | chr4: 105205725-105205745 | CGUCCUCUUAGAGAACUUUG | 6663 |
| 54790_2_12720 | - | chr4: 105205743-105205763 | CGAUGAGCCCUCCGACUCCG | 6664 |
| 54790_2_12722 | - | chr4: 105205747-105205767 | GGGUCGAUGAGCCCUCCGAC | 6665 |
| 54790_2_12724 | - | chr4: 105205753-105205773 | AUAUUAGGGUCGAUGAGCCC | 6666 |
| 54790_2_12726 | - | chr4: 105205756-105205776 | CGGAUAUUAGGGUCGAUGAG | 6667 |
| 54790_2_12728 | - | chr4: 105205757-105205777 | ACGGAUAUUAGGGUCGAUGA | 6668 |
| 54790_2_12731 | - | chr4: 105205784-105205804 | UUUUUUAAUCGGUCCUCACC | 6669 |
| 54790_2_12732 | - | chr4: 105205787-105205807 | UCUUUUUUAAUCGGUCCUC | 6670 |
| 54790_2_12734 | - | chr4: 105205792-105205812 | UUUUAUCUUUUUUAAUCGG | 6671 |
| 54790_2_12740 | - | chr4: 105205834-105205854 | ACUCUGGCCGGACUGGUUGU | 6672 |
| 54790_2_12744 | - | chr4: 105205848-105205868 | ACUCCAACCCUCAAACUCUG | 6673 |
| 54790_2_12746 | - | chr4: 105205861-105205881 | GUCCACCUAGUGGACUCCAA | 6674 |
| 54790_2_12749 | - | chr4: 105205862-105205882 | CGUCCACCUAGUGGACUCCA | 6675 |
| 54790_2_12751 | - | chr4: 105205866-105205886 | ACUUCGUCCACCUAGUGGAC | 6676 |
| 54790_2_12755 | - | chr4: 105205877-105205897 | GAAAUCCUCCGACUUCGUCC | 6677 |
| 54790_2_12757 | - | chr4: 105205880-105205900 | CGUGAAAUCCUCCGACUUCG | 6678 |
| 54790_2_12759 | - | chr4: 105205890-105205910 | ACAUUAGGAUCGUGAAAUCC | 6679 |
| 54790_2_12760 | - | chr4: 105205893-105205913 | CGGACAUUAGGAUCGUGAAA | 6680 |
| 54790_2_12766 | - | chr4: 105205921-105205941 | AUGUUUCCCGACCCACACC | 6681 |
| 54790_2_12768 | - | chr4: 105205924-105205944 | AUAAUGUUUCCCGACCCAC | 6682 |
| 54790_2_12769 | - | chr4: 105205929-105205949 | UUAAGAUAAUGUUUUCCCGA | 6683 |
| 54790_2_12770 | - | chr4: 105205930-105205950 | AUUAAGAUAAUGUUUUCCCG | 6684 |
| 54790_2_12772 | - | chr4: 105205934-105205954 | CUCCAUUAAGAUAAUGUUUU | 6685 |
| 54790_2_12784 | - | chr4: 105206023-105206043 | AAGGGUGUGGGUUGUGGGU | 6686 |
| 54790_2_12785 | - | chr4: 105206024-105206044 | AAAGGGUGUGGGUUGUGGG | 6687 |
| 54790_2_12787 | - | chr4: 105206027-105206047 | UACAAAGGGUGUGGGUUGUG | 6688 |
| 54790_2_12788 | - | chr4: 105206028-105206048 | AUACAAAGGGUGUGGGUUGU | 6689 |
| 54790_2_12789 | - | chr4: 105206029-105206049 | AAUACAAAGGGUGUGGGUUG | 6690 |
| 54790_2_12792 | - | chr4: 105206035-105206055 | AAGAGAAAUACAAAGGGUGU | 6691 |
| 54790_2_12793 | - | chr4: 105206036-105206056 | AAAGAGAAAUACAAAGGGUG | 6692 |
| 54790_2_12795 | - | chr4: 105206041-105206061 | AAGUAAAAGAGAAAUACAAA | 6693 |
| 54790_2_12796 | - | chr4: 105206042-105206062 | CAAGUAAAAGAGAAAUACAA | 6694 |
| 54790_2_12801 | - | chr4: 105206071-105206091 | AAACUAUAAAUCUGAACUAG | 6695 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_12807 | - | chr4: 105206127-105206147 | GAGCUGUUCCCCAACCAGAU | 6696 |
| 54790_2_12808 | - | chr4: 105206128-105206148 | AGAGCUGUUCCCCAACCAGA | 6697 |
| 54790_2_12811 | - | chr4: 105206153-105206173 | GGAAAGGGAGAGGUCCCAGU | 6698 |
| 54790_2_12813 | - | chr4: 105206154-105206174 | AGGAAAGGGAGAGGUCCCAG | 6699 |
| 54790_2_12815 | - | chr4: 105206163-105206183 | UCACUCAUGAGGAAAGGGAG | 6700 |
| 54790_2_12818 | - | chr4: 105206168-105206188 | UGGCGUCACUCAUGAGGAAA | 6701 |
| 54790_2_12819 | - | chr4: 105206169-105206189 | CUGGCGUCACUCAUGAGGAA | 6702 |
| 54790_2_12822 | - | chr4: 105206174-105206194 | GGACCCUGGCGUCACUCAUG | 6703 |
| 54790_2_12827 | - | chr4: 105206188-105206208 | GCUUAUGGGCAGCAGGACCC | 6704 |
| 54790_2_12828 | - | chr4: 105206195-105206215 | ACAGAAUGCUUAUGGGCAGC | 6705 |
| 54790_2_12830 | - | chr4: 105206202-105206222 | UCAGCAAACAGAAUGCUUAU | 6706 |
| 54790_2_12831 | - | chr4: 105206203-105206223 | CUCAGCAAACAGAAUGCUUA | 6707 |
| 54790_2_12834 | - | chr4: 105206239-105206259 | AAGGCAGCGAAGCUGGGGAA | 6708 |
| 54790_2_12838 | - | chr4: 105206244-105206264 | AGCCAAAGGCAGCGAAGCUG | 6709 |
| 54790_2_12840 | - | chr4: 105206245-105206265 | CAGCCAAAGGCAGCGAAGCU | 6710 |
| 54790_2_12842 | - | chr4: 105206246-105206266 | GCAGCCAAAGGCAGCGAAGC | 6711 |
| 54790_2_12847 | - | chr4: 105206258-105206278 | CUUAAUCACAAAGCAGCCAA | 6712 |
| 54790_2_12850 | - | chr4: 105206290-105206310 | AAGGAGGCUUUAGGAAACAU | 6713 |
| 54790_2_12851 | - | chr4: 105206291-105206311 | GAAGGAGGCUUUAGGAAACA | 6714 |
| 54790_2_12853 | - | chr4: 105206299-105206319 | CUAAAGGCGAAGGAGGCUUU | 6715 |
| 54790_2_12856 | - | chr4: 105206306-105206326 | UCAAGGACUAAAGGCGAAGG | 6716 |
| 54790_2_12858 | - | chr4: 105206309-105206329 | GCAUCAAGGACUAAAGGCGA | 6717 |
| 54790_2_12861 | - | chr4: 105206315-105206335 | UCCCCAGCAUCAAGGACUAA | 6718 |
| 54790_2_12862 | - | chr4: 105206323-105206343 | CCAAAAGGUCCCCAGCAUCA | 6719 |
| 54790_2_12865 | - | chr4: 105206338-105206358 | AAGCUGUCUUCCCAACCAAA | 6720 |
| 54790_2_12867 | - | chr4: 105206361-105206381 | AGCAGGCUCACCCUGACAUA | 6721 |
| 54790_2_12870 | - | chr4: 105206378-105206398 | GAGUUACAUACCUGUGUAGC | 6722 |
| 54790_2_12872 | - | chr4: 105206410-105206430 | CUAAACAGAAACUCAACAGU | 6723 |
| 54790_2_12879 | - | chr4: 105206446-105206466 | UCCACGUUUGUACCAUUUGA | 6724 |
| 54790_2_12882 | - | chr4: 105206447-105206467 | CUCCACGUUUGUACCAUUUG | 6725 |
| 54790_2_12887 | - | chr4: 105206488-105206508 | AGACAAAACUAACAGGACAA | 6726 |
| 54790_2_12888 | - | chr4: 105206495-105206515 | CUGUGAUAGACAAAACUAAC | 6727 |
| 54790_2_12893 | - | chr4: 105206518-105206538 | AUCUCUUAUUUGGAGGGCAU | 6728 |
| 54790_2_12894 | - | chr4: 105206519-105206539 | CAUCUCUUAUUUGGAGGGCA | 6729 |
| 54790_2_12896 | - | chr4: 105206524-105206544 | UCCAUCAUCUCUUAUUUGGA | 6730 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_12897 | - | chr4: 105206525-105206545 | CUCCAUCAUCUCUUAUUGG | 6731 |
| 54790_2_12900 | - | chr4: 105206528-105206548 | CUGCUCCAUCAUCUCUUAUU | 6732 |
| 54790_2_12907 | - | chr4: 105206573-105206593 | CCCUCUUUUAAAGUCAGUUG | 6733 |
| 54790_2_12922 | - | chr4: 105206673-105206693 | UACCUUAUCACGGUCGACUC | 6734 |
| 54790_2_12927 | - | chr4: 105206692-105206712 | GGUAAUCGUGAUUUUAUGGU | 6735 |
| 54790_2_12939 | - | chr4: 105206796-105206816 | UGGAGGACUUGUAGACUAGC | 6736 |
| 54790_2_12942 | - | chr4: 105206813-105206833 | CAUGAACAAAAUCAGGCUGG | 6737 |
| 54790_2_12944 | - | chr4: 105206816-105206836 | GUUCAUGAACAAAAUCAGGC | 6738 |
| 54790_2_12948 | - | chr4: 105206820-105206840 | UCAUGUUCAUGAACAAAAUC | 6739 |
| 54790_2_12958 | - | chr4: 105206864-105206884 | AAAGCAGUAUCCAAUAUUAA | 6740 |
| 54790_2_12979 | - | chr4: 105206941-105206961 | UAUUUUUGUUCUUGCGAGAC | 6741 |
| 54790_2_12986 | - | chr4: 105206966-105206986 | CAAACUUGUUUUAUAUGACU | 6742 |
| 54790_2_13013 | - | chr4: 105207076-105207096 | CAUUUCCAUAUAUUAAUGUU | 6743 |
| 54790_2_13027 | - | chr4: 105207149-105207169 | GAGAAUCUUAUAAAAGCAAC | 6744 |
| 54790_2_13055 | - | chr4: 105207308-105207328 | AAGGAGAGUUCUCAUGCUUA | 6745 |
| 54790_2_13061 | - | chr4: 105207327-105207347 | GUCUCCCUUUGUACUUCAAA | 6746 |
| 54790_2_13080 | - | chr4: 105207407-105207427 | AAUCUGUUGGCUAUUCUGAA | 6747 |
| 54790_2_13084 | - | chr4: 105207420-105207440 | AACUCUUGUUUAAAAUCUGU | 6748 |
| 54790_2_13095 | - | chr4: 105207515-105207535 | AUAGCCAAAACAAGCAGAAA | 6749 |
| 54790_2_13096 | - | chr4: 105207516-105207536 | CAUAGCCAAAACAAGCAGAA | 6750 |
| 54790_2_13101 | - | chr4: 105207543-105207563 | CUUAAAUACAGACACUGAAA | 6751 |
| 54790_2_13115 | - | chr4: 105207613-105207633 | UUUCACAUCCGAAAUCAUAC | 6752 |
| 54790_2_13119 | - | chr4: 105207651-105207671 | CACAGCAGUAUAGGUUAACA | 6753 |
| 54790_2_13122 | - | chr4: 105207660-105207680 | AAUGACUUCCACAGCAGUAU | 6754 |
| 54790_2_13135 | - | chr4: 105207734-105207754 | AAGAGUGAUAAAGUUAAAUU | 6755 |
| 54790_2_13146 | - | chr4: 105207791-105207811 | AGAUAGAAGUUAUCGUCUGU | 6756 |
| 54790_2_13159 | - | chr4: 105207870-105207890 | UCAAUGAAUUCUUCUUUGGU | 6757 |
| 54790_2_13165 | - | chr4: 105207909-105207929 | AUAUGAGGGGUAACCACACU | 6758 |
| 54790_2_13166 | - | chr4: 105207910-105207930 | GAUAUGAGGGGUAACCACAC | 6759 |
| 54790_2_13170 | - | chr4: 105207917-105207937 | GACAGUAGAUAUGAGGGGUA | 6760 |
| 54790_2_13177 | - | chr4: 105207964-105207984 | GUUUAAGUUGAAUAGGUUUU | 6761 |
| 54790_2_13180 | - | chr4: 105207992-105208012 | AGACAUGGACAUACAGGGUA | 6762 |
| 54790_2_13189 | - | chr4: 105208037-105208057 | GAAGUCGUCUCAAGUGUUAA | 6763 |
| 54790_2_13206 | - | chr4: 105208147-105208167 | AGGUGACCCAAGAGAUGGCC | 6764 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_13209 | - | chr4: 105208152-105208172 | UGGCAAGGUGACCCAAGAGA | 6765 |
| 54790_2_13212 | - | chr4: 105208167-105208187 | AAGAGAAUGAAAAGUUGGCA | 6766 |
| 54790_2_13213 | - | chr4: 105208172-105208192 | UUGUAAAGAGAAUGAAAAGU | 6767 |
| 54790_2_13227 | - | chr4: 105208233-105208253 | CAAGGUGACCCAAGAUAAGU | 6768 |
| 54790_2_13228 | - | chr4: 105208251-105208271 | AAGAGAAUGAAAAGUUAGCA | 6769 |
| 54790_2_13237 | - | chr4: 105208302-105208322 | GAGAAGCCAGCUUGAGAAUG | 6770 |
| 54790_2_13238 | - | chr4: 105208303-105208323 | AGAGAAGCCAGCUUGAGAAU | 6771 |
| 54790_2_13240 | - | chr4: 105208304-105208324 | CAGAGAAGCCAGCUUGAGAA | 6772 |
| 54790_2_13256 | - | chr4: 105208367-105208387 | CUGCUCAAUGCUAGCCAUUU | 6773 |
| 54790_2_13257 | - | chr4: 105208368-105208388 | CCUGCUCAAUGCUAGCCAUU | 6774 |
| 54790_2_13262 | - | chr4: 105208394-105208414 | UAAUUCAGAGGAGUAUGUUG | 6775 |
| 54790_2_13263 | - | chr4: 105208395-105208415 | GUAAUUCAGAGGAGUAUGUU | 6776 |
| 54790_2_13266 | - | chr4: 105208396-105208416 | UGUAAUUCAGAGGAGUAUGU | 6777 |
| 54790_2_13268 | - | chr4: 105208406-105208426 | UAACUCAAAAUGUAAUUCAG | 6778 |
| 54790_2_13286 | - | chr4: 105208503-105208523 | UCUCUAUCCCUUAUACUUAA | 6779 |
| 54790_2_13297 | - | chr4: 105208578-105208598 | AGAAGUAUAAACUGAUUAAA | 6780 |
| 54790_2_13305 | - | chr4: 105208611-105208631 | CUCAGCAACUUUUUGAUGAC | 6781 |
| 54790_2_13320 | - | chr4: 105208720-105208740 | UCCUAAACUUUGAGAUUAAU | 6782 |
| 54790_2_13328 | - | chr4: 105208777-105208797 | AGGUUACCACGUCAAAAAGC | 6783 |
| 54790_2_13337 | - | chr4: 105208797-105208817 | CUGUUUCCUUUUGUUAUGGC | 6784 |
| 54790_2_13340 | - | chr4: 105208801-105208821 | CCUGCUGUUUCCUUUUGUUA | 6785 |
| 54790_2_13347 | - | chr4: 105208834-105208854 | GGGAAGAAGACUGUUUUAAU | 6786 |
| 54790_2_13356 | - | chr4: 105208854-105208874 | GCUGACAGUUCGUUCUUUGG | 6787 |
| 54790_2_13357 | - | chr4: 105208855-105208875 | UGCUGACAGUUCGUUCUUUG | 6788 |
| 54790_2_13359 | - | chr4: 105208856-105208876 | UUGCUGACAGUUCGUUCUUU | 6789 |
| 54790_2_13362 | - | chr4: 105208857-105208877 | UUUGCUGACAGUUCGUUCUU | 6790 |
| 54790_2_13387 | - | chr4: 105208977-105208997 | AAUGCCAAACUUAAUUCUAC | 6791 |
| 54790_2_13394 | - | chr4: 105209039-105209059 | AUAUAUAUAUCCAUGCCUUG | 6792 |
| 54790_2_13407 | - | chr4: 105209171-105209191 | GAAUACACACCAAAAGUGAA | 6793 |
| 54790_2_13411 | - | chr4: 105209193-105209213 | CUGGUUGAAUAACUCACAGC | 6794 |
| 54790_2_13417 | - | chr4: 105209212-105209232 | AGACUCAAACUUAGUGAGCC | 6795 |
| 54790_2_13442 | - | chr4: 105209338-105209358 | AGAUUUCCUCCCUAUUUGGA | 6796 |
| 54790_2_13445 | - | chr4: 105209342-105209362 | UUUCAGAUUUCCUCCCUAUU | 6797 |
| 54790_2_13449 | - | chr4: 105209373-105209393 | CAGAGCAUCUCAGUCAACAC | 6798 |
| 54790_2_13453 | - | chr4: 105209402-105209422 | AGUUGGUGAGCUCUGAGUCC | 6799 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_13457 | - | chr4: 105209419-105209439 | UUAACAUAAAGAUCCAAAGU | 6800 |
| 54790_2_13465 | - | chr4: 105209489-105209509 | AGCCACUGACCUAUAUCAAG | 6801 |
| 54790_2_13475 | - | chr4: 105209526-105209546 | UUUAGUUAAAAGAAAGUUGU | 6802 |
| 54790_2_13482 | - | chr4: 105209561-105209581 | CCCAUUGUGACAAACCAACU | 6803 |
| 54790_2_13500 | - | chr4: 105209668-105209688 | UUAUAAAAGCAUCUUCACCA | 6804 |
| 54790_2_13516 | - | chr4: 105209730-105209750 | UGUUUAAAAUAAUUCUUUCA | 6805 |
| 54790_2_13533 | - | chr4: 105209900-105209920 | ACGACAGUGGUAGAGUAACG | 6806 |
| 54790_2_13539 | - | chr4: 105209927-105209947 | ACAGGAAUGAAAAUGAUGGU | 6807 |
| 54790_2_13550 | - | chr4: 105209990-105210010 | GGCAAAUUUUUAUUGGAUA | 6808 |
| 54790_2_13558 | - | chr4: 105210031-105210051 | UCAAUGAAUUCUUCUUUGGU | 6809 |
| 54790_2_13564 | - | chr4: 105210069-105210089 | UGUAAGGGUAGUCACACUC | 6810 |
| 54790_2_13565 | - | chr4: 105210070-105210090 | AUGUAAGGGUAGUCACACU | 6811 |
| 54790_2_13566 | - | chr4: 105210071-105210091 | GAUGUAAGGGUAGUCACAC | 6812 |
| 54790_2_13576 | - | chr4: 105210123-105210143 | GUUGAGAUGAAUAGGUUUU | 6813 |
| 54790_2_13579 | - | chr4: 105210151-105210171 | AGACAUGGACAUACAGGGUA | 6814 |
| 54790_2_13587 | - | chr4: 105210196-105210216 | GAAGUCGUCUCAAGUGUUAA | 6815 |
| 54790_2_13602 | - | chr4: 105210306-105210326 | UCCACUGGGUUCUCUACCGG | 6816 |
| 54790_2_13605 | - | chr4: 105210311-105210331 | GUUGUUCCACUGGGUUCUCU | 6817 |
| 54790_2_13608 | - | chr4: 105210326-105210346 | UUCUCUUACUUUUCAGUUGU | 6818 |
| 54790_2_13619 | - | chr4: 105210379-105210399 | CUCUUCGGUCGGACUCUAAC | 6819 |
| 54790_2_13620 | - | chr4: 105210380-105210400 | CCUCUUCGGUCGGACUCUAA | 6820 |
| 54790_2_13621 | - | chr4: 105210381-105210401 | ACCUCUUCGGUCGGACUCUA | 6821 |
| 54790_2_13628 | - | chr4: 105210401-105210421 | UAGGGUUCAUUCUCAUGUCA | 6822 |
| 54790_2_13635 | - | chr4: 105210453-105210473 | CUUGACACAAUUGGAUGGUU | 6823 |
| 54790_2_13638 | - | chr4: 105210486-105210506 | UUAGUCGUUCCCCAGAUUCG | 6824 |
| 54790_2_13641 | - | chr4: 105210496-105210516 | GUUCAGUCCUUUAGUCGUUC | 6825 |
| 54790_2_13642 | - | chr4: 105210497-105210517 | UGUUCAGUCCUUUAGUCGUU | 6826 |
| 54790_2_13643 | - | chr4: 105210498-105210518 | AUGUUCAGUCCUUUAGUCGU | 6827 |
| 54790_2_13648 | - | chr4: 105210510-105210530 | CCGUCAACUCACAUGUUCAG | 6828 |
| 54790_2_13653 | - | chr4: 105210531-105210551 | AAUUUCACCCAUAUAAUCCG | 6829 |
| 54790_2_13655 | - | chr4: 105210535-105210555 | UAGUAAUUUCACCCAUAUAA | 6830 |
| 54790_2_13657 | - | chr4: 105210544-105210564 | UACAUGUAAUAGUAAUUUCA | 6831 |
| 54790_2_13659 | - | chr4: 105210545-105210565 | CUACAUGUAAUAGUAAUUUC | 6832 |
| 54790_2_13667 | - | chr4: 105210595-105210615 | AUACUGACUGUCUUUUUAAU | 6833 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_13673 | − | chr4: 105210623-105210643 | UAAACAAUCCUACCCAUUUA | 6834 |
| 54790_2_13674 | − | chr4: 105210624-105210644 | AUAAACAAUCCUACCCAUUU | 6835 |
| 54790_2_13678 | − | chr4: 105210631-105210651 | UACCACGAUAAACAAUCCUA | 6836 |
| 54790_2_13679 | − | chr4: 105210632-105210652 | CUACCACGAUAAACAAUCCU | 6837 |
| 54790_2_13681 | − | chr4: 105210636-105210656 | ACUACUACCACGAUAAACAA | 6838 |
| 54790_2_13686 | − | chr4: 105210650-105210670 | AACUCGAUUUUCCAACUACU | 6839 |
| 54790_2_13688 | − | chr4: 105210660-105210680 | CUCAAAACAGAACUCGAUUU | 6840 |
| 54790_2_13693 | − | chr4: 105210705-105210725 | CUACACUCUUUCAUGUACUU | 6841 |
| 54790_2_13700 | − | chr4: 105210732-105210752 | CUUUGUCUUGUUGAACCAUU | 6842 |
| 54790_2_13705 | − | chr4: 105210738-105210758 | UUCCGUCUUUGUCUUGUUGA | 6843 |
| 54790_2_13711 | − | chr4: 105210757-105210777 | UUUAAAUCCUGUGUAAAACU | 6844 |
| 54790_2_13713 | − | chr4: 105210771-105210791 | CGUCUCUUUACCUAUUUAAA | 6845 |
| 54790_2_13715 | − | chr4: 105210782-105210802 | CUUAUCGUCACCGUCUCUUU | 6846 |
| 54790_2_13719 | − | chr4: 105210793-105210813 | GGACUUGAUCUCUUAUCGUC | 6847 |
| 54790_2_13724 | − | chr4: 105210825-105210845 | UGGCGUCAUUAUGUUCUCUU | 6848 |
| 54790_2_13738 | − | chr4: 105210903-105210923 | UCUGGAAAUUUUCUAGUGAG | 6849 |
| 54790_2_13744 | − | chr4: 105210961-105210981 | AUUUAGGUCACCCUUCGGUA | 6850 |
| 54790_2_13748 | − | chr4: 105210971-105210991 | CUAAUAAUAAAUUUAGGUCA | 6851 |
| 54790_2_13750 | − | chr4: 105210972-105210992 | UCUAAUAAUAAAUUUAGGUC | 6852 |
| 54790_2_13752 | − | chr4: 105211007-105211027 | CUUCAUACAUUUCCGGUACC | 6853 |
| 54790_2_13756 | − | chr4: 105211010-105211030 | GAUCUUCAUACAUUUCCGGU | 6854 |
| 54790_2_13759 | − | chr4: 105211016-105211036 | CACGCCGAUCUUCAUACAUU | 6855 |
| 54790_2_13764 | − | chr4: 105211033-105211053 | UUCUCCUCACAAAACUCCAC | 6856 |
| 54790_2_13765 | − | chr4: 105211038-105211058 | ACUUGUUCUCCUCACAAAAC | 6857 |
| 54790_2_13770 | − | chr4: 105211050-105211070 | CAAUCAAGAGUCACUUGUUC | 6858 |
| 54790_2_13774 | − | chr4: 105211077-105211097 | AUCGACUCCUCUUCUCUUUG | 6859 |
| 54790_2_13780 | − | chr4: 105211091-105211111 | UUUAAUCGUACUAUAUCGAC | 6860 |
| 54790_2_13785 | − | chr4: 105211125-105211145 | UCUCCCUUGUUUUCAUGUUU | 6861 |
| 54790_2_13787 | − | chr4: 105211142-105211162 | CCUUCUUACUAAGUCGAUCU | 6862 |
| 54790_2_13789 | − | chr4: 105211143-105211163 | ACCUUCUUACUAAGUCGAUC | 6863 |
| 54790_2_13794 | − | chr4: 105211163-105211183 | UUCGGUUACUAUCUUACUGG | 6864 |
| 54790_2_13807 | − | chr4: 105211230-105211250 | GAUAAAUCUAUCUCGUCCAU | 6865 |
| 54790_2_13809 | − | chr4: 105211235-105211255 | GUCCUGAUAAAUCUAUCUCG | 6866 |
| 54790_2_13811 | − | chr4: 105211254-105211274 | CUCUAUUUCUCCUGAUUUUG | 6867 |
| 54790_2_13813 | − | chr4: 105211265-105211285 | UAGACUCACUACUCUAUUUC | 6868 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_13821 | - | chr4: 105211294-105211314 | GUCUGACUACUCACGAUACU | 6869 |
| 54790_2_13823 | - | chr4: 105211295-105211315 | AGUCUGACUACUCACGAUAC | 6870 |
| 54790_2_13832 | - | chr4: 105211375-105211395 | AUCCCUACUUGUUCUAUCAG | 6871 |
| 54790_2_13838 | - | chr4: 105211393-105211413 | AAGAUCCAAGAUCCCUACAU | 6872 |
| 54790_2_13839 | - | chr4: 105211394-105211414 | CAAGAUCCAAGAUCCCUACA | 6873 |
| 54790_2_13844 | - | chr4: 105211401-105211421 | UGUAUAACAAGAUCCAAGAU | 6874 |
| 54790_2_13845 | - | chr4: 105211402-105211422 | UUGUAUAACAAGAUCCAAGA | 6875 |
| 54790_2_13852 | - | chr4: 105211409-105211429 | AUAGAAAUUGUAUAACAAGA | 6876 |
| 54790_2_13860 | - | chr4: 105211472-105211492 | GUCACCUCAGGGGCUGGAC | 6877 |
| 54790_2_13862 | - | chr4: 105211477-105211497 | UGCUGGUCACCUCAGGGGGC | 6878 |
| 54790_2_13865 | - | chr4: 105211481-105211501 | UAAAUGCUGGUCACCUCAGG | 6879 |
| 54790_2_13866 | - | chr4: 105211482-105211502 | CUAAAUGCUGGUCACCUCAG | 6880 |
| 54790_2_13869 | - | chr4: 105211483-105211503 | CCUAAAUGCUGGUCACCUCA | 6881 |
| 54790_2_13871 | - | chr4: 105211484-105211504 | CCCUAAAUGCUGGUCACCUC | 6882 |
| 54790_2_13873 | - | chr4: 105211494-105211514 | UCGGCUUAUUCCCUAAAUGC | 6883 |
| 54790_2_13876 | - | chr4: 105211513-105211533 | UUAAUGGCCCUCCUCUGCCU | 6884 |
| 54790_2_13878 | - | chr4: 105211529-105211549 | CUCUCAUUGCUCCUUCUUAA | 6885 |
| 54790_2_13888 | - | chr4: 105211578-105211598 | GUUAGGACACUCUCACUUUA | 6886 |
| 54790_2_13890 | - | chr4: 105211579-105211599 | UGUUAGGACACUCUCACUUU | 6887 |
| 54790_2_13896 | - | chr4: 105211595-105211615 | CUUUCAUUUAGACCUGUGUU | 6888 |
| 54790_2_13913 | - | chr4: 105211697-105211717 | CAGAAUUUCCCUAUCUUUCA | 6889 |
| 54790_2_13920 | - | chr4: 105211769-105211789 | GGGAUGACUAUUCCCCAAAC | 6890 |
| 54790_2_13921 | - | chr4: 105211789-105211809 | CUCUAUUGUGAAAGACAAAU | 6891 |
| 54790_2_13923 | - | chr4: 105211790-105211810 | ACUCUAUUGUGAAAGACAAA | 6892 |
| 54790_2_13933 | - | chr4: 105211833-105211853 | CACUGUUGUAAUUGUGAUUU | 6893 |
| 54790_2_13946 | - | chr4: 105211876-105211896 | ACAAAUGACACACUAGGACU | 6894 |
| 54790_2_13956 | - | chr4: 105211971-105211991 | GUGAAUAUGAGGUGGCCAUA | 6895 |
| 54790_2_13959 | - | chr4: 105211979-105211999 | UAUGCAGGGUGAAUAUGAGG | 6896 |
| 54790_2_13960 | - | chr4: 105211982-105212002 | UUAUGCAGGGUGAAUAUG | 6897 |
| 54790_2_13964 | - | chr4: 105211993-105212013 | UUGGCAUACUGUUAUAUGCA | 6898 |
| 54790_2_13965 | - | chr4: 105211994-105212014 | AUUGGCAUACUGUUAUAUGC | 6899 |
| 54790_2_13970 | - | chr4: 105212012-105212032 | UUCACGCCUCAUUCCUACAU | 6900 |
| 54790_2_13978 | - | chr4: 105212066-105212086 | AGCUACCAAAGGAAUAAUCA | 6901 |
| 54790_2_13981 | - | chr4: 105212077-105212097 | AUUUCCCUUGAAGCUACCAA | 6902 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_13990 | − | chr4: 105212125-105212145 | GACAGAUAAAGUGCUGACAU | 6903 |
| 54790_2_13994 | − | chr4: 105212126-105212146 | GGACAGAUAAAGUGCUGACA | 6904 |
| 54790_2_14000 | − | chr4: 105212147-105212167 | UUUGGAAUUUCUCAUGUUUC | 6905 |
| 54790_2_14003 | − | chr4: 105212165-105212185 | AACUGCAUGGCUUGAACAUU | 6906 |
| 54790_2_14007 | − | chr4: 105212178-105212198 | CUGACUAGAUAAAAACUGCA | 6907 |
| 54790_2_14011 | − | chr4: 105212214-105212234 | CAUUACAACUAUGGGUAACC | 6908 |
| 54790_2_14013 | − | chr4: 105212222-105212242 | GAGGUAUUCAUUACAACUAU | 6909 |
| 54790_2_14014 | − | chr4: 105212223-105212243 | GGAGGUAUUCAUUACAACUA | 6910 |
| 54790_2_14017 | − | chr4: 105212241-105212261 | ACAUUAAGAAGAUAAAGAGG | 6911 |
| 54790_2_14018 | − | chr4: 105212244-105212264 | AGAACAUUAAGAAGAUAAAG | 6912 |
| 54790_2_14030 | − | chr4: 105212273-105212293 | AGUAAUCUUUAUAGAUCAUU | 6913 |
| 54790_2_14032 | − | chr4: 105212303-105212323 | CUGCUGGACCUCAAUCUGAA | 6914 |
| 54790_2_14036 | − | chr4: 105212319-105212339 | GUAGUGUUCUGAAAGUCUGC | 6915 |
| 54790_2_14048 | − | chr4: 105212357-105212377 | AGCUUAUUAUUUUAUUAGUU | 6916 |
| 54790_2_14049 | − | chr4: 105212358-105212378 | GAGCUUAUUAUUUUAUUAGU | 6917 |
| 54790_2_14061 | − | chr4: 105212474-105212494 | CCACAAAUAAAGGCAAAUAC | 6918 |
| 54790_2_14062 | − | chr4: 105212484-105212504 | GUGUGUAUACCCACAAAUAA | 6919 |
| 54790_2_14068 | − | chr4: 105212518-105212538 | AAUGAUUUUACUCUAGUUUA | 6920 |
| 54790_2_14078 | − | chr4: 105212568-105212588 | AUACACAAUUUGAAAAUUUU | 6921 |
| 54790_2_14080 | − | chr4: 105212569-105212589 | CAUACACAAUUUGAAAAUUU | 6922 |
| 54790_2_14092 | − | chr4: 105212617-105212637 | UAAUUUCAUUUAAACCAGAA | 6923 |
| 54790_2_14108 | − | chr4: 105212708-105212728 | GCACUCGAUGGCGUGGACCG | 6924 |
| 54790_2_14111 | − | chr4: 105212712-105212732 | GUCCGCACUCGAUGGCGUGG | 6925 |
| 54790_2_14113 | − | chr4: 105212731-105212751 | AGGGUUUCACGACCCUAAUG | 6926 |
| 54790_2_14114 | − | chr4: 105212739-105212759 | GGAGUCGGAGGGUUUCACGA | 6927 |
| 54790_2_14115 | − | chr4: 105212740-105212760 | CGGAGUCGGAGGGUUUCACG | 6928 |
| 54790_2_14122 | − | chr4: 105212773-105212793 | CCAAAACUUGAGGACUGAAG | 6929 |
| 54790_2_14127 | − | chr4: 105212794-105212814 | AAAGUGGUACAACCGGUCCG | 6930 |
| 54790_2_14128 | − | chr4: 105212798-105212818 | UCCCAAAGUGGUACAACCGG | 6931 |
| 54790_2_14129 | − | chr4: 105212803-105212823 | CUCUGUCCCAAAGUGGUACA | 6932 |
| 54790_2_14138 | − | chr4: 105212817-105212837 | AACAUAAAAAUCAUCUCUGU | 6933 |
| 54790_2_14139 | − | chr4: 105212818-105212838 | AAACAUAAAAAUCAUCUCUG | 6934 |
| 54790_2_14142 | − | chr4: 105212847-105212867 | GUCCGUGCACGGUGGUACGG | 6935 |
| 54790_2_14143 | − | chr4: 105212866-105212886 | UAGGUUCAUAGACCCUGAUG | 6936 |
| 54790_2_14144 | − | chr4: 105212874-105212894 | GGAGUCGGUAGGUUCAUAGA | 6937 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_14145 | - | chr4: 105212875-105212895 | CGGAGUCGGUAGGUUCAUAG | 6938 |
| 54790_2_14150 | - | chr4: 105212914-105212934 | GUGACGUUGGAGGCGGAGGA | 6939 |
| 54790_2_14151 | - | chr4: 105212915-105212935 | AGUGACGUUGGAGGCGGAGG | 6940 |
| 54790_2_14153 | - | chr4: 105212950-105212970 | AGCUGGUCCGAUCUCACGUC | 6941 |
| 54790_2_14156 | - | chr4: 105212964-105212984 | UCUAAGAGUGAGACAGCUGG | 6942 |
| 54790_2_14173 | - | chr4: 105213016-105213036 | GGUGGGUGGGUGGGGAAUG | 6943 |
| 54790_2_14174 | - | chr4: 105213017-105213037 | UGGUGGGUGGGUGGGGAAU | 6944 |
| 54790_2_14177 | - | chr4: 105213018-105213038 | UUGGUGGGUGGGUGGGGAA | 6945 |
| 54790_2_14180 | - | chr4: 105213023-105213043 | GUCUUUUGGUGGGUGGGUGG | 6946 |
| 54790_2_14181 | - | chr4: 105213024-105213044 | AGUCUUUUGGUGGGUGGGUG | 6947 |
| 54790_2_14183 | - | chr4: 105213025-105213045 | GAGUCUUUUGGUGGGUGGGU | 6948 |
| 54790_2_14186 | - | chr4: 105213026-105213046 | GGAGUCUUUUGGUGGGUGGG | 6949 |
| 54790_2_14188 | - | chr4: 105213029-105213049 | AAUGGAGUCUUUUGGUGGGU | 6950 |
| 54790_2_14189 | - | chr4: 105213030-105213050 | CAAUGGAGUCUUUUGGUGGG | 6951 |
| 54790_2_14191 | - | chr4: 105213033-105213053 | CUCCAAUGGAGUCUUUUGGU | 6952 |
| 54790_2_14192 | - | chr4: 105213034-105213054 | ACUCCAAUGGAGUCUUUUGG | 6953 |
| 54790_2_14194 | - | chr4: 105213037-105213057 | AAAACUCCAAUGGAGUCUUU | 6954 |
| 54790_2_14198 | - | chr4: 105213047-105213067 | UUUGUAAAAUAAAACUCCAA | 6955 |
| 54790_2_14214 | - | chr4: 105213139-105213159 | CUAUGUCAGAAAAAGAAUUG | 6956 |
| 54790_2_14230 | - | chr4: 105213245-105213265 | CUGACGUGUCAAACUUCAGC | 6957 |
| 54790_2_14262 | - | chr4: 105213379-105213399 | AAACUCAAUUUGAUUAAAAU | 6958 |
| 54790_2_14274 | - | chr4: 105213451-105213471 | UUAGUGUGUCAUUUUGAAUA | 6959 |
| 54790_2_14278 | - | chr4: 105213480-105213500 | CAAUGAGAAGAAUACAGAUG | 6960 |
| 54790_2_14285 | - | chr4: 105213519-105213539 | AAGUCCAUUUGGUCAAGCAU | 6961 |
| 54790_2_14287 | - | chr4: 105213530-105213550 | AAAAUAGCAGGAAGUCCAUU | 6962 |
| 54790_2_14289 | - | chr4: 105213542-105213562 | GAAAAAUAUCUUAAAAUAGC | 6963 |
| 54790_2_14299 | - | chr4: 105213603-105213623 | AGAAGAACAUCCUAGGUAAA | 6964 |
| 54790_2_14302 | - | chr4: 105213604-105213624 | AAGAAGAACAUCCUAGGUAA | 6965 |
| 54790_2_14305 | - | chr4: 105213610-105213630 | CAGUGAAAGAAGAACAUCCU | 6966 |
| 54790_2_14323 | - | chr4: 105213656-105213676 | GGCUUUUGGUAGUGUGCUUU | 6967 |
| 54790_2_14325 | - | chr4: 105213670-105213690 | UCAUCCAAAUGAAGGGCUUU | 6968 |
| 54790_2_14326 | - | chr4: 105213677-105213697 | AGGUGGGUCAUCCAAAUGAA | 6969 |
| 54790_2_14327 | - | chr4: 105213678-105213698 | AAGGUGGGUCAUCCAAAUGA | 6970 |
| 54790_2_14330 | - | chr4: 105213693-105213713 | AUGGAGACUCAUAGGAAGGU | 6971 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_14331 | − | chr4: 105213694-105213714 | UAUGGAGACUCAUAGGAAGG | 6972 |
| 54790_2_14333 | − | chr4: 105213697-105213717 | AACUAUGGAGACUCAUAGGA | 6973 |
| 54790_2_14335 | − | chr4: 105213701-105213721 | AUGCAACUAUGGAGACUCAU | 6974 |
| 54790_2_14338 | − | chr4: 105213712-105213732 | UGCCAUCAGACAUGCAACUA | 6975 |
| 54790_2_14353 | − | chr4: 105213795-105213815 | AUGGGAAACAGAAUGACAAU | 6976 |
| 54790_2_14356 | − | chr4: 105213813-105213833 | AGUACUGUACUAGGUGCCAU | 6977 |
| 54790_2_14358 | − | chr4: 105213814-105213834 | GAGUACUGUACUAGGUGCCA | 6978 |
| 54790_2_14360 | − | chr4: 105213822-105213842 | UGUGAGCAGAGUACUGUACU | 6979 |
| 54790_2_14369 | − | chr4: 105213892-105213912 | UGAGGUGGGACCCGCUGUCU | 6980 |
| 54790_2_14371 | − | chr4: 105213893-105213913 | AUGAGGUGGGACCCGCUGUC | 6981 |
| 54790_2_14375 | − | chr4: 105213902-105213922 | CGUGGUGACAUGAGGUGGGA | 6982 |
| 54790_2_14376 | − | chr4: 105213903-105213923 | ACGUGGUGACAUGAGGUGGG | 6983 |
| 54790_2_14382 | − | chr4: 105213943-105213963 | AGUGAACUUGGGUCGUCGUC | 6984 |
| 54790_2_14386 | − | chr4: 105213970-105213990 | CGAUGAGCCCUCAGACUCUG | 6985 |
| 54790_2_14390 | − | chr4: 105213983-105214003 | ACCAUAUCAGGGUCGAUGAG | 6986 |
| 54790_2_14392 | − | chr4: 105213984-105214004 | CACCAUAUCAGGGUCGAUGA | 6987 |
| 54790_2_14396 | − | chr4: 105214003-105214023 | UCGGUCCGUACCACCGUACC | 6988 |
| 54790_2_14397 | − | chr4: 105214006-105214026 | CAAUCGGUCCGUACCACCGU | 6989 |
| 54790_2_14399 | − | chr4: 105214011-105214031 | AUUUCAAUCGGUCCGUACC | 6990 |
| 54790_2_14401 | − | chr4: 105214014-105214034 | AUGAUUUCAAUCGGUCCGU | 6991 |
| 54790_2_14403 | − | chr4: 105214019-105214039 | CAAAGAUGAUUUCAAUCGG | 6992 |
| 54790_2_14406 | − | chr4: 105214051-105214071 | CCUCUGGUCGGACCGGUUGU | 6993 |
| 54790_2_14407 | − | chr4: 105214060-105214080 | GGUCCUCAACCUCUGGUCGG | 6994 |
| 54790_2_14410 | − | chr4: 105214072-105214092 | CUAGUGAACUCCGGUCCUCA | 6995 |
| 54790_2_14412 | − | chr4: 105214078-105214098 | GUCCACCUAGUGAACUCCGG | 6996 |
| 54790_2_14415 | − | chr4: 105214083-105214103 | GUUCCGUCCACCUAGUGAAC | 6997 |
| 54790_2_14419 | − | chr4: 105214094-105214114 | GAAAUACUCCGGUUCCGUCC | 6998 |
| 54790_2_14421 | − | chr4: 105214097-105214117 | CGUGAAAUACUCCGGUUCCG | 6999 |
| 54790_2_14425 | − | chr4: 105214101-105214121 | GGAUCGUGAAAUACUCCGGU | 7000 |
| 54790_2_14426 | − | chr4: 105214107-105214127 | UUUUGAGGAUCGUGAAAUAC | 7001 |
| 54790_2_14428 | − | chr4: 105214135-105214155 | AUAUAUAGCAUUGUACUGUA | 7002 |
| 54790_2_14430 | − | chr4: 105214169-105214189 | CUCGAUACUUGGUCUUUGGU | 7003 |
| 54790_2_14435 | − | chr4: 105214191-105214211 | UUCUGACAUUUUCCCUAUA | 7004 |
| 54790_2_14438 | − | chr4: 105214198-105214218 | GAUUGUUUCUGACAUUUUU | 7005 |
| 54790_2_14439 | − | chr4: 105214199-105214219 | AGAUUGUUUUCUGACAUUUU | 7006 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_14446 | − | chr4: 105214239-105214259 | CAAAAGAUUCCGGACGGGGC | 7007 |
| 54790_2_14448 | − | chr4: 105214251-105214271 | UCCUCUCUAAGACAAAAGAU | 7008 |
| 54790_2_14451 | − | chr4: 105214271-105214291 | CCCUGUUCACUUUCCUUCCG | 7009 |
| 54790_2_14453 | − | chr4: 105214275-105214295 | AGCCCCCUGUUCACUUUCCU | 7010 |
| 54790_2_14454 | − | chr4: 105214279-105214299 | AGGGAGCCCCCUGUUCACUU | 7011 |
| 54790_2_14458 | − | chr4: 105214291-105214311 | UUUUUUUUUUAGAGGGAGCC | 7012 |
| 54790_2_14460 | − | chr4: 105214292-105214312 | UUUUUUUUUUUAGAGGGAGC | 7013 |
| 54790_2_14461 | − | chr4: 105214293-105214313 | UUUUUUUUUUUUAGAGGGAG | 7014 |
| 54790_2_14463 | − | chr4: 105214294-105214314 | UUUUUUUUUUUUUAGAGGGA | 7015 |
| 54790_2_14467 | − | chr4: 105214339-105214359 | UGAGGUCGGACCCACUGUGU | 7016 |
| 54790_2_14470 | − | chr4: 105214340-105214360 | GUGAGGUCGGACCCACUGUG | 7017 |
| 54790_2_14472 | − | chr4: 105214349-105214369 | UGUGGUGACGUGAGGUCGGA | 7018 |
| 54790_2_14473 | − | chr4: 105214350-105214370 | GUGUGGUGACGUGAGGUCGG | 7019 |
| 54790_2_14477 | − | chr4: 105214384-105214404 | UUGGAUCCUCCGACUCCGAC | 7020 |
| 54790_2_14479 | − | chr4: 105214390-105214410 | ACGAACUUGGAUCCUCCGAC | 7021 |
| 54790_2_14481 | − | chr4: 105214396-105214416 | CUCCUAACGAACUUGGAUCC | 7022 |
| 54790_2_14482 | − | chr4: 105214399-105214419 | ACCCUCCUAACGAACUUGGA | 7023 |
| 54790_2_14487 | − | chr4: 105214415-105214435 | UGAACCCUCCGACUCUACCC | 7024 |
| 54790_2_14489 | − | chr4: 105214418-105214438 | CCAUGAACCCUCCGACUCUA | 7025 |
| 54790_2_14492 | − | chr4: 105214419-105214439 | UCCAUGAACCCUCCGACUCU | 7026 |
| 54790_2_14495 | − | chr4: 105214428-105214448 | ACAUCAGGGUCCAUGAACCC | 7027 |
| 54790_2_14496 | − | chr4: 105214431-105214451 | CGGACAUCAGGGUCCAUGAA | 7028 |
| 54790_2_14498 | − | chr4: 105214432-105214452 | ACGGACAUCAGGGUCCAUGA | 7029 |
| 54790_2_14501 | − | chr4: 105214439-105214459 | ACCGUACACGGACAUCAGGG | 7030 |
| 54790_2_14502 | − | chr4: 105214459-105214479 | UUUUUUUUACGGUCCACACC | 7031 |
| 54790_2_14503 | − | chr4: 105214462-105214482 | UUUUUUUUUUUACGGUCCAC | 7032 |
| 54790_2_14504 | − | chr4: 105214467-105214487 | UUUUUUUUUUUUUUUACGG | 7033 |
| 54790_2_14506 | − | chr4: 105214511-105214531 | CCUCCGGUCUGACCCGUUGU | 7034 |
| 54790_2_14507 | − | chr4: 105214519-105214539 | GUCCUCGACCUCCGGUCUGA | 7035 |
| 54790_2_14509 | − | chr4: 105214520-105214540 | GGUCCUCGACCUCCGGUCUG | 7036 |
| 54790_2_14511 | − | chr4: 105214529-105214549 | GUGAACUCGGGUCCUCGACC | 7037 |
| 54790_2_14513 | − | chr4: 105214532-105214552 | CUAGUGAACUCGGGUCCUCG | 7038 |
| 54790_2_14516 | − | chr4: 105214538-105214558 | ACCCACCUAGUGAACUCGGG | 7039 |
| 54790_2_14521 | − | chr4: 105214554-105214574 | CACCAAACUCGGUUCCACCC | 7040 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_14524 | − | chr4: 105214557-105214577 | CACCACCAAACUCGGUUCCA | 7041 |
| 54790_2_14525 | − | chr4: 105214558-105214578 | ACACCACCAAACUCGGUUCC | 7042 |
| 54790_2_14527 | − | chr4: 105214561-105214581 | CCCACACCACCAAACUCGGU | 7043 |
| 54790_2_14529 | − | chr4: 105214573-105214593 | AGGGAGUCCCAACCCACACC | 7044 |
| 54790_2_14531 | − | chr4: 105214576-105214596 | UAGAGGGAGUCCCAACCCAC | 7045 |
| 54790_2_14532 | − | chr4: 105214581-105214601 | AAUCUUAGAGGGAGUCCCAA | 7046 |
| 54790_2_14533 | − | chr4: 105214582-105214602 | UAAUCUUAGAGGGAGUCCCA | 7047 |
| 54790_2_14535 | − | chr4: 105214586-105214606 | CUUCUAAUCUUAGAGGGAGU | 7048 |
| 54790_2_14536 | − | chr4: 105214587-105214607 | CCUUCUAAUCUUAGAGGGAG | 7049 |
| 54790_2_14542 | − | chr4: 105214608-105214628 | CUGAGUUUUAGUCUUCCCAC | 7050 |
| 54790_2_14544 | − | chr4: 105214609-105214629 | UCUGAGUUUUAGUCUUCCCA | 7051 |
| 54790_2_14547 | − | chr4: 105214610-105214630 | UUCUGAGUUUUAGUCUUCCC | 7052 |
| 54790_2_14549 | − | chr4: 105214613-105214633 | AAAUUCUGAGUUUUAGUCUU | 7053 |
| 54790_2_14550 | − | chr4: 105214614-105214634 | AAAAUUCUGAGUUUUAGUCU | 7054 |
| 54790_2_14555 | − | chr4: 105214637-105214657 | UUUCCCACCCUGGAAGAGAC | 7055 |
| 54790_2_14556 | − | chr4: 105214638-105214658 | GUUUCCCACCCUGGAAGAGA | 7056 |
| 54790_2_14557 | − | chr4: 105214639-105214659 | CGUUUCCCACCCUGGAAGAG | 7057 |
| 54790_2_14563 | − | chr4: 105214650-105214670 | GAAAGGGGUCACGUUUCCCA | 7058 |
| 54790_2_14564 | − | chr4: 105214651-105214671 | GGAAAGGGGUCACGUUUCCC | 7059 |
| 54790_2_14567 | − | chr4: 105214654-105214674 | UAAGGAAAGGGGUCACGUUU | 7060 |
| 54790_2_14568 | − | chr4: 105214655-105214675 | GUAAGGAAAGGGGUCACGUU | 7061 |
| 54790_2_14575 | − | chr4: 105214693-105214713 | UAGGAGGACUCAAAAAUACC | 7062 |
| 54790_2_14576 | − | chr4: 105214696-105214716 | AGUUAGGAGGACUCAAAAAU | 7063 |
| 54790_2_14584 | − | chr4: 105214745-105214765 | GUGGAAGGUCCUUGGAGGUG | 7064 |
| 54790_2_14585 | − | chr4: 105214757-105214777 | GGGACCUACUCGGUGGAAGG | 7065 |
| 54790_2_14590 | − | chr4: 105214774-105214794 | GCCUCGAAGAUUCAGGAGGG | 7066 |
| 54790_2_14593 | − | chr4: 105214794-105214814 | ACUUCAUAUUCCUUUCACGU | 7067 |
| 54790_2_14597 | − | chr4: 105214805-105214825 | CUACGAAUCCCACUUCAUAU | 7068 |
| 54790_2_14600 | − | chr4: 105214817-105214837 | AUGUCUACUUCUCUACGAAU | 7069 |
| 54790_2_14601 | − | chr4: 105214818-105214838 | UAUGUCUACUUCUCUACGAA | 7070 |
| 54790_2_14611 | − | chr4: 105214841-105214861 | AUAUAAACGACCAAAUAGUU | 7071 |
| 54790_2_14613 | − | chr4: 105214852-105214872 | UUUGUGAAUGAAUAUAAACG | 7072 |
| 54790_2_14620 | − | chr4: 105214898-105214918 | GAGAAACCCAAGUUAUGCAA | 7073 |
| 54790_2_14623 | − | chr4: 105214912-105214932 | CAAGGGUGUUGUGGGAGAAA | 7074 |
| 54790_2_14624 | − | chr4: 105214913-105214933 | CCAAGGGUGUUGUGGGAGAA | 7075 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_14628 | - | chr4: 105214934-105214954 | CUGGUUGGUCGAAGCUCAAC | 7076 |
| 54790_2_14629 | - | chr4: 105214935-105214955 | ACUGGUUGGUCGAAGCUCAA | 7077 |
| 54790_2_14630 | - | chr4: 105214936-105214956 | GACUGGUUGGUCGAAGCUCA | 7078 |
| 54790_2_14636 | - | chr4: 105214971-105214991 | GUCUGUGUUCAGUGUUUAGG | 7079 |
| 54790_2_14643 | - | chr4: 105215048-105215068 | CACAGGAGGUUAAAUUAAGG | 7080 |
| 54790_2_14645 | - | chr4: 105215070-105215090 | UGUUCGUCGUCUGUGAUCGA | 7081 |
| 54790_2_14646 | - | chr4: 105215071-105215091 | UUGUUCGUCGUCUGUGAUCG | 7082 |
| 54790_2_14652 | - | chr4: 105215106-105215126 | AGAACACUGGUUUACACACU | 7083 |
| 54790_2_14653 | - | chr4: 105215107-105215127 | GAGAACACUGGUUUACACAC | 7084 |
| 54790_2_14664 | - | chr4: 105215200-105215220 | AUCACUGCCUAUGGCACACA | 7085 |
| 54790_2_14667 | - | chr4: 105215209-105215229 | CAUAUUCUUAUCACUGCCUA | 7086 |
| 54790_2_14671 | - | chr4: 105215242-105215262 | AGGUCUCAUGUAGCAUUUUC | 7087 |
| 54790_2_14679 | - | chr4: 105215262-105215282 | GAAAAUUAGAUUUUAUAAAA | 7088 |
| 54790_2_14701 | - | chr4: 105215367-105215387 | UUUUCUAGAACAUUAUUUCA | 7089 |
| 54790_2_14713 | - | chr4: 105215439-105215459 | GAAUAAUAAUUCAGGCUUUU | 7090 |
| 54790_2_14715 | - | chr4: 105215447-105215467 | AAUGUGCUGAAUAAUAAUUC | 7091 |
| 54790_2_14733 | - | chr4: 105215544-105215564 | CUCAGAGGCAUUUCUAACUC | 7092 |
| 54790_2_14737 | - | chr4: 105215559-105215579 | AACUCUAAAUCUUUUCUCAG | 7093 |
| 54790_2_14753 | - | chr4: 105215628-105215648 | UGCAUUAUUGAAGCAGUGCU | 7094 |
| 54790_2_14754 | - | chr4: 105215629-105215649 | CUGCAUUAUUGAAGCAGUGC | 7095 |
| 54790_2_14764 | - | chr4: 105215699-105215719 | GAUAAGGGGAAAAAAAAAAC | 7096 |
| 54790_2_14765 | - | chr4: 105215712-105215732 | UAAAAUCACUGCAGAUAAGG | 7097 |
| 54790_2_14768 | - | chr4: 105215713-105215733 | GUAAAAUCACUGCAGAUAAG | 7098 |
| 54790_2_14769 | - | chr4: 105215714-105215734 | GGUAAAAUCACUGCAGAUAA | 7099 |
| 54790_2_14771 | - | chr4: 105215715-105215735 | UGGUAAAAUCACUGCAGAUA | 7100 |
| 54790_2_14775 | - | chr4: 105215735-105215755 | UAAGAUGUAGCAUGAAGAGA | 7101 |
| 54790_2_14783 | - | chr4: 105215758-105215778 | AUGUUUCAAUGUUCUCUUUG | 7102 |
| 54790_2_14789 | - | chr4: 105215806-105215826 | CCAGAAAUGAGUUGGCAUUC | 7103 |
| 54790_2_14792 | - | chr4: 105215814-105215834 | UUAGAACCCCAGAAAUGAGU | 7104 |
| 54790_2_14798 | - | chr4: 105215838-105215858 | UGCUCUGCUAAAAAGGUUA | 7105 |
| 54790_2_14800 | - | chr4: 105215844-105215864 | CUACACUGCUCUGCUAAAAA | 7106 |
| 54790_2_14804 | - | chr4: 105215882-105215902 | UUACUCAGGCCGACCAUUUA | 7107 |
| 54790_2_14808 | - | chr4: 105215896-105215916 | UUACAGUUAAAAUGUUACUC | 7108 |
| 54790_2_14811 | - | chr4: 105215926-105215946 | UGUCAGACAUGUCUCUUCAA | 7109 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_14819 | - | chr4: 105215968-105215988 | AAAGGUACUUUAGUCACACA | 7110 |
| 54790_2_14823 | - | chr4: 105215986-105216006 | GGUUGAUCUCUUAAUAGAAA | 7111 |
| 54790_2_14825 | - | chr4: 105216007-105216027 | CAAAGAGUAGAAGGAAAUGG | 7112 |
| 54790_2_14826 | - | chr4: 105216010-105216030 | GAACAAAGAGUAGAAGGAAA | 7113 |
| 54790_2_14829 | - | chr4: 105216016-105216036 | AGGGGAGAACAAAGAGUAGA | 7114 |
| 54790_2_14840 | - | chr4: 105216034-105216054 | CUGAAUUAACUUUAUUUAAG | 7115 |
| 54790_2_14844 | - | chr4: 105216035-105216055 | GCUGAAUUAACUUUAUUUAA | 7116 |
| 54790_2_14847 | - | chr4: 105216036-105216056 | AGCUGAAUUAACUUUAUUUA | 7117 |
| 54790_2_14860 | - | chr4: 105216121-105216141 | UAGCUCUAAUAUUCACAGCA | 7118 |
| 54790_2_14875 | - | chr4: 105216220-105216240 | UCCUUUUGUUUUAGUCAGCG | 7119 |
| 54790_2_14918 | - | chr4: 105216500-105216520 | CUCUAUCGUAUCCAUCUUUU | 7120 |
| 54790_2_14938 | - | chr4: 105216637-105216657 | AAAUGUUCUGCUUUAACCUG | 7121 |
| 54790_2_14941 | - | chr4: 105216671-105216691 | GAUUGUAGAGGAAAACAUCU | 7122 |
| 54790_2_14943 | - | chr4: 105216683-105216703 | GAACAAAACAGGAUUGUAG | 7123 |
| 54790_2_14951 | - | chr4: 105216693-105216713 | AUUUUCAUAGAACAAAAAC | 7124 |
| 54790_2_14959 | - | chr4: 105216717-105216737 | UAGUGAAUGAUCCAAGUUUA | 7125 |
| 54790_2_14985 | - | chr4: 105216897-105216917 | AUAUAACCUUAACAUUACCU | 7126 |
| 54790_2_14998 | - | chr4: 105217005-105217025 | CUCAAAAAAUCUAAACAUUU | 7127 |
| 54790_2_15007 | - | chr4: 105217064-105217084 | UUCAUAGAGAAUGCAGGGAG | 7128 |
| 54790_2_15008 | - | chr4: 105217065-105217085 | CUUCAUAGAGAAUGCAGGGA | 7129 |
| 54790_2_15009 | - | chr4: 105217066-105217086 | UCUUCAUAGAGAAUGCAGGG | 7130 |
| 54790_2_15013 | - | chr4: 105217069-105217089 | GUAUCUUCAUAGAGAAUGCA | 7131 |
| 54790_2_15015 | - | chr4: 105217070-105217090 | UGUAUCUUCAUAGAGAAUGC | 7132 |
| 54790_2_15029 | - | chr4: 105217127-105217147 | UCUGUUCAUAGGAUAUAAUU | 7133 |
| 54790_2_15030 | - | chr4: 105217138-105217158 | GAAGAGAAAGGUCUGUUCAU | 7134 |
| 54790_2_15035 | - | chr4: 105217150-105217170 | UGCCUUUGAAAUGAAGAGAA | 7135 |
| 54790_2_15073 | - | chr4: 105217346-105217366 | GAGUUCAUUUCAAGAGCAA | 7136 |
| 54790_2_15081 | - | chr4: 105217408-105217428 | CUGAUGAGAACCUGUGGACU | 7137 |
| 54790_2_15084 | - | chr4: 105217414-105217434 | GAGGCACUGAUGAGAACCUG | 7138 |
| 54790_2_15092 | - | chr4: 105217433-105217453 | UAAUCUGUGCAUAGAUCUUG | 7139 |
| 54790_2_15101 | - | chr4: 105217499-105217519 | AAGGUACCUUAUCGUAUGAA | 7140 |
| 54790_2_15103 | - | chr4: 105217514-105217534 | GACUUAUUUGUCAUAAAGGU | 7141 |
| 54790_2_15111 | - | chr4: 105217543-105217563 | UUUGUGUCCUAGUAACAAAU | 7142 |
| 54790_2_15115 | - | chr4: 105217557-105217577 | AGGACCUGUAUUACUUUGUG | 7143 |
| 54790_2_15118 | - | chr4: 105217574-105217594 | UCCACGACACACCGUAAAGG | 7144 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_15120 | - | chr4: 105217584-105217604 | UACAGACCUUUCCACGACAC | 7145 |
| 54790_2_15121 | - | chr4: 105217594-105217614 | ACUACUAUCCUACAGACCUU | 7146 |
| 54790_2_15125 | - | chr4: 105217599-105217619 | AUUAUACUACUAUCCUACAG | 7147 |
| 54790_2_15127 | - | chr4: 105217607-105217627 | UUUCAGAAAUUAUACUACUA | 7148 |
| 54790_2_15135 | - | chr4: 105217634-105217654 | UUAAAACAAAGAAAUUACGU | 7149 |
| 54790_2_15155 | - | chr4: 105217720-105217740 | UUAACGUGUAAUUUUAAAAA | 7150 |
| 54790_2_15160 | - | chr4: 105217746-105217766 | AUCUAUGGGACUGGUUCUUU | 7151 |
| 54790_2_15162 | - | chr4: 105217747-105217767 | UAUCUAUGGGACUGGUUCUU | 7152 |
| 54790_2_15164 | - | chr4: 105217755-105217775 | GUGAUAUCUAUCUAUGGGAC | 7153 |
| 54790_2_15166 | - | chr4: 105217760-105217780 | CAUAUGUGAUAUCUAUCUAU | 7154 |
| 54790_2_15167 | - | chr4: 105217761-105217781 | UCAUAUGUGAUAUCUAUCUA | 7155 |
| 54790_2_15174 | - | chr4: 105217829-105217849 | AGAGAUGUGUCCUAAUGUGU | 7156 |
| 54790_2_15182 | - | chr4: 105217922-105217942 | UUCUUCGUCCAGGAUCCGUU | 7157 |
| 54790_2_15187 | - | chr4: 105217928-105217948 | CUGUAAUUCUUCGUCCAGGA | 7158 |
| 54790_2_15190 | - | chr4: 105217935-105217955 | UUAAAAACUGUAAUUCUUCG | 7159 |
| 54790_2_15195 | - | chr4: 105217964-105217984 | AGACGCCCUCUCUAUUUUAA | 7160 |
| 54790_2_15196 | - | chr4: 105217965-105217985 | GAGACGCCCUCUCUAUUUUA | 7161 |
| 54790_2_15203 | - | chr4: 105217979-105217999 | AAGUGAGCUCAGUUGAGACG | 7162 |
| 54790_2_15204 | - | chr4: 105217980-105218000 | GAAGUGAGCUCAGUUGAGAC | 7163 |
| 54790_2_15230 | - | chr4: 105218117-105218137 | AAAGCAAGUACCCUGGACAG | 7164 |
| 54790_2_15232 | - | chr4: 105218124-105218144 | UGCCCUUAAAGCAAGUACCC | 7165 |
| 54790_2_15236 | - | chr4: 105218147-105218167 | CUUCAUCUUCAAGAAUCACU | 7166 |
| 54790_2_15237 | - | chr4: 105218148-105218168 | UCUUCAUCUUCAAGAAUCAC | 7167 |
| 54790_2_15247 | - | chr4: 105218196-105218216 | UUAAAAAGCUUUCUUCAUUG | 7168 |
| 54790_2_15251 | - | chr4: 105218223-105218243 | CAUAAAUUCUUCUAUGGGGC | 7169 |
| 54790_2_15253 | - | chr4: 105218227-105218247 | GGAACAUAAAUUCUUCUAUG | 7170 |
| 54790_2_15254 | - | chr4: 105218228-105218248 | AGGAACAUAAAUUCUUCUAU | 7171 |
| 54790_2_15255 | - | chr4: 105218229-105218249 | UAGGAACAUAAAUUCUUCUA | 7172 |
| 54790_2_15260 | - | chr4: 105218248-105218268 | GCCAUAUGAUCACAUCACU | 7173 |
| 54790_2_15263 | - | chr4: 105218270-105218290 | UUGGAAAAGAAACACUGGAU | 7174 |
| 54790_2_15264 | - | chr4: 105218275-105218295 | UGUCCUUGGAAAAGAAACAC | 7175 |
| 54790_2_15268 | - | chr4: 105218289-105218309 | CUCCUUAUCAGUACUGUCCU | 7176 |
| 54790_2_15274 | - | chr4: 105218314-105218334 | UCAGGACAAAGAGGUAGAUU | 7177 |
| 54790_2_15275 | - | chr4: 105218323-105218343 | AUGAUCUGUUCAGGACAAAG | 7178 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_15277 | - | chr4: 105218332-105218352 | UAGAUGGAGAUGAUCUGUUC | 7179 |
| 54790_2_15280 | - | chr4: 105218348-105218368 | UGAGCCAAACUAUGAAUAGA | 7180 |
| 54790_2_15289 | - | chr4: 105218407-105218427 | GGCAUGGCAUAGCCGACAUG | 7181 |
| 54790_2_15292 | - | chr4: 105218423-105218443 | GCUAAAAGAACGAAACGGCA | 7182 |
| 54790_2_15293 | - | chr4: 105218428-105218448 | AACAAGCUAAAAGAACGAAA | 7183 |
| 54790_2_15308 | - | chr4: 105218482-105218502 | AAGACCACUUUCGGUUUGAA | 7184 |
| 54790_2_15309 | - | chr4: 105218483-105218503 | GAAGACCACUUUCGGUUUGA | 7185 |
| 54790_2_15312 | - | chr4: 105218491-105218511 | CUCAUCACGAAGACCACUUU | 7186 |
| 54790_2_15316 | - | chr4: 105218528-105218548 | GCAAUGAUAAAUAUCUACUG | 7187 |
| 54790_2_15317 | - | chr4: 105218529-105218549 | GGCAAUGAUAAAUAUCUACU | 7188 |
| 54790_2_15318 | - | chr4: 105218530-105218550 | UGGCAAUGAUAAAUAUCUAC | 7189 |
| 54790_2_15322 | - | chr4: 105218550-105218570 | UACGAUACUAAGAGAUUAAC | 7190 |
| 54790_2_15326 | - | chr4: 105218590-105218610 | UUACUUGUACUAAUGUAGAU | 7191 |
| 54790_2_15334 | - | chr4: 105218613-105218633 | AAUUUUUAAAUAUUAUGCUC | 7192 |
| 54790_2_15336 | - | chr4: 105218614-105218634 | AAAUUUUUAAAUAUUAUGCU | 7193 |
| 54790_2_15338 | - | chr4: 105218615-105218635 | AAAAUUUUUAAAUAUUAUGC | 7194 |
| 54790_2_15349 | - | chr4: 105218673-105218693 | UGAGUUUUGGUUGAUUUACA | 7195 |
| 54790_2_15350 | - | chr4: 105218674-105218694 | CUGAGUUUUGGUUGAUUUAC | 7196 |
| 54790_2_15352 | - | chr4: 105218686-105218706 | AGAACAAGAAUGCUGAGUUU | 7197 |
| 54790_2_15357 | - | chr4: 105218723-105218743 | AAGACAAGACAUAUACCUAC | 7198 |
| 54790_2_15371 | - | chr4: 105218782-105218802 | UCCAGAAGUUGCAUAAAAUA | 7199 |
| 54790_2_15378 | - | chr4: 105218806-105218826 | CUUCUGGAAACAUAAUUUAU | 7200 |
| 54790_2_15379 | - | chr4: 105218807-105218827 | UCUUCUGGAAACAUAAUUUA | 7201 |
| 54790_2_15389 | - | chr4: 105218822-105218842 | UUCAUUACAAAAGGUUCUUC | 7202 |
| 54790_2_15392 | - | chr4: 105218831-105218851 | UAUAUAUUUUUCAUUACAAA | 7203 |
| 54790_2_15401 | - | chr4: 105218932-105218952 | UCUGAAAAGCUCUGAUAAAU | 7204 |
| 54790_2_15433 | - | chr4: 105219187-105219207 | AUCUUCUUAAAGAUUAAUAA | 7205 |
| 54790_2_15451 | - | chr4: 105219233-105219253 | AGUUAAUUUGUAGGAUAUUA | 7206 |
| 54790_2_15452 | - | chr4: 105219242-105219262 | UCAUGUUUUAGUUAAUUUGU | 7207 |
| 54790_2_15464 | - | chr4: 105219280-105219300 | CAUUUUUAUUCUUCCUAUUU | 7208 |
| 54790_2_15467 | - | chr4: 105219304-105219324 | AACUGGUUACCAUAACAAUC | 7209 |
| 54790_2_15471 | - | chr4: 105219321-105219341 | UUGAUCUAGUCUUAAUCAAC | 7210 |
| 54790_2_15485 | - | chr4: 105219382-105219402 | AAGGCAUGCCAUCUAUGUUU | 7211 |
| 54790_2_15493 | - | chr4: 105219401-105219421 | UUCCCUACCAUUGCCUCAAA | 7212 |
| 54790_2_15500 | - | chr4: 105219478-105219498 | UCCUUGUAACACAAGCAUUU | 7213 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_15506 | - | chr4: 105219503-105219523 | UUAUUUAAAAACUCUGUACC | 7214 |
| 54790_2_15512 | - | chr4: 105219570-105219590 | CUAAAUUGUCACAUCCCCAG | 7215 |
| 54790_2_15513 | - | chr4: 105219571-105219591 | ACUAAAUUGUCACAUCCCCA | 7216 |
| 54790_2_15517 | - | chr4: 105219572-105219592 | AACUAAAUUGUCACAUCCCC | 7217 |
| 54790_2_15521 | - | chr4: 105219597-105219617 | GAAAUUAACUAUAUUAGAGU | 7218 |
| 54790_2_15524 | - | chr4: 105219622-105219642 | UACCCCACAAAGCUAUCAAA | 7219 |
| 54790_2_15526 | - | chr4: 105219668-105219688 | UUCAGCCCUAAAAUCAAGAA | 7220 |
| 54790_2_15544 | - | chr4: 105219818-105219838 | AUAAUUUAUGAUAUAUUACU | 7221 |
| 54790_2_15545 | - | chr4: 105219819-105219839 | GAUAAUUUAUGAUAUAUUAC | 7222 |
| 54790_2_15548 | - | chr4: 105219847-105219867 | CUUAGUUCUCAUAGCCCCUC | 7223 |
| 54790_2_15550 | - | chr4: 105219852-105219872 | UGCUCCUUAGUUCUCAUAGC | 7224 |
| 54790_2_15551 | - | chr4: 105219853-105219873 | UUGCUCCUUAGUUCUCAUAG | 7225 |
| 54790_2_15553 | - | chr4: 105219854-105219874 | AUUGCUCCUUAGUUCUCAUA | 7226 |
| 54790_2_15557 | - | chr4: 105219869-105219889 | UUUAUUAUCCCGUCGAUUGC | 7227 |
| 54790_2_15561 | - | chr4: 105219881-105219901 | CCUUUUUGUUUCUUUAUUAU | 7228 |
| 54790_2_15562 | - | chr4: 105219882-105219902 | CCCUUUUUGUUUCUUUAUUA | 7229 |
| 54790_2_15567 | - | chr4: 105219902-105219922 | UUCUUUUACAACUCACGAUU | 7230 |
| 54790_2_15568 | - | chr4: 105219903-105219923 | AUUCUUUUACAACUCACGAU | 7231 |
| 54790_2_15574 | - | chr4: 105219926-105219946 | UCUUUCAUUUAAUACACCAC | 7232 |
| 54790_2_15575 | - | chr4: 105219931-105219951 | GUUAUUCUUUCAUUUAAUAC | 7233 |
| 54790_2_15582 | - | chr4: 105219970-105219990 | AACCUGGACUAUAAGAUUAC | 7234 |
| 54790_2_15585 | - | chr4: 105219989-105220009 | CUAUUUAUGAGGACAGAAGA | 7235 |
| 54790_2_15593 | - | chr4: 105220052-105220072 | AACUUGUAUAAGAUACACAG | 7236 |
| 54790_2_15601 | - | chr4: 105220104-105220124 | GUUAUAAAAAUAAUCUGUCA | 7237 |
| 54790_2_15605 | - | chr4: 105220131-105220151 | GUGUAGUUAUAUAAUGACAC | 7238 |
| 54790_2_15610 | - | chr4: 105220168-105220188 | ACUUUAUGUAAUUUCUAGGA | 7239 |
| 54790_2_15611 | - | chr4: 105220169-105220189 | AACUUUAUGUAAUUUCUAGG | 7240 |
| 54790_2_15614 | - | chr4: 105220172-105220192 | AAGAACUUUAUGUAAUUUCU | 7241 |
| 54790_2_15620 | - | chr4: 105220209-105220229 | UAAUGUAUAGGCCAACAAAU | 7242 |
| 54790_2_15621 | - | chr4: 105220210-105220230 | GUAAUGUAUAGGCCAACAAA | 7243 |
| 54790_2_15627 | - | chr4: 105220221-105220241 | AGGUUAUCUUGGUAAUGUAU | 7244 |
| 54790_2_15636 | - | chr4: 105220253-105220273 | UGAAAGUAAAAAUAUAUGCC | 7245 |
| 54790_2_15638 | - | chr4: 105220256-105220276 | UUUAUGAAAGUAAAAAUAUAU | 7246 |
| 54790_2_15642 | - | chr4: 105220294-105220314 | UGAUAUUAUCAUAUAUACUC | 7247 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_15643 | - | chr4: 105220295-105220315 | CUGAUAUUAUCAUAUAUACU | 7248 |
| 54790_2_15645 | - | chr4: 105220296-105220316 | UCUGAUAUUAUCAUAUAUAC | 7249 |
| 54790_2_15649 | - | chr4: 105220319-105220339 | AAUUACCGACUUACCCCACU | 7250 |
| 54790_2_15653 | - | chr4: 105220325-105220345 | UUCUGUAAUUACCGACUUAC | 7251 |
| 54790_2_15654 | - | chr4: 105220326-105220346 | CUUCUGUAAUUACCGACUUA | 7252 |
| 54790_2_15656 | - | chr4: 105220327-105220347 | UCUUCUGUAAUUACCGACUU | 7253 |
| 54790_2_15660 | - | chr4: 105220335-105220355 | GGACCAGUUCUUCUGUAAUU | 7254 |
| 54790_2_15664 | - | chr4: 105220353-105220373 | CGACAUUUUUAAUACAAUGG | 7255 |
| 54790_2_15667 | - | chr4: 105220377-105220397 | UUUAACAAGAUUAUUGGUUU | 7256 |
| 54790_2_15677 | - | chr4: 105220421-105220441 | AACCCUCAAAAUUUUACUUA | 7257 |
| 54790_2_15680 | - | chr4: 105220439-105220459 | GUGACUGAGUCCGAACUCAA | 7258 |
| 54790_2_15683 | - | chr4: 105220440-105220460 | UGUGACUGAGUCCGAACUCA | 7259 |
| 54790_2_15686 | - | chr4: 105220450-105220470 | ACCCUCUUCUUGUGACUGAG | 7260 |
| 54790_2_15696 | - | chr4: 105220469-105220489 | GGUCACAAAUUCAAACACGA | 7261 |
| 54790_2_15699 | - | chr4: 105220470-105220490 | CGGUCACAAAUUCAAACACG | 7262 |
| 54790_2_15703 | - | chr4: 105220494-105220514 | GAUGAAAGUUGAGGUUCCCA | 7263 |
| 54790_2_15706 | - | chr4: 105220498-105220518 | AGGGGAUGAAAGUUGAGGUU | 7264 |
| 54790_2_15707 | - | chr4: 105220499-105220519 | GAGGGGAUGAAAGUUGAGGU | 7265 |
| 54790_2_15709 | - | chr4: 105220522-105220542 | CUCCCCUCCAUAGUCCUCAC | 7266 |
| 54790_2_15711 | - | chr4: 105220529-105220549 | UCUCCCCUCCCCUCCAUAG | 7267 |
| 54790_2_15714 | - | chr4: 105220536-105220556 | AGUGCCAUCUCCCCCUCCCC | 7268 |
| 54790_2_15715 | - | chr4: 105220539-105220559 | ACGAGUGCCAUCUCCCCCUC | 7269 |
| 54790_2_15717 | - | chr4: 105220540-105220560 | CACGAGUGCCAUCUCCCCCU | 7270 |
| 54790_2_15719 | - | chr4: 105220541-105220561 | CCACGAGUGCCAUCUCCCCC | 7271 |
| 54790_2_15723 | - | chr4: 105220544-105220564 | UGACCACGAGUGCCAUCUCC | 7272 |
| 54790_2_15724 | - | chr4: 105220545-105220565 | GUGACCACGAGUGCCAUCUC | 7273 |
| 54790_2_15726 | - | chr4: 105220546-105220566 | CGUGACCACGAGUGCCAUCU | 7274 |
| 54790_2_15728 | - | chr4: 105220547-105220567 | CCGUGACCACGAGUGCCAUC | 7275 |
| 54790_2_15732 | - | chr4: 105220553-105220573 | GAGGAUCCGUGACCACGAGU | 7276 |
| 54790_2_15733 | - | chr4: 105220562-105220582 | GACGGGUUAGAGGAUCCGUG | 7277 |
| 54790_2_15735 | - | chr4: 105220568-105220588 | AGUCAGGACGGGUUAGAGGA | 7278 |
| 54790_2_15744 | - | chr4: 105220617-105220637 | GUCAGAACAAGUCCACGAAU | 7279 |
| 54790_2_15746 | - | chr4: 105220626-105220646 | UUUCAGGAGGUCAGAACAAG | 7280 |
| 54790_2_15748 | - | chr4: 105220668-105220688 | AGGUUAUCGGUCAGUUACGG | 7281 |
| 54790_2_15750 | - | chr4: 105220693-105220713 | AGCCUACGGACGGAGUGUCU | 7282 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_15751 | - | chr4: 105220694-105220714 | AAGCCUACGGACGGAGUGUC | 7283 |
| 54790_2_15754 | - | chr4: 105220712-105220732 | UACAGUUCUUUCGGUCAUAA | 7284 |
| 54790_2_15760 | - | chr4: 105220758-105220778 | ACACGUCACUCUCGGGAACA | 7285 |
| 54790_2_15763 | - | chr4: 105220784-105220804 | UCCUGUCUAGAGAGGAUAGU | 7286 |
| 54790_2_15764 | - | chr4: 105220785-105220805 | UUCCUGUCUAGAGAGGAUAG | 7287 |
| 54790_2_15766 | - | chr4: 105220804-105220824 | GAUACCACUAUCUUCUUUAU | 7288 |
| 54790_2_15771 | - | chr4: 105220821-105220841 | UCCGUUUCGACUUCAUCGAU | 7289 |
| 54790_2_15773 | - | chr4: 105220841-105220861 | CUGACACCCCACCUGAGUCG | 7290 |
| 54790_2_15774 | - | chr4: 105220851-105220871 | UCGUCUUUCUCUGACACCCC | 7291 |
| 54790_2_15776 | - | chr4: 105220854-105220874 | GGGUCGUCUUUCUCUGACAC | 7292 |
| 54790_2_15777 | - | chr4: 105220855-105220875 | GGGGUCGUCUUUCUCUGACA | 7293 |
| 54790_2_15778 | - | chr4: 105220856-105220876 | CGGGGUCGUCUUUCUCUGAC | 7294 |
| 54790_2_15783 | - | chr4: 105220881-105220901 | CUAAGAAUGACAGGUCCCGU | 7295 |
| 54790_2_15785 | - | chr4: 105220886-105220906 | AUGCUCUAAGAAUGACAGGU | 7296 |
| 54790_2_15787 | - | chr4: 105220887-105220907 | CAUGCUCUAAGAAUGACAGG | 7297 |
| 54790_2_15794 | - | chr4: 105220911-105220931 | UUGCAGAAGUUGUUUAGGCU | 7298 |
| 54790_2_15796 | - | chr4: 105220916-105220936 | AAAAAUUGCAGAAGUUGUUU | 7299 |
| 54790_2_15810 | - | chr4: 105220994-105221014 | UCCUUACUGGAACACUGUCU | 7300 |
| 54790_2_15814 | - | chr4: 105221007-105221027 | UGUGAGCUGGUUGUCCUUAC | 7301 |
| 54790_2_15818 | - | chr4: 105221020-105221040 | UAGAAUGGAUAAUUGUGAGC | 7302 |
| 54790_2_15823 | - | chr4: 105221035-105221055 | GUUGACUCCCAUUAUUAGAA | 7303 |
| 54790_2_15841 | - | chr4: 105221162-105221182 | UGGUUUGAUCACACAUGACU | 7304 |
| 54790_2_15855 | - | chr4: 105221201-105221221 | UUUGAAUUUGGGCUUAAAGG | 7305 |
| 54790_2_15857 | - | chr4: 105221212-105221232 | UGGAAUUGUUUUUUGAAUUU | 7306 |
| 54790_2_15859 | - | chr4: 105221213-105221233 | CUGGAAUUGUUUUUUGAAUU | 7307 |
| 54790_2_15865 | - | chr4: 105221232-105221252 | UAGGUGAAUAGACAAUAUCC | 7308 |
| 54790_2_15877 | - | chr4: 105221289-105221309 | UUAACCAACCAGUUUCUUAU | 7309 |
| 54790_2_15886 | - | chr4: 105221360-105221380 | AGAGAUCUGCAUUUAAGAUC | 7310 |
| 54790_2_15893 | - | chr4: 105221400-105221420 | GGAAUGCCAUUGAAGAUGAG | 7311 |
| 54790_2_15902 | - | chr4: 105221421-105221441 | UUUGAGGGAGAAAAAUUCAG | 7312 |
| 54790_2_15909 | - | chr4: 105221436-105221456 | AUAAUAUAUAGAUUAUUUGA | 7313 |
| 54790_2_15911 | - | chr4: 105221437-105221457 | AAUAAUAUAUAGAUUAUUUG | 7314 |
| 54790_2_15920 | - | chr4: 105221477-105221497 | UUAAAAUCUGUUUCUUAAAA | 7315 |
| 54790_2_15930 | - | chr4: 105221526-105221546 | GUUUUUCAUAAUCCUCAGUA | 7316 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_15931 | − | chr4: 105221527-105221547 | GGUUUUUCAUAAUCCUCAGU | 7317 |
| 54790_2_15936 | − | chr4: 105221548-105221568 | UGUGCAUAGGAGGUUUUGUC | 7318 |
| 54790_2_15937 | − | chr4: 105221558-105221578 | AUCUAAAUCAUGUGCAUAGG | 7319 |
| 54790_2_15938 | − | chr4: 105221561-105221581 | CUAAUCUAAAUCAUGUGCAU | 7320 |
| 54790_2_15945 | − | chr4: 105221624-105221644 | AUUUCUGAAAAGGUGUUAAU | 7321 |
| 54790_2_15948 | − | chr4: 105221634-105221654 | AAGUUCCUCCAUUUCUGAAA | 7322 |
| 54790_2_15953 | − | chr4: 105221694-105221714 | UUUUUAUUUUUUUUCUUUU | 7323 |
| 54790_2_15959 | − | chr4: 105221794-105221814 | CACCCACGUCGCGUGGUCGU | 7324 |
| 54790_2_15960 | − | chr4: 105221812-105221832 | UACGAUCUACUGCUCAAUCA | 7325 |
| 54790_2_15961 | − | chr4: 105221813-105221833 | UUACGAUCUACUGCUCAAUC | 7326 |
| 54790_2_15965 | − | chr4: 105221846-105221866 | CUGCCCCUCCCUAUCGUAA | 7327 |
| 54790_2_15967 | − | chr4: 105221847-105221867 | CCUGCCCCUCCCUAUCGUA | 7328 |
| 54790_2_15971 | − | chr4: 105221857-105221877 | ACCCCACCCCCUGCCCCU | 7329 |
| 54790_2_15973 | − | chr4: 105221858-105221878 | CACCCACCCCCUGCCCCC | 7330 |
| 54790_2_15976 | − | chr4: 105221861-105221881 | CAACACCCCACCCCCUGCC | 7331 |
| 54790_2_15977 | − | chr4: 105221862-105221882 | ACAACACCCCACCCCCUGC | 7332 |
| 54790_2_15979 | − | chr4: 105221863-105221883 | GACAACACCCCACCCCCUG | 7333 |
| 54790_2_15982 | − | chr4: 105221864-105221884 | UGACAACACCCCACCCCCU | 7334 |
| 54790_2_15984 | − | chr4: 105221868-105221888 | CCCCUGACAACACCCCACCC | 7335 |
| 54790_2_15985 | − | chr4: 105221869-105221889 | ACCCCUGACAACACCCCACC | 7336 |
| 54790_2_15988 | − | chr4: 105221870-105221890 | GACCCCUGACAACACCCCAC | 7337 |
| 54790_2_15990 | − | chr4: 105221871-105221891 | AGACCCCUGACAACACCCCA | 7338 |
| 54790_2_15991 | − | chr4: 105221872-105221892 | GAGACCCCUGACAACACCCC | 7339 |
| 54790_2_15994 | − | chr4: 105221875-105221895 | UGUGAGACCCCUGACAACAC | 7340 |
| 54790_2_15995 | − | chr4: 105221876-105221896 | GUGUGAGACCCCUGACAACA | 7341 |
| 54790_2_15997 | − | chr4: 105221877-105221897 | AGUGUGAGACCCCUGACAAC | 7342 |
| 54790_2_15999 | − | chr4: 105221887-105221907 | UUCCCCUUGUAGUGUGAGAC | 7343 |
| 54790_2_16000 | − | chr4: 105221888-105221908 | CUUCCCCUUGUAGUGUGAGA | 7344 |
| 54790_2_16003 | − | chr4: 105221889-105221909 | CCUUCCCCUUGUAGUGUGAG | 7345 |
| 54790_2_16005 | − | chr4: 105221904-105221924 | CUUGUGUACCUGUGUCCUUC | 7346 |
| 54790_2_16007 | − | chr4: 105221905-105221925 | UCUUGUGUACCUGUGUCCUU | 7347 |
| 54790_2_16010 | − | chr4: 105221906-105221926 | CUCUUGUGUACCUGUGUCCU | 7348 |
| 54790_2_16014 | − | chr4: 105221910-105221930 | GUUACUCUUGUGUACCUGUG | 7349 |
| 54790_2_16016 | − | chr4: 105221917-105221937 | UUAACUUGUUACUCUUGUGU | 7350 |
| 54790_2_16023 | − | chr4: 105221940-105221960 | CGUAUAAGAGUGAGUAUCCA | 7351 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_16025 | - | chr4: 105221941-105221961 | GCGUAUAAGAGUGAGUAUCC | 7352 |
| 54790_2_16028 | - | chr4: 105221944-105221964 | GUGGCGUAUAAGAGUGAGUA | 7353 |
| 54790_2_16035 | - | chr4: 105222011-105222031 | ACAUCCCUGUACCUACUUUA | 7354 |
| 54790_2_16040 | - | chr4: 105222021-105222041 | AGUACAGGAAACAUCCCUGU | 7355 |
| 54790_2_16042 | - | chr4: 105222027-105222047 | UACUCAAGUACAGGAAACAU | 7356 |
| 54790_2_16044 | - | chr4: 105222028-105222048 | CUACUCAAGUACAGGAAACA | 7357 |
| 54790_2_16048 | - | chr4: 105222074-105222094 | UUACACCGUGUAUAUGUGGU | 7358 |
| 54790_2_16051 | - | chr4: 105222090-105222110 | AUCUGACCUAAUUCUUUUAC | 7359 |
| 54790_2_16053 | - | chr4: 105222105-105222125 | UUACAGGUUGUUACUAUCUG | 7360 |
| 54790_2_16058 | - | chr4: 105222138-105222158 | AUAAGUGUUAUCGUUUCUGA | 7361 |
| 54790_2_16063 | - | chr4: 105222164-105222184 | UACGUGUGCAUACAAAUAAC | 7362 |
| 54790_2_16067 | - | chr4: 105222215-105222235 | UAAUGACCCAAAUAUGGGUU | 7363 |
| 54790_2_16071 | - | chr4: 105222229-105222249 | CUGACUCGGUAGGGUAAUGA | 7364 |
| 54790_2_16072 | - | chr4: 105222230-105222250 | ACUGACUCGGUAGGGUAAUG | 7365 |
| 54790_2_16079 | - | chr4: 105222275-105222295 | CAGUCACACCGCUAAGGAGU | 7366 |
| 54790_2_16080 | - | chr4: 105222276-105222296 | UCAGUCACACCGCUAAGGAG | 7367 |
| 54790_2_16085 | - | chr4: 105222288-105222308 | UUGGUAACACCUUCAGUCAC | 7368 |
| 54790_2_16087 | - | chr4: 105222300-105222320 | CAUUUGAUCAAGUUGGUAAC | 7369 |
| 54790_2_16093 | - | chr4: 105222326-105222346 | UUGUGAAAAUGCGACAACCA | 7370 |
| 54790_2_16095 | - | chr4: 105222327-105222347 | CUUGUGAAAAUGCGACAACC | 7371 |
| 54790_2_16097 | - | chr4: 105222330-105222350 | AUCCUUGUGAAAAUGCGACA | 7372 |
| 54790_2_16099 | - | chr4: 105222349-105222369 | ACCUCUCCUACACCUCUUUA | 7373 |
| 54790_2_16103 | - | chr4: 105222358-105222378 | UUGUUCACGACCUCUCCUAC | 7374 |
| 54790_2_16105 | - | chr4: 105222364-105222384 | CCUGUGUUGUUCACGACCUC | 7375 |
| 54790_2_16108 | - | chr4: 105222369-105222389 | UCACUCCUGUGUUGUUCACG | 7376 |
| 54790_2_16113 | - | chr4: 105222385-105222405 | UACCGCUAGUAAUUUUUCAC | 7377 |
| 54790_2_16116 | - | chr4: 105222404-105222424 | AGUAGAGUGUGGUCAAUCUU | 7378 |
| 54790_2_16122 | - | chr4: 105222464-105222484 | CUUUUUUACGAGUGGUAGUG | 7379 |
| 54790_2_16131 | - | chr4: 105222545-105222565 | UUUGUUAGGGUAGUUUUUCA | 7380 |
| 54790_2_16132 | - | chr4: 105222546-105222566 | GUUUGUUAGGGUAGUUUUUC | 7381 |
| 54790_2_16143 | - | chr4: 105222618-105222638 | GUUGGAUGAGUAGACUGUUU | 7382 |
| 54790_2_16144 | - | chr4: 105222619-105222639 | CGUUGGAUGAGUAGACUGUU | 7383 |
| 54790_2_16147 | - | chr4: 105222654-105222674 | ACUUGUCCGUUGGGUGUUUU | 7384 |
| 54790_2_16148 | - | chr4: 105222669-105222689 | CUUGAUGGUAGUCUCACUUG | 7385 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_16153 | - | chr4: 105222691-105222711 | UUCUCGAAGACGUGUCGUUU | 7386 |
| 54790_2_16158 | - | chr4: 105222728-105222748 | UUUUCGGUUUUAACUGUUUA | 7387 |
| 54790_2_16160 | - | chr4: 105222729-105222749 | GUUUUCGGUUUUAACUGUUU | 7388 |
| 54790_2_16163 | - | chr4: 105222755-105222775 | CAGAUUUGUGGUUUUCGUU | 7389 |
| 54790_2_16165 | - | chr4: 105222785-105222805 | AGUGCUGUAUCCGUGCCCGU | 7390 |
| 54790_2_16167 | - | chr4: 105222790-105222810 | UGGUAAGUGCUGUAUCCGUG | 7391 |
| 54790_2_16168 | - | chr4: 105222791-105222811 | GUGGUAAGUGCUGUAUCCGU | 7392 |
| 54790_2_16170 | - | chr4: 105222796-105222816 | CCGUUGUGGUAAGUGCUGUA | 7393 |
| 54790_2_16171 | - | chr4: 105222817-105222837 | UUUUGGGAUCUUCUUUUGGA | 7394 |
| 54790_2_16180 | - | chr4: 105222873-105222893 | UAUGUUUUUAGUUAAGUUCU | 7395 |
| 54790_2_16184 | - | chr4: 105222914-105222934 | GUAUACACCUUUCGACUUUG | 7396 |
| 54790_2_16188 | - | chr4: 105222928-105222948 | CUUUUGACCGAUCGGUAUAC | 7397 |
| 54790_2_16192 | - | chr4: 105222942-105222962 | UAUUUACCACGACCCUUUUG | 7398 |
| 54790_2_16195 | - | chr4: 105222950-105222970 | GGAUAAAUUAUUUACCACGA | 7399 |
| 54790_2_16197 | - | chr4: 105222951-105222971 | GGGAUAAAUUAUUUACCACG | 7400 |
| 54790_2_16199 | - | chr4: 105222957-105222977 | UCCUAAGGGAUAAAUUAUUU | 7401 |
| 54790_2_16200 | - | chr4: 105222977-105222997 | CUUUUUGUUCUUUACCCCUU | 7402 |
| 54790_2_16202 | - | chr4: 105222982-105223002 | GGACUCUUUUUGUUCUUUAC | 7403 |
| 54790_2_16204 | - | chr4: 105222983-105223003 | UGGACUCUUUUUGUUCUUUA | 7404 |
| 54790_2_16207 | - | chr4: 105222984-105223004 | UUGGACUCUUUUUGUUCUUU | 7405 |
| 54790_2_16214 | - | chr4: 105223038-105223058 | CUUGUCUCGGGAGUCUUUAU | 7406 |
| 54790_2_16220 | - | chr4: 105223065-105223085 | UUUUGUCUCUAUAUCUAGUU | 7407 |
| 54790_2_16223 | - | chr4: 105223092-105223112 | GCUGAGCAUGGUCCACCACG | 7408 |
| 54790_2_16224 | - | chr4: 105223098-105223118 | AGGACUGCUGAGCAUGGUCC | 7409 |
| 54790_2_16226 | - | chr4: 105223104-105223124 | UGAAAAGGACUGCUGAGCA | 7410 |
| 54790_2_16229 | - | chr4: 105223118-105223138 | UACUUCACAUCUCUUGAAAA | 7411 |
| 54790_2_16251 | - | chr4: 105223210-105223230 | AAGGUGAAUUAAUAUUUUUA | 7412 |
| 54790_2_16254 | - | chr4: 105223229-105223249 | GAUUAAGUAUGGAGAAUAUA | 7413 |
| 54790_2_16259 | - | chr4: 105223240-105223260 | UUUCCUAUAUGGAUUAAGUA | 7414 |
| 54790_2_16261 | - | chr4: 105223251-105223271 | GGAAUAUAAUGUUUCCUAUA | 7415 |
| 54790_2_16264 | - | chr4: 105223272-105223292 | AGCAAGCCACAUGUUAGACC | 7416 |
| 54790_2_16296 | - | chr4: 105223424-105223444 | UAAAGAAAGUGUUUUUUAUA | 7417 |
| 54790_2_16298 | - | chr4: 105223425-105223445 | GUAAAGAAAGUGUUUUUUAU | 7418 |
| 54790_2_16302 | - | chr4: 105223447-105223467 | GUUGCCAAGUCUCACUCUUG | 7419 |
| 54790_2_16308 | - | chr4: 105223469-105223489 | AUUACUAUGUAAUAUUGGUA | 7420 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_16310 | - | chr4: 105223474-105223494 | UUAAAAUUACUAUGUAAUAU | 7421 |
| 54790_2_16332 | - | chr4: 105223612-105223632 | UCAAGAUGUGUGCAAUGCUA | 7422 |
| 54790_2_16341 | - | chr4: 105223664-105223684 | UGGAUUCUUCCUAUCAACAU | 7423 |
| 54790_2_16343 | - | chr4: 105223665-105223685 | UUGGAUUCUUCCUAUCAACA | 7424 |
| 54790_2_16347 | - | chr4: 105223684-105223704 | AUUAUUCUCCAAAACUAUUU | 7425 |
| 54790_2_16349 | - | chr4: 105223708-105223728 | GGCCACACCUCCUGCAUAGA | 7426 |
| 54790_2_16350 | - | chr4: 105223729-105223749 | CUGAGUAAAGAUGAUGUAUA | 7427 |
| 54790_2_16361 | - | chr4: 105223780-105223800 | UAUUAGUAAUUCAGAGUGUU | 7428 |
| 54790_2_16366 | - | chr4: 105223812-105223832 | UCUCUGUCACUUCCACUGAC | 7429 |
| 54790_2_16370 | - | chr4: 105223849-105223869 | UGUUUCAGGAUCAAACUUAC | 7430 |
| 54790_2_16372 | - | chr4: 105223850-105223870 | GUGUUUCAGGAUCAAACUUA | 7431 |
| 54790_2_16375 | - | chr4: 105223863-105223883 | UGCUAAAGGCACUGUGUUUC | 7432 |
| 54790_2_16378 | - | chr4: 105223877-105223897 | AUGGGAACUAUAUCUGCUAA | 7433 |
| 54790_2_16381 | - | chr4: 105223895-105223915 | ACUUCAGACUGCUUGCUUAU | 7434 |
| 54790_2_16383 | - | chr4: 105223896-105223916 | UACUUCAGACUGCUUGCUUA | 7435 |
| 54790_2_16392 | - | chr4: 105223923-105223943 | UUAUACAUUCAGAUUACUGA | 7436 |
| 54790_2_16393 | - | chr4: 105223924-105223944 | UUUAUACAUUCAGAUUACUG | 7437 |
| 54790_2_16411 | - | chr4: 105224037-105224057 | UGUAUAGUUGCCAUACUAUA | 7438 |
| 54790_2_16424 | - | chr4: 105224083-105224103 | UAUGUCAGCUUUUUUUCAAG | 7439 |
| 54790_2_16426 | - | chr4: 105224084-105224104 | UUAUGUCAGCUUUUUUUCAA | 7440 |
| 54790_2_16427 | - | chr4: 105224085-105224105 | UUUAUGUCAGCUUUUUUUCA | 7441 |
| 54790_2_16445 | - | chr4: 105224151-105224171 | AAAUAACGAAAACUAGGUGG | 7442 |
| 54790_2_16447 | - | chr4: 105224152-105224172 | CAAAUAACGAAAACUAGGUG | 7443 |
| 54790_2_16450 | - | chr4: 105224153-105224173 | CCAAAUAACGAAAACUAGGU | 7444 |
| 54790_2_16452 | - | chr4: 105224154-105224174 | ACCAAAUAACGAAAACUAGG | 7445 |
| 54790_2_16457 | - | chr4: 105224157-105224177 | AAAACCAAAUAACGAAAACU | 7446 |
| 54790_2_16467 | - | chr4: 105224174-105224194 | AAACAAAAACAAAAUAAAAA | 7447 |
| 54790_2_16470 | - | chr4: 105224203-105224223 | UAUGCUCAAAUUUGUGAAGA | 7448 |
| 54790_2_16471 | - | chr4: 105224204-105224224 | AUAUGCUCAAAUUUGUGAAG | 7449 |
| 54790_2_16479 | - | chr4: 105224258-105224278 | CUCUUCGGAUUACUCAAGAA | 7450 |
| 54790_2_16484 | - | chr4: 105224273-105224293 | CUCCAUACCAUUUGACUCUU | 7451 |
| 54790_2_16490 | - | chr4: 105224308-105224328 | CAUUUCACCAAUAUGCAUUU | 7452 |
| 54790_2_16493 | - | chr4: 105224341-105224361 | AUAGCACAUUAGUGUGCAAA | 7453 |
| 54790_2_16500 | - | chr4: 105224398-105224418 | UAAUCCAUCAUAAUUAUGAC | 7454 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_16502 | - | chr4: 105224436-105224456 | GUGAAACAAUUACUGCAUCU | 7455 |
| 54790_2_16510 | - | chr4: 105224467-105224487 | AUUAUAAAUUCUAGUCGCAU | 7456 |
| 54790_2_16530 | - | chr4: 105224551-105224571 | UGGUUUCCUAAGACCAAAAC | 7457 |
| 54790_2_16534 | - | chr4: 105224571-105224591 | UUGACUACUAGCUAACAUUU | 7458 |
| 54790_2_16538 | - | chr4: 105224598-105224618 | UUUAUCUCAGUUGAAAAUAC | 7459 |
| 54790_2_16546 | - | chr4: 105224640-105224660 | ACCUUUAUCUUCUAUGUCAG | 7460 |
| 54790_2_16549 | - | chr4: 105224683-105224703 | UCUCUCUCUCUCUCUCUCUC | 7461 |
| 54790_2_16578 | - | chr4: 105224784-105224804 | AGAAACAUGCAACAAUUAUA | 7462 |
| 54790_2_16584 | - | chr4: 105224822-105224842 | CUAAAGGUCAAAUUAUAACC | 7463 |
| 54790_2_16591 | - | chr4: 105224838-105224858 | AUUUUUUCAGAAAUUCUAA | 7464 |
| 54790_2_16602 | - | chr4: 105224899-105224919 | UUGUAAUGCAUGGGCUUCCA | 7465 |
| 54790_2_16605 | - | chr4: 105224908-105224928 | UAAUGUUCUUUGUAAUGCAU | 7466 |
| 54790_2_16606 | - | chr4: 105224909-105224929 | CUAAUGUUCUUUGUAAUGCA | 7467 |
| 54790_2_16621 | - | chr4: 105224989-105225009 | AAUUAAAUUACAAUUUUAAA | 7468 |
| 54790_2_16637 | - | chr4: 105225049-105225069 | GUAUUUUUUAAGUCUAAAA | 7469 |
| 54790_2_16639 | - | chr4: 105225071-105225091 | UGCUAAAGUUAUAAGAACUU | 7470 |
| 54790_2_16653 | - | chr4: 105225134-105225154 | UCUUCAUAGGUUUACCAAAA | 7471 |
| 54790_2_16654 | - | chr4: 105225147-105225167 | GCAGCAUGAGAUUUCUUCAU | 7472 |
| 54790_2_16661 | - | chr4: 105225171-105225191 | UGUGUGGAUUUUUUACUAUA | 7473 |
| 54790_2_16673 | - | chr4: 105225283-105225303 | CCUUAACCUAGGAAAAUACA | 7474 |
| 54790_2_16677 | - | chr4: 105225294-105225314 | GAUUAUUGAACCCUUAACCU | 7475 |
| 54790_2_16686 | - | chr4: 105225341-105225361 | UUUCAAAAAACUAGUGAGA | 7476 |
| 54790_2_16695 | - | chr4: 105225427-105225447 | GGAGGAGAACCAGUGACCUA | 7477 |
| 54790_2_16702 | - | chr4: 105225445-105225465 | ACCUACAACAUUGCUGAGGG | 7478 |
| 54790_2_16704 | - | chr4: 105225448-105225468 | GCUACCUACAACAUUGCUGA | 7479 |
| 54790_2_16707 | - | chr4: 105225449-105225469 | AGCUACCUACAACAUUGCUG | 7480 |
| 54790_2_16712 | - | chr4: 105225493-105225513 | AACACUAAGUCAAAGGUAAA | 7481 |
| 54790_2_16713 | - | chr4: 105225500-105225520 | AGAGAAAACACUAAGUCAA | 7482 |
| 54790_2_16726 | - | chr4: 105225584-105225604 | GCUCUUGUCCCUGUCAAUGU | 7483 |
| 54790_2_16727 | - | chr4: 105225585-105225605 | AGCUCUUGUCCCUGUCAAUG | 7484 |
| 54790_2_16731 | - | chr4: 105225616-105225636 | GCCAUGGGAAUACAGGAGAG | 7485 |
| 54790_2_16732 | - | chr4: 105225617-105225637 | UGCCAUGGGAAUACAGGAGA | 7486 |
| 54790_2_16735 | - | chr4: 105225618-105225638 | GUGCCAUGGGAAUACAGGAG | 7487 |
| 54790_2_16739 | - | chr4: 105225623-105225643 | CUGAAGUGCCAUGGGAAUAC | 7488 |
| 54790_2_16741 | - | chr4: 105225631-105225651 | UGAGACUACUGAAGUGCCAU | 7489 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_16743 | - | chr4: 105225632-105225652 | AUGAGACUACUGAAGUGCCA | 7490 |
| 54790_2_16750 | - | chr4: 105225657-105225677 | CCUGAACUGUGGUUAUGUUG | 7491 |
| 54790_2_16752 | - | chr4: 105225668-105225688 | UCCUCUACUGCCCUGAACUG | 7492 |
| 54790_2_16755 | - | chr4: 105225713-105225733 | UCAGUGCAGUUGCCAUGGCA | 7493 |
| 54790_2_16758 | - | chr4: 105225718-105225738 | CUCACUCAGUGCAGUUGCCA | 7494 |
| 54790_2_16773 | - | chr4: 105225797-105225817 | GAUAAUGUCACUCAGAGAAU | 7495 |
| 54790_2_16786 | - | chr4: 105225840-105225860 | AUUUUUCUCUAGAAUAUUUG | 7496 |
| 54790_2_16794 | - | chr4: 105225873-105225893 | CCAGAUUAUCUUUGCAAUGC | 7497 |
| 54790_2_16809 | - | chr4: 105225944-105225964 | AAACGUAAACUUUUAGGACA | 7498 |
| 54790_2_16811 | - | chr4: 105225950-105225970 | AAAAGAAAACGUAAACUUUU | 7499 |
| 54790_2_16821 | - | chr4: 105225982-105226002 | AUCAUUUCUUUAUGUGGUUU | 7500 |
| 54790_2_16822 | - | chr4: 105225983-105226003 | AAUCAUUUCUUUAUGUGGUU | 7501 |
| 54790_2_16827 | - | chr4: 105225988-105226008 | CAACAAAUCAUUUCUUUAUG | 7502 |
| 54790_2_16835 | - | chr4: 105226030-105226050 | GUAAUUAUUAAGAUGAUUAA | 7503 |
| 54790_2_16836 | - | chr4: 105226031-105226051 | UGUAAUUAUUAAGAUGAUUA | 7504 |
| 54790_2_16841 | - | chr4: 105226056-105226076 | UAUUUUGGCUACGUAUCUGU | 7505 |
| 54790_2_16845 | - | chr4: 105226071-105226091 | GGAUUAAAAACAAGUAUUU | 7506 |
| 54790_2_16856 | - | chr4: 105226092-105226112 | AAGCUUUUUUUUAAGGUUU | 7507 |
| 54790_2_16858 | - | chr4: 105226098-105226118 | CAAUUUAAGCUUUUUUUUA | 7508 |
| 54790_2_16869 | - | chr4: 105226155-105226175 | AAAGACAAGUGCAUAAUUAA | 7509 |
| 54790_2_16872 | - | chr4: 105226211-105226231 | CCCUGAUCCGGAUUCGUGAG | 7510 |
| 54790_2_16873 | - | chr4: 105226225-105226245 | GUCUCCGAGGGUGUCCCUGA | 7511 |
| 54790_2_16874 | - | chr4: 105226231-105226251 | GGUUUUGUCUCCGAGGGUGU | 7512 |
| 54790_2_16876 | - | chr4: 105226232-105226252 | UGGUUUUGUCUCCGAGGGUG | 7513 |
| 54790_2_16878 | - | chr4: 105226242-105226262 | UACCACUUCGUGGUUUUGUC | 7514 |
| 54790_2_16881 | - | chr4: 105226261-105226281 | UUUUGACUCCUUAGACGGGU | 7515 |
| 54790_2_16887 | - | chr4: 105226274-105226294 | AAAUUUCUACACUUUUGAC | 7516 |
| 54790_2_16895 | - | chr4: 105226316-105226336 | AACAUUUCAGAGUAGCAGCU | 7517 |
| 54790_2_16898 | - | chr4: 105226354-105226374 | UAAGUAAUAAUAUGUAACAA | 7518 |
| 54790_2_16900 | - | chr4: 105226390-105226410 | GUCACGGCUAAGAAAUUCUA | 7519 |
| 54790_2_16902 | - | chr4: 105226406-105226426 | UUGUUGGUUUGGUAUAGUCA | 7520 |
| 54790_2_16909 | - | chr4: 105226433-105226453 | AUAAAGUUGUCCUCUAAAUC | 7521 |
| 54790_2_16912 | - | chr4: 105226444-105226464 | UGACCCCUAAUAUAAAGUUG | 7522 |
| 54790_2_16915 | - | chr4: 105226460-105226480 | CCGGGGGUGGAGGUUGUGAC | 7523 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_16917 | − | chr4: 105226461-105226481 | UCCGGGGUGGAGGUUGUGA | 7524 |
| 54790_2_16919 | − | chr4: 105226462-105226482 | GUCCGGGGUGGAGGUUGUG | 7525 |
| 54790_2_16922 | − | chr4: 105226481-105226501 | AUUAGGUUUGUGAAGGGUGG | 7526 |
| 54790_2_16923 | − | chr4: 105226515-105226535 | UCCUGUCGUGGUACGGUACU | 7527 |
| 54790_2_16925 | − | chr4: 105226516-105226536 | CUCCUGUCGUGGUACGGUAC | 7528 |
| 54790_2_16929 | − | chr4: 105226535-105226555 | GAACUCUUGAGUGAUAGUCC | 7529 |
| 54790_2_16932 | − | chr4: 105226538-105226558 | AGAGAACUCUUGAGUGAUAG | 7530 |
| 54790_2_16938 | − | chr4: 105226585-105226605 | CUCCCUUCCUCUGUCCCUCC | 7531 |
| 54790_2_16939 | − | chr4: 105226586-105226606 | CCUCCCUUCCUCUGUCCCUC | 7532 |
| 54790_2_16941 | − | chr4: 105226587-105226607 | CCCUCCCUUCCUCUGUCCCU | 7533 |
| 54790_2_16944 | − | chr4: 105226588-105226608 | UCCCUCCCUUCCUCUGUCCC | 7534 |
| 54790_2_16946 | − | chr4: 105226591-105226611 | CUCUCCCUCCCUUCCUCUGU | 7535 |
| 54790_2_16949 | − | chr4: 105226592-105226612 | UCUCUCCCUCCCUUCCUCUG | 7536 |
| 54790_2_16951 | − | chr4: 105226599-105226619 | CCCUUCCUCUCUCCCUCCCU | 7537 |
| 54790_2_16955 | − | chr4: 105226603-105226623 | CCCUCCCUUCCUCUCUCCCU | 7538 |
| 54790_2_16956 | − | chr4: 105226604-105226624 | UCCCUCCCUUCCUCUCUCCC | 7539 |
| 54790_2_16960 | − | chr4: 105226607-105226627 | GUCUCCCUCCCUUCCUCUCU | 7540 |
| 54790_2_16962 | − | chr4: 105226608-105226628 | UGUCUCCCUCCCUUCCUCUC | 7541 |
| 54790_2_16966 | − | chr4: 105226615-105226635 | CCCUUCCUGUCUCCCUCCCU | 7542 |
| 54790_2_16970 | − | chr4: 105226619-105226639 | CCCUCCCUUCCUGUCUCCCU | 7543 |
| 54790_2_16971 | − | chr4: 105226620-105226640 | UCCCUCCCUUCCUGUCUCCC | 7544 |
| 54790_2_16974 | − | chr4: 105226623-105226643 | UUCUCCCUCCCUUCCUGUCU | 7545 |
| 54790_2_16977 | − | chr4: 105226624-105226644 | CUUCUCCCUCCCUUCCUGUC | 7546 |
| 54790_2_16980 | − | chr4: 105226631-105226651 | CUCCCUCCUUCUCCCUCCCU | 7547 |
| 54790_2_16982 | − | chr4: 105226635-105226655 | CCUUCUCCCUCCUUCUCCCU | 7548 |
| 54790_2_16985 | − | chr4: 105226636-105226656 | UCCUUCUCCCUCCUUCUCCC | 7549 |
| 54790_2_16987 | − | chr4: 105226639-105226659 | CUCUCCUUCUCCCUCCUUCU | 7550 |
| 54790_2_16989 | − | chr4: 105226640-105226660 | UCUCUCCUUCUCCCUCCUUC | 7551 |
| 54790_2_16994 | − | chr4: 105226646-105226666 | UUUUUCUCUCCUUCUCCCUCCC | 7552 |
| 54790_2_16996 | − | chr4: 105226649-105226669 | CUCUUUUCUCUCUCCUUCU | 7553 |
| 54790_2_16998 | − | chr4: 105226650-105226670 | CCUCUUUUCUCUCUCCUUC | 7554 |
| 54790_2_17003 | − | chr4: 105226656-105226676 | CCUCACCCUCUUUUCUCUC | 7555 |
| 54790_2_17010 | − | chr4: 105226671-105226691 | CGUAGAUUGUACCGACCUCA | 7556 |
| 54790_2_17012 | − | chr4: 105226672-105226692 | CCGUAGAUUGUACCGACCUC | 7557 |
| 54790_2_17015 | − | chr4: 105226677-105226697 | CUCGUCCGUAGAUUGUACCG | 7558 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_17017 | - | chr4: 105226681-105226701 | UCCCCUCGUCCGUAGAUUGU | 7559 |
| 54790_2_17018 | - | chr4: 105226693-105226713 | CGUCUUUCGUUUCCCCUCG | 7560 |
| 54790_2_17021 | - | chr4: 105226699-105226719 | UAGUACCGUCUUUCGUUUUC | 7561 |
| 54790_2_17023 | - | chr4: 105226700-105226720 | UUAGUACCGUCUUUCGUUUU | 7562 |
| 54790_2_17024 | - | chr4: 105226701-105226721 | AUUAGUACCGUCUUUCGUUU | 7563 |
| 54790_2_17029 | - | chr4: 105226715-105226735 | GGAAUGUUUGAAUAUUAGU | 7564 |
| 54790_2_17032 | - | chr4: 105226738-105226758 | UGACCGUAGACGAAACCCAC | 7565 |
| 54790_2_17034 | - | chr4: 105226743-105226763 | UUUCGUGACCGUAGACGAAA | 7566 |
| 54790_2_17035 | - | chr4: 105226744-105226764 | GUUUCGUGACCGUAGACGAA | 7567 |
| 54790_2_17037 | - | chr4: 105226756-105226776 | GACAUAUCCUCCGUUUCGUG | 7568 |
| 54790_2_17039 | - | chr4: 105226767-105226787 | CCAAGACGUCCGACAUAUCC | 7569 |
| 54790_2_17042 | - | chr4: 105226770-105226790 | GUACCAAGACGUCCGACAUA | 7570 |
| 54790_2_17046 | - | chr4: 105226779-105226799 | AUUAACCGAGUACCAAGACG | 7571 |
| 54790_2_17047 | - | chr4: 105226788-105226808 | UUUAUCCAAAUUAACCGAGU | 7572 |
| 54790_2_17050 | - | chr4: 105226795-105226815 | AUAUUCUUUUAUCCAAAUUA | 7573 |
| 54790_2_17051 | - | chr4: 105226804-105226824 | ACCCAUUAAAUAUUCUUUUA | 7574 |
| 54790_2_17054 | - | chr4: 105226823-105226843 | GAUAUUUCUUUAUCGACAGA | 7575 |
| 54790_2_17055 | - | chr4: 105226824-105226844 | CGAUAUUUCUUUAUCGACAG | 7576 |
| 54790_2_17070 | - | chr4: 105226860-105226880 | AACCUUUGAAAGGAUACAA | 7577 |
| 54790_2_17071 | - | chr4: 105226869-105226889 | UAGCAUUUUAACCUUUUGAA | 7578 |
| 54790_2_17076 | - | chr4: 105226902-105226922 | GGACAAAGAGAUCUUGCUUC | 7579 |
| 54790_2_17087 | - | chr4: 105226923-105226943 | CAUCUUUAUUUCCAGAAUUC | 7580 |
| 54790_2_17091 | - | chr4: 105226946-105226966 | AAAUACAUGCCAUAUUAUUU | 7581 |
| 54790_2_17113 | - | chr4: 105227057-105227077 | GUGUUACACGAGAACUCUUG | 7582 |
| 54790_2_17122 | - | chr4: 105227123-105227143 | AUGCUCUUAUGGGUUAUAGC | 7583 |
| 54790_2_17124 | - | chr4: 105227133-105227153 | UCCUCAGGAGAUGCUCUUAU | 7584 |
| 54790_2_17125 | - | chr4: 105227134-105227154 | UUCCUCAGGAGAUGCUCUUA | 7585 |
| 54790_2_17132 | - | chr4: 105227148-105227168 | CAGUUUUAACAUAUUCCUC | 7586 |
| 54790_2_17149 | - | chr4: 105227231-105227251 | AGUGACUAAUUGUUUACCCA | 7587 |
| 54790_2_17151 | - | chr4: 105227232-105227252 | GAGUGACUAAUUGUUUACCC | 7588 |
| 54790_2_17156 | - | chr4: 105227254-105227274 | GAAGAACCUUUGGGAAACC | 7589 |
| 54790_2_17158 | - | chr4: 105227263-105227283 | ACAGAGACAGAAGAACCUUU | 7590 |
| 54790_2_17160 | - | chr4: 105227264-105227284 | AACAGAGACAGAAGAACCUU | 7591 |
| 54790_2_17181 | - | chr4: 105227307-105227327 | CUUUUUUGGGGUUGUUAAAC | 7592 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_17183 | - | chr4: 105227319-105227339 | CAAAAUUAAGGCCUUUUUUG | 7593 |
| 54790_2_17184 | - | chr4: 105227320-105227340 | UCAAAAUUAAGGCCUUUUUU | 7594 |
| 54790_2_17185 | - | chr4: 105227321-105227341 | AUCAAAAUUAAGGCCUUUUU | 7595 |
| 54790_2_17188 | - | chr4: 105227331-105227351 | AUGCUGGCCAAUCAAAAUUA | 7596 |
| 54790_2_17191 | - | chr4: 105227347-105227367 | UGUCUUUCCUAAGAGGAUGC | 7597 |
| 54790_2_17192 | - | chr4: 105227354-105227374 | AUGGCAAUGUCUUUCCUAAG | 7598 |
| 54790_2_17197 | - | chr4: 105227373-105227393 | GAAGCAACUUUACAAGAGGA | 7599 |
| 54790_2_17199 | - | chr4: 105227377-105227397 | AUGAGAAGCAACUUUACAAG | 7600 |
| 54790_2_17211 | - | chr4: 105227419-105227439 | UAUAAAAAUCAUUCCCUAGA | 7601 |
| 54790_2_17221 | - | chr4: 105227498-105227518 | UUCAAACACCUUGCUAUUGA | 7602 |
| 54790_2_17226 | - | chr4: 105227561-105227581 | CAGAGAACACAAAAUUAAUA | 7603 |
| 54790_2_17275 | - | chr4: 105227738-105227758 | AUAAAUAUAAAUUUUUGCUA | 7604 |
| 54790_2_17326 | - | chr4: 105227968-105227988 | UUCAUGCUGUAGUUUUUAUG | 7605 |
| 54790_2_17327 | - | chr4: 105227969-105227989 | UUUCAUGCUGUAGUUUUUAU | 7606 |
| 54790_2_17328 | - | chr4: 105227970-105227990 | CUUUCAUGCUGUAGUUUUUA | 7607 |
| 54790_2_17344 | - | chr4: 105228038-105228058 | AUUUUGCUUAAUAAAAGAGA | 7608 |
| 54790_2_17360 | - | chr4: 105228140-105228160 | CACUUUUUAUAUACAUACCC | 7609 |
| 54790_2_17375 | - | chr4: 105228207-105228227 | UAAUAAACUGCCAUUUUAGA | 7610 |
| 54790_2_17389 | - | chr4: 105228240-105228260 | UGGUCUUUAAAUCUUAUUUC | 7611 |
| 54790_2_17395 | - | chr4: 105228260-105228280 | GAAUGAGGAAAAUUUGUUAU | 7612 |
| 54790_2_17398 | - | chr4: 105228275-105228295 | GAAAGUUAUAUGUUAGAAUG | 7613 |
| 54790_2_17408 | - | chr4: 105228297-105228317 | AACUUUUCACAAGAAGGGC | 7614 |
| 54790_2_17411 | - | chr4: 105228301-105228321 | GGUUAACUUUUCACAAGAA | 7615 |
| 54790_2_17413 | - | chr4: 105228302-105228322 | UGGUUAACUUUUUCACAAGA | 7616 |
| 54790_2_17419 | - | chr4: 105228322-105228342 | CAUUUGUGUGAAAAGUUAA | 7617 |
| 54790_2_17438 | - | chr4: 105228403-105228423 | AUAUGGAGUUUUAAACACAA | 7618 |
| 54790_2_17440 | - | chr4: 105228420-105228440 | AAAAGAAAUGUAUUUCAAUA | 7619 |
| 54790_2_17443 | - | chr4: 105228450-105228470 | UAAUAGCUACUAAGAAAUGA | 7620 |
| 54790_2_17455 | - | chr4: 105228491-105228511 | GACAUUCUUUAAAGUGUCAA | 7621 |
| 54790_2_17456 | - | chr4: 105228492-105228512 | GGACAUUCUUUAAAGUGUCA | 7622 |
| 54790_2_17460 | - | chr4: 105228513-105228533 | UAAUCCAUUCCACAUAAUUU | 7623 |
| 54790_2_17477 | - | chr4: 105228576-105228596 | ACAUGUUUUCUACUUUCUA | 7624 |
| 54790_2_17482 | - | chr4: 105228612-105228632 | AUAAAUUAUAUAAAAUUUGU | 7625 |
| 54790_2_17488 | - | chr4: 105228667-105228687 | UCAUAUACAGAGCAAUCAAA | 7626 |
| 54790_2_17496 | - | chr4: 105228708-105228728 | AAAAAAGGCACUUUUCUUU | 7627 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_2_17498 | - | chr4: 105228722-105228742 | GUCCAGAUACUACCAAAAAA | 7628 |
| 54790_2_17506 | - | chr4: 105228795-105228815 | CUAUCACUUUUCAAAAAUUA | 7629 |
| 54790_2_17509 | - | chr4: 105228821-105228841 | UGAGAGGCUUCUCCAAAAUC | 7630 |
| 54790_2_17516 | - | chr4: 105228837-105228857 | UUUGUAGUCUUUGAUAUGAG | 7631 |
| 54790_2_17525 | - | chr4: 105228881-105228901 | ACACCUAAUAAAGAAACUUU | 7632 |
| 54790_2_17532 | - | chr4: 105228920-105228940 | AGAAAAUUUGGGUGAGACAA | 7633 |
| 54790_2_17537 | - | chr4: 105228931-105228951 | UAACUUGUAGUAGAAAAUUU | 7634 |
| 54790_2_17538 | - | chr4: 105228932-105228952 | AUAACUUGUAGUAGAAAAUU | 7635 |
| 54790_2_17545 | - | chr4: 105228970-105228990 | UCUUUUACAUUUUAAGGUAC | 7636 |
| 54790_2_17566 | - | chr4: 105229049-105229069 | ACUUGAUAAAAUUUACAUAA | 7637 |
| 54790_2_17567 | - | chr4: 105229050-105229070 | AACUUGAUAAAAUUUACAUA | 7638 |
| 54790_2_17581 | - | chr4: 105229131-105229151 | UAGAUACUUUUGUAAAUCAA | 7639 |
| 54790_2_17585 | - | chr4: 105229155-105229175 | CAGAUCAGGUUUAACUCUAC | 7640 |
| 54790_2_17595 | - | chr4: 105229238-105229258 | UCCUUCCAUACAUUAACUCU | 7641 |
| 54790_2_17606 | - | chr4: 105229304-105229324 | UUAUUUGUUAUAACUCAUAU | 7642 |
| 54790_2_17610 | - | chr4: 105229354-105229374 | GCGCGGUGACGUGAGGUCGG | 7643 |
| 54790_2_17616 | - | chr4: 105229394-105229414 | GUAAACUUGGGUCCUCCGCC | 7644 |
| 54790_2_17618 | - | chr4: 105229397-105229417 | UUAGUAAACUUGGGUCCUCC | 7645 |
| 54790_2_17620 | - | chr4: 105229400-105229420 | CUCUUAGUAAACUUGGGUCC | 7646 |
| 54790_2_17621 | - | chr4: 105229403-105229423 | GUCCUCUUAGUAAACUUGGG | 7647 |
| 54790_2_17628 | - | chr4: 105229422-105229442 | CAAUGAACCCUCCGACUCCG | 7648 |
| 54790_2_17631 | - | chr4: 105229426-105229446 | GGGUCAAUGAACCCUCCGAC | 7649 |
| 54790_2_17633 | - | chr4: 105229432-105229452 | ACAUCAGGGUCAAUGAACCC | 7650 |
| 54790_2_17635 | - | chr4: 105229435-105229455 | CGGACAUCAGGGUCAAUGAA | 7651 |
| 54790_2_17636 | - | chr4: 105229436-105229456 | ACGGACAUCAGGGUCAAUGA | 7652 |
| 54790_2_17639 | - | chr4: 105229463-105229483 | GUUUUCAUCGACCCGUACC | 7653 |
| 54790_2_17640 | - | chr4: 105229466-105229486 | UAUGUUUUCAUCGACCCGU | 7654 |
| 54790_2_17641 | - | chr4: 105229471-105229491 | AUUUUUAUGUUUUCAUCGA | 7655 |
| 54790_2_17642 | - | chr4: 105229472-105229492 | GAUUUUUAUGUUUUCAUCG | 7656 |
| 54790_2_17645 | - | chr4: 105229511-105229531 | GCUCUGGUAGAACCGGUUGC | 7657 |
| 54790_2_17646 | - | chr4: 105229520-105229540 | AGUUCUCUAGCUCUGGUAGA | 7658 |
| 54790_2_17649 | - | chr4: 105229543-105229563 | CGACUCCGUCCGUCUAGUGC | 7659 |
| 54790_2_17653 | - | chr4: 105229555-105229575 | CGUGAAACCCUCCGACUCCG | 7660 |
| 54790_2_17654 | - | chr4: 105229559-105229579 | GGGUCGUGAAACCCUCCGAC | 7661 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_2_17656 | - | chr4: 105229565-105229585 | ACAUCAGGGUCGUGAAACCC | 7662 |
| 54790_2_17657 | - | chr4: 105229568-105229588 | CGGACAUCAGGGUCGUGAAA | 7663 |
| 54790_2_17659 | - | chr4: 105229569-105229589 | GCGGACAUCAGGGUCGUGAA | 7664 |
| 54790_2_17662 | - | chr4: 105229596-105229616 | UUUAUUUACCGGUCCGUGCC | 7665 |
| 54790_2_17663 | - | chr4: 105229599-105229619 | UAUUUAUUUACCGGUCCGU | 7666 |
| 54790_2_17666 | - | chr4: 105229604-105229624 | UUAUUUAUUUUAUUUACCGG | 7667 |
| 54790_2_17667 | - | chr4: 105229609-105229629 | AUGAAUUAUUUAUUUUAUUU | 7668 |
| 54790_2_17687 | - | chr4: 105229687-105229707 | ACCUCUUUUCGUGACCCUCC | 7669 |
| 54790_2_17688 | - | chr4: 105229688-105229708 | GACCUCUUUUCGUGACCCUC | 7670 |
| 54790_2_17690 | - | chr4: 105229689-105229709 | CGACCUCUUUUCGUGACCCU | 7671 |
| 54790_2_17693 | - | chr4: 105229690-105229710 | UCGACCUCUUUUCGUGACCC | 7672 |
| 54790_2_17695 | - | chr4: 105229693-105229713 | CCGUCGACCUCUUUUCGUGA | 7673 |
| 54790_2_17697 | - | chr4: 105229694-105229714 | CCCGUCGACCUCUUUUCGUG | 7674 |
| 54790_2_17702 | - | chr4: 105229707-105229727 | UCCUUUUCCUUACCCCGUCG | 7675 |
| 54790_2_17706 | - | chr4: 105229714-105229734 | ACGGAGGUCCUUUUCCUUAC | 7676 |
| 54790_2_17707 | - | chr4: 105229715-105229735 | AACGGAGGUCCUUUUCCUUA | 7677 |
| 54790_2_17708 | - | chr4: 105229716-105229736 | AAACGGAGGUCCUUUUCCUU | 7678 |
| 54790_2_17712 | - | chr4: 105229721-105229741 | UUAUUAAACGGAGGUCCUUU | 7679 |
| 54790_2_17714 | - | chr4: 105229727-105229747 | CCGGUAUUAUUAAACGGAGG | 7680 |
| 54790_2_17717 | - | chr4: 105229748-105229768 | GACCUCUUAUAUAUUACUUG | 7681 |
| 54790_2_17722 | - | chr4: 105229767-105229787 | AAAUAAAAAAAAAUCUAGAG | 7682 |
| 54790_2_17729 | - | chr4: 105229838-105229858 | GGUCAUUAAUUUACCUUAUU | 7683 |
| 54790_2_17732 | - | chr4: 105229846-105229866 | UCAUAGAGGGUCAUUAAUUU | 7684 |
| 54790_2_17739 | - | chr4: 105229870-105229890 | UCAUAGAGAUAUAAAAGUCU | 7685 |
| 54790_2_17747 | - | chr4: 105229932-105229952 | CCCAAUACAAUUUAUUAAAU | 7686 |
| 54790_2_17749 | - | chr4: 105229952-105229972 | CUUUGUUGGAUGUAGUUAUU | 7687 |
| 54790_2_17750 | - | chr4: 105229953-105229973 | UCUUUGUUGGAUGUAGUUAU | 7688 |
| 54790_2_17756 | - | chr4: 105229978-105229998 | GUUAGAAAACGUCAUUAUUU | 7689 |
| 54790_2_17758 | - | chr4: 105230003-105230023 | UAUAUAUGUAAUUUACUACA | 7690 |
| 54790_2_17762 | - | chr4: 105230084-105230104 | CACUACGACGUGAGGUCGGA | 7691 |
| 54790_2_17763 | - | chr4: 105230085-105230105 | ACACUACGACGUGAGGUCGG | 7692 |
| 54790_2_17766 | - | chr4: 105230114-105230134 | UCCUCCACCUGUGACGUCAC | 7693 |
| 54790_2_17768 | - | chr4: 105230128-105230148 | UUAGUGGACUUGGGUCCUCC | 7694 |
| 54790_2_17770 | - | chr4: 105230131-105230151 | UUCUUAGUGGACUUGGGUCC | 7695 |
| 54790_2_17771 | - | chr4: 105230134-105230154 | UUCUUCUUAGUGGACUUGGG | 7696 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_17780 | - | chr4: 105230157-105230177 | GGGUCAAUGAACCCUCCGAC | 7697 |
| 54790_2_17784 | - | chr4: 105230163-105230183 | ACAUUAGGGUCAAUGAACCC | 7698 |
| 54790_2_17785 | - | chr4: 105230166-105230186 | UGGACAUUAGGGUCAAUGAA | 7699 |
| 54790_2_17788 | - | chr4: 105230167-105230187 | GUGGACAUUAGGGUCAAUGA | 7700 |
| 54790_2_17791 | - | chr4: 105230190-105230210 | UUAAUCGUCCCGUACCACCA | 7701 |
| 54790_2_17792 | - | chr4: 105230194-105230214 | GUUUUUAAUCGUCCCGUACC | 7702 |
| 54790_2_17793 | - | chr4: 105230197-105230217 | UAUGUUUUUAAUCGUCCCGU | 7703 |
| 54790_2_17794 | - | chr4: 105230202-105230222 | UUUUCUAUGUUUUUAAUCGU | 7704 |
| 54790_2_17795 | - | chr4: 105230203-105230223 | UUUUUCUAUGUUUUUAAUCG | 7705 |
| 54790_2_17799 | - | chr4: 105230244-105230264 | GAUCUGGUUGGACCGGUUGU | 7706 |
| 54790_2_17800 | - | chr4: 105230253-105230273 | GGUCCUCAAGAUCUGGUUGG | 7707 |
| 54790_2_17801 | - | chr4: 105230271-105230291 | GGUCACCUAGUGGACUCCGG | 7708 |
| 54790_2_17804 | - | chr4: 105230276-105230296 | AUUCCGGUCACCUAGUGGAC | 7709 |
| 54790_2_17808 | - | chr4: 105230287-105230307 | GAAACCCUUCGAUUCCGGUC | 7710 |
| 54790_2_17810 | - | chr4: 105230294-105230314 | GGGUCGUGAAACCCUUCGAU | 7711 |
| 54790_2_17811 | - | chr4: 105230303-105230323 | CGGAUAUUAGGGUCGUGAAA | 7712 |
| 54790_2_17813 | - | chr4: 105230304-105230324 | GCGGAUAUUAGGGUCGUGAA | 7713 |
| 54790_2_17818 | - | chr4: 105230334-105230354 | AAAUAGACUGUCCGACCCAC | 7714 |
| 54790_2_17822 | - | chr4: 105230339-105230359 | UUCUUAAAUAGACUGUCCGA | 7715 |
| 54790_2_17823 | - | chr4: 105230340-105230360 | AUUCUUAAAUAGACUGUCCG | 7716 |
| 54790_2_17825 | - | chr4: 105230344-105230364 | GAAAAUUCUUAAAUAGACUG | 7717 |
| 54790_2_17835 | - | chr4: 105230404-105230424 | AUAGUACAUCCUACUGUUAA | 7718 |
| 54790_2_17836 | - | chr4: 105230416-105230436 | UUGACGGUGUUUAUAGUACA | 7719 |
| 54790_2_17843 | - | chr4: 105230453-105230473 | UUUUGUCUAUGAGAGAGUAC | 7720 |
| 54790_2_17847 | - | chr4: 105230476-105230496 | UGAUACAAACCGUUCGUACA | 7721 |
| 54790_2_17849 | - | chr4: 105230477-105230497 | AUGAUACAAACCGUUCGUAC | 7722 |
| 54790_2_17852 | - | chr4: 105230488-105230508 | CGAACUAUGAUAUGAUACAA | 7723 |
| 54790_2_17863 | - | chr4: 105230551-105230571 | ACGUUUAAUUUGACGUUGU | 7724 |
| 54790_2_17872 | - | chr4: 105230620-105230640 | GUAUCUUUUACUUUACACUU | 7725 |
| 54790_2_17876 | - | chr4: 105230649-105230669 | AUUUUUUACCUGUUCCCUGU | 7726 |
| 54790_2_17878 | - | chr4: 105230655-105230675 | UGUAUGAUUUUUUACCGUUU | 7727 |
| 54790_2_17880 | - | chr4: 105230656-105230676 | GUGUAUGAUUUUUUACCUGU | 7728 |
| 54790_2_17882 | - | chr4: 105230662-105230682 | UUAUUGGUGUAUGAUUUUUU | 7729 |
| 54790_2_17890 | - | chr4: 105230702-105230722 | UAAACAAAGAAUUGUAUA | 7730 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_17899 | - | chr4: 105230784-105230804 | AUCUAGAAGUCAUAAAGAU | 7731 |
| 54790_2_17900 | - | chr4: 105230785-105230805 | AAUCUAGAAGUCAUAAAGA | 7732 |
| 54790_2_17913 | - | chr4: 105230832-105230852 | ACUUAAAAAAUCUAAUGAC | 7733 |
| 54790_2_17921 | - | chr4: 105230894-105230914 | ACUUAAAUUAUAAACUUAUG | 7734 |
| 54790_2_17931 | - | chr4: 105230950-105230970 | AGGACUUUUUUACUAUUUCA | 7735 |
| 54790_2_17933 | - | chr4: 105230951-105230971 | GAGGACUUUUUUACUAUUUC | 7736 |
| 54790_2_17938 | - | chr4: 105230978-105230998 | AUGAACUAUAAUCUUGUUGA | 7737 |
| 54790_2_17939 | - | chr4: 105230979-105230999 | UAUGAACUAUAAUCUUGUUG | 7738 |
| 54790_2_17945 | - | chr4: 105231013-105231033 | UAUACGAUGUUCUAUUCCUA | 7739 |
| 54790_2_17947 | - | chr4: 105231014-105231034 | UUAUACGAUGUUCUAUUCCU | 7740 |
| 54790_2_17949 | - | chr4: 105231018-105231038 | GUCUUUAUACGAUGUUCUAU | 7741 |
| 54790_2_17956 | - | chr4: 105231076-105231096 | AUAUUAUAAUUAUACUAGUU | 7742 |
| 54790_2_17968 | - | chr4: 105231170-105231190 | AAGACUUUUUCUUAACAUAC | 7743 |
| 54790_2_17969 | - | chr4: 105231171-105231191 | UAAGACUUUUUCUUAACAUA | 7744 |
| 54790_2_17971 | - | chr4: 105231172-105231192 | AUAAGACUUUUUCUUAACAU | 7745 |
| 54790_2_17977 | - | chr4: 105231197-105231217 | UUAUUUGUUUAACCCAUCGG | 7746 |
| 54790_2_17982 | - | chr4: 105231205-105231225 | AAACCUUUUUAUUUGUUUAA | 7747 |
| 54790_2_17983 | - | chr4: 105231206-105231226 | UAAACCUUUUUAUUUGUUUA | 7748 |
| 54790_2_17987 | - | chr4: 105231223-105231243 | UCAACUGAGGUUUCAAGUAA | 7749 |
| 54790_2_17994 | - | chr4: 105231247-105231267 | GUCUUAUAAAACUCCUUAAU | 7750 |
| 54790_2_17997 | - | chr4: 105231255-105231275 | UCAUGAACGUCUUAUAAAAC | 7751 |
| 54790_2_18009 | - | chr4: 105231339-105231359 | AUUCAUGUUUUGUUUUGUU | 7752 |
| 54790_2_18012 | - | chr4: 105231340-105231360 | UAUUCAUGUUUUGUUUUGU | 7753 |
| 54790_2_18024 | - | chr4: 105231402-105231422 | UCCUUAUUCAAAAAUUUUAC | 7754 |
| 54790_2_18028 | - | chr4: 105231422-105231442 | UAUCUUCUUUAAUUAUGUGA | 7755 |
| 54790_2_18037 | - | chr4: 105231465-105231485 | GUUGGUCAGUCUUCAAAAUG | 7756 |
| 54790_2_18056 | - | chr4: 105231554-105231574 | GAUCUCUUAGUUCAUUUUUU | 7757 |
| 54790_2_18062 | - | chr4: 105231582-105231602 | GUCUAUUUUUCUAAUAUAUG | 7758 |
| 54790_2_18083 | - | chr4: 105231705-105231725 | AGAAAGACUAUUUUCUUUUU | 7759 |
| 54790_2_18084 | - | chr4: 105231706-105231726 | AAGAAAGACUAUUUUCUUUU | 7760 |
| 54790_2_18103 | - | chr4: 105231790-105231810 | AAAAAUUAAUCCAUUGUAUA | 7761 |
| 54790_2_18104 | - | chr4: 105231819-105231839 | AUAGAGAAAGCCAGAAGAAA | 7762 |
| 54790_2_18128 | - | chr4: 105231945-105231965 | CAGACAUGUGGUUUGGGGGU | 7763 |
| 54790_2_18132 | - | chr4: 105231978-105231998 | UUCAUGAUGCGAAUAAUGGA | 7764 |
| 54790_2_18133 | - | chr4: 105231979-105231999 | AUUCAUGAUGCGAAUAAUGG | 7765 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_2_18137 | - | chr4: 105232019-105232039 | AACUCCUACCCUCUUCCCUC | 7766 |
| 54790_2_18141 | - | chr4: 105232024-105232044 | UAUGAAACUCCUACCCUCUU | 7767 |
| 54790_2_18143 | - | chr4: 105232025-105232045 | CUAUGAAACUCCUACCCUCU | 7768 |
| 54790_2_18148 | - | chr4: 105232031-105232051 | UCGUCCCUAUGAAACUCCUA | 7769 |
| 54790_2_18149 | - | chr4: 105232032-105232052 | GUCGUCCCUAUGAAACUCCU | 7770 |
| 54790_2_18152 | - | chr4: 105232036-105232056 | GUCUGUCGUCCCUAUGAAAC | 7771 |
| 54790_2_18155 | - | chr4: 105232047-105232067 | UCCCCCUUGUUGUCUGUCGU | 7772 |
| 54790_2_18157 | - | chr4: 105232048-105232068 | CUCCCCCUUGUUGUCUGUCG | 7773 |
| 54790_2_18159 | - | chr4: 105232064-105232084 | UUGUGUACCUGUGUUUCUCC | 7774 |
| 54790_2_18161 | - | chr4: 105232065-105232085 | CUUGUGUACCUGUGUUUCUC | 7775 |
| 54790_2_18163 | - | chr4: 105232066-105232086 | UCUUGUGUACCUGUGUUUCU | 7776 |
| 54790_2_18165 | - | chr4: 105232067-105232087 | UUCUUGUGUACCUGUGUUUC | 7777 |
| 54790_2_18169 | - | chr4: 105232078-105232098 | UCGAUUUGUCGUUCUUGUGU | 7778 |
| 54790_2_18175 | - | chr4: 105232102-105232122 | UAUGGUGUACAAGAGAAUUC | 7779 |
| 54790_2_18179 | - | chr4: 105232134-105232154 | AUAGGAUUUGUUUGAUUGUU | 7780 |
| 54790_2_18181 | - | chr4: 105232161-105232181 | UCGUUGUACCUACCUCGACC | 7781 |
| 54790_2_18184 | - | chr4: 105232164-105232184 | ACGUCGUUGUACCUACCUCG | 7782 |
| 54790_2_18187 | - | chr4: 105232170-105232190 | CAAGACACGUCGUUGUACCU | 7783 |
| 54790_2_18189 | - | chr4: 105232174-105232194 | AGCACAAGACACGUCGUUGU | 7784 |
| 54790_2_18194 | - | chr4: 105232227-105232247 | UUUCACAAUGUAUAUGUGGU | 7785 |
| 54790_2_18197 | - | chr4: 105232256-105232276 | UUACAGGCAUUCAUCAUCUG | 7786 |
| 54790_2_18200 | - | chr4: 105232289-105232309 | AUAAUUACUAUCGCUUCUGU | 7787 |
| 54790_2_18207 | - | chr4: 105232342-105232362 | AUAUUUAGUAAGAUGGUAUU | 7788 |
| 54790_2_18211 | - | chr4: 105232366-105232386 | AUAAGCCGUAUAAUGGGUUU | 7789 |
| 54790_2_18212 | - | chr4: 105232367-105232387 | AAUAAGCCGUAUAAUGGGUU | 7790 |
| 54790_2_18215 | - | chr4: 105232382-105232402 | CUGGCUCGUUAGGGUAAUAA | 7791 |
| 54790_2_18222 | - | chr4: 105232422-105232442 | UUCGUCACGCCAUUAAAGUC | 7792 |
| 54790_2_18227 | - | chr4: 105232434-105232454 | UCGACAACACCUUUCGUCAC | 7793 |
| 54790_2_18228 | - | chr4: 105232446-105232466 | CAUUUGAUCAAGUCGACAAC | 7794 |
| 54790_2_18235 | - | chr4: 105232472-105232492 | GAAUAGGGGAAUAACGAACA | 7795 |
| 54790_2_18238 | - | chr4: 105232473-105232493 | UGAAUAGGGGAAUAACGAAC | 7796 |
| 54790_2_18243 | - | chr4: 105232499-105232519 | AAUCAUUCCACGUCUCUUUU | 7797 |
| 54790_2_18245 | - | chr4: 105232500-105232520 | UAAUCAUUCCACGUCUCUUU | 7798 |
| 54790_2_18254 | - | chr4: 105232550-105232570 | GGAGUCUAUAGUAGAAGGGA | 7799 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_18270 | - | chr4: 105232633-105232653 | CAAAGUCUCGAAGUACGGAA | 7800 |
| 54790_2_18286 | - | chr4: 105232740-105232760 | GUUUUCUUCCCCCCGCAUAC | 7801 |
| 54790_2_18300 | - | chr4: 105232796-105232816 | AUGUUUUCUCUAGAGGGGC | 7802 |
| 54790_2_18301 | - | chr4: 105232800-105232820 | UUCUAUGUUUUCUCUAGAG | 7803 |
| 54790_2_18302 | - | chr4: 105232801-105232821 | AUUCUAUGUUUUCUCUAGA | 7804 |
| 54790_2_18304 | - | chr4: 105232802-105232822 | GAUUCUAUGUUUUCUCUAG | 7805 |
| 54790_2_18311 | - | chr4: 105232826-105232846 | CUUUAUGAAAAACCCUUUCU | 7806 |
| 54790_2_18315 | - | chr4: 105232863-105232883 | UAUUCCAGGUGACAGAAUAG | 7807 |
| 54790_2_18316 | - | chr4: 105232864-105232884 | AUAUUCCAGGUGACAGAAUA | 7808 |
| 54790_2_18319 | - | chr4: 105232865-105232885 | AAUAUUCCAGGUGACAGAAU | 7809 |
| 54790_2_18323 | - | chr4: 105232877-105232897 | UUCAGUGUUAUCAAUAUUCC | 7810 |
| 54790_2_18325 | - | chr4: 105232909-105232929 | CCAAAUACACCUGAGAGAUA | 7811 |
| 54790_2_18332 | - | chr4: 105232949-105232969 | CUGGCUUAAACUUGCCUGCA | 7812 |
| 54790_2_18336 | - | chr4: 105232968-105232988 | UCAUAUUCUCUUUAACACAC | 7813 |
| 54790_2_18345 | - | chr4: 105233016-105233036 | AGGUUCCCUUUGUUAUCAAA | 7814 |
| 54790_2_18348 | - | chr4: 105233036-105233056 | CCUUCCCCUCCAGCCCUUUA | 7815 |
| 54790_2_18354 | - | chr4: 105233083-105233103 | GGUGCAGUAGCUUUUUAAAA | 7816 |
| 54790_2_18355 | - | chr4: 105233084-105233104 | UGGUGCAGUAGCUUUUUAAA | 7817 |
| 54790_2_18359 | - | chr4: 105233125-105233145 | AGGGUUUCACGACCCUAAUG | 7818 |
| 54790_2_18361 | - | chr4: 105233133-105233153 | GGAACCGGAGGGUUUCACGA | 7819 |
| 54790_2_18363 | - | chr4: 105233134-105233154 | CGGAACCGGAGGGUUUCACG | 7820 |
| 54790_2_18365 | - | chr4: 105233150-105233170 | GAGUCCACUAGACGGACGGA | 7821 |
| 54790_2_18367 | - | chr4: 105233167-105233187 | CCAGAACUUGAGGACUGGAG | 7822 |
| 54790_2_18373 | - | chr4: 105233188-105233208 | AAAAUGAUACAACCGGUCCG | 7823 |
| 54790_2_18374 | - | chr4: 105233192-105233212 | CCCCAAAAUGAUACAACCGG | 7824 |
| 54790_2_18375 | - | chr4: 105233197-105233217 | CUCUACCCCAAAAUGAUACA | 7825 |
| 54790_2_18384 | - | chr4: 105233211-105233231 | AACAUAAAAAUCAUCUCUAC | 7826 |
| 54790_2_18385 | - | chr4: 105233212-105233232 | AAACAUAAAAAUCAUCUCUA | 7827 |
| 54790_2_18387 | - | chr4: 105233213-105233233 | AAAACAUAAAAAUCAUCUCU | 7828 |
| 54790_2_18391 | - | chr4: 105233260-105233280 | AGGGUUCAUCGACUCUAAUG | 7829 |
| 54790_2_18395 | - | chr4: 105233308-105233328 | GUGACGUUGGAGACGGAGGG | 7830 |
| 54790_2_18397 | - | chr4: 105233333-105233353 | CCUCACGUCGCCGUGUUAGA | 7831 |
| 54790_2_18399 | - | chr4: 105233344-105233364 | AACGGGUCCGACCUCACGUC | 7832 |
| 54790_2_18401 | - | chr4: 105233354-105233374 | AGAGUGAGAGAACGGGUCCG | 7833 |
| 54790_2_18403 | - | chr4: 105233358-105233378 | CCUCAGAGUGAGAGAACGGG | 7834 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_2_18422 | − | chr4: 105233379-105233399 | AAAAAAAAAAAAAAACUCU | 7835 |
| 54790_2_18459 | − | chr4: 105233638-105233658 | UCAAAAUUACCAGCUAAUGU | 7836 |
| 54790_2_18460 | − | chr4: 105233639-105233659 | AUCAAAAUUACCAGCUAAUG | 7837 |
| 54790_2_18465 | − | chr4: 105233664-105233684 | UUUAUGGUCAUGGAGAACAA | 7838 |
| 54790_2_18466 | − | chr4: 105233665-105233685 | AUUUAUGGUCAUGGAGAACA | 7839 |
| 54790_2_18470 | − | chr4: 105233674-105233694 | CUCUAAAAUAUUUAUGGUCA | 7840 |
| 54790_2_18474 | − | chr4: 105233680-105233700 | UAGCAACUCUAAAAUAUUUA | 7841 |
| 54790_2_18478 | − | chr4: 105233724-105233744 | GUGACAACUGACAGCUACUC | 7842 |
| 54790_2_18489 | − | chr4: 105233791-105233811 | GAAUAAUUGUGGAUAAAUAU | 7843 |
| 54790_2_18492 | − | chr4: 105233802-105233822 | UAUAUCUUAAGGAAUAAUUG | 7844 |
| 54790_2_18494 | − | chr4: 105233813-105233833 | AAAAAUACUAAUAUAUCUUA | 7845 |
| 54790_3_5 | + | chr4: 105237359-105237379 | CAGAAAUGUACUGAGACACA | 7846 |
| 54790_3_12 | + | chr4: 105237397-105237417 | AGCAAAUUUAUCUUCAGAUA | 7847 |
| 54790_3_13 | + | chr4: 105237398-105237418 | GCAAAUUUAUCUUCAGAUAU | 7848 |
| 54790_3_22 | + | chr4: 105237430-105237450 | CUUUUUUUAAAUCUUGAGUC | 7849 |
| 54790_3_31 | + | chr4: 105237446-105237466 | AGUCUGGCAGCAAUUUGUAA | 7850 |
| 54790_3_73 | + | chr4: 105237650-105237670 | GCUCUUUGUAUAUUAUCUCC | 7851 |
| 54790_3_78 | + | chr4: 105237663-105237683 | UAUCUCCUGGAGAGACAGCU | 7852 |
| 54790_3_84 | + | chr4: 105237708-105237728 | AAUGAGAAAAUAACGACCAU | 7853 |
| 54790_3_86 | + | chr4: 105237748-105237768 | UUUAAAUAUUUUUUAAUUCA | 7854 |
| 54790_3_95 | + | chr4: 105237778-105237798 | UAUUAGUUUCACAAGAUUUC | 7855 |
| 54790_3_99 | + | chr4: 105237786-105237806 | UCACAAGAUUUCUGGCUAAU | 7856 |
| 54790_3_100 | + | chr4: 105237787-105237807 | CACAAGAUUUCUGGCUAAUA | 7857 |
| 54790_3_110 | + | chr4: 105237817-105237837 | UAUCUUCAGUCUUCAUGAGU | 7858 |
| 54790_3_112 | + | chr4: 105237818-105237838 | AUCUUCAGUCUUCAUGAGUU | 7859 |
| 54790_3_114 | + | chr4: 105237819-105237839 | UCUUCAGUCUUCAUGAGUUG | 7860 |
| 54790_3_117 | + | chr4: 105237820-105237840 | CUUCAGUCUUCAUGAGUUGG | 7861 |
| 54790_3_125 | + | chr4: 105237882-105237902 | CUUUUCUCCAUUUAUACAUU | 7862 |
| 54790_3_148 | + | chr4: 105237958-105237978 | UUGAUUAAAAAAUAUGAUAC | 7863 |
| 54790_3_155 | + | chr4: 105237979-105237999 | GGCAUACCUCAGAGAUAUUG | 7864 |
| 54790_3_156 | + | chr4: 105237980-105238000 | GCAUACCUCAGAGAUAUUGU | 7865 |
| 54790_3_157 | + | chr4: 105237985-105238005 | CCUCAGAGAUAUUGUGGGUU | 7866 |
| 54790_3_163 | + | chr4: 105238032-105238052 | UUACAAUAAAGCAAGUUGUA | 7867 |
| 54790_3_165 | + | chr4: 105238041-105238061 | AGCAAGUUGUAAGGACUUUU | 7868 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_184 | + | chr4: 105238169-105238189 | AAAAAAUGCCAACAAUUAUC | 7869 |
| 54790_3_185 | + | chr4: 105238170-105238190 | AAAAAUGCCAACAAUUAUCU | 7870 |
| 54790_3_189 | + | chr4: 105238199-105238219 | GUGAGUGCUAAUCUUUUUGC | 7871 |
| 54790_3_193 | + | chr4: 105238202-105238222 | AGUGCUAAUCUUUUUGCUGG | 7872 |
| 54790_3_195 | + | chr4: 105238205-105238225 | GCUAAUCUUUUUGCUGGUGG | 7873 |
| 54790_3_196 | + | chr4: 105238206-105238226 | CUAAUCUUUUUGCUGGUGGA | 7874 |
| 54790_3_202 | + | chr4: 105238232-105238252 | UGCUUCAGUAUUGAUCGCUG | 7875 |
| 54790_3_204 | + | chr4: 105238243-105238263 | UGAUCGCUGUGGACUGAUCA | 7876 |
| 54790_3_206 | + | chr4: 105238246-105238266 | UCGCUGUGGACUGAUCAUGG | 7877 |
| 54790_3_208 | + | chr4: 105238259-105238279 | AUCAUGGUGGUAGUUGCUGA | 7878 |
| 54790_3_210 | + | chr4: 105238266-105238286 | UGGUAGUUGCUGAAGGUUGC | 7879 |
| 54790_3_212 | + | chr4: 105238267-105238287 | GGUAGUUGCUGAAGGUUGCU | 7880 |
| 54790_3_213 | + | chr4: 105238271-105238291 | GUUGCUGAAGGUUGCUGGGA | 7881 |
| 54790_3_215 | + | chr4: 105238283-105238303 | UGCUGGGAUGGCUGUGUGUG | 7882 |
| 54790_3_237 | + | chr4: 105238412-105238432 | AGCAGAAUUUCUUUGAAAAU | 7883 |
| 54790_3_259 | + | chr4: 105238512-105238532 | GCAGUUUACAGCAUCUUCAU | 7884 |
| 54790_3_279 | + | chr4: 105238610-105238630 | AGUAACUCAGCCCCAUCUUC | 7885 |
| 54790_3_280 | + | chr4: 105238628-105238648 | UCAGGCUCUACUUCUAAUUC | 7886 |
| 54790_3_288 | + | chr4: 105238671-105238691 | CAUCUGCAGUGACCUCUCCA | 7887 |
| 54790_3_293 | + | chr4: 105238703-105238723 | ACUCCUCAAAGUAAUCCAUG | 7888 |
| 54790_3_294 | + | chr4: 105238704-105238724 | CUCCUCAAAGUAAUCCAUGA | 7889 |
| 54790_3_297 | + | chr4: 105238708-105238728 | UCAAAGUAAUCCAUGAGGGU | 7890 |
| 54790_3_306 | + | chr4: 105238790-105238810 | UGUUCUUAAUAACUUCUAAA | 7891 |
| 54790_3_311 | + | chr4: 105238808-105238828 | AAUGGUGAUACCUUUCCAGA | 7892 |
| 54790_3_315 | + | chr4: 105238829-105238849 | GGCUUUCAAUGUACUUUGCC | 7893 |
| 54790_3_321 | + | chr4: 105238851-105238871 | GAUCCAUCAGAAGACUAUCU | 7894 |
| 54790_3_328 | + | chr4: 105238922-105238942 | AAAAGUACUCCUUAAUCCAU | 7895 |
| 54790_3_332 | + | chr4: 105238949-105238969 | AGAAUCAAUGUUGUAUUAAC | 7896 |
| 54790_3_338 | + | chr4: 105238985-105239005 | UUAAUCUUGUGCAUCUCCAU | 7897 |
| 54790_3_341 | + | chr4: 105238994-105239014 | UGCAUCUCCAUCGGAGCUCU | 7898 |
| 54790_3_343 | + | chr4: 105238995-105239015 | GCAUCUCCAUCGGAGCUCUU | 7899 |
| 54790_3_344 | + | chr4: 105239003-105239023 | AUCGGAGCUCUUGGGUGACU | 7900 |
| 54790_3_349 | + | chr4: 105239030-105239050 | UUGAGCAGUAAUAUUUUGAA | 7901 |
| 54790_3_351 | + | chr4: 105239033-105239053 | AGCAGUAAUAUUUUGAAAGG | 7902 |
| 54790_3_353 | + | chr4: 105239039-105239059 | AAUAUUUUGAAAGGAGGUUU | 7903 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_381 | + | chr4: 105239091-105239111 | UUAGCAGUAAGUCUCAACAC | 7904 |
| 54790_3_384 | + | chr4: 105239092-105239112 | UAGCAGUAAGUCUCAACACU | 7905 |
| 54790_3_394 | + | chr4: 105239173-105239193 | UUCCAUUACUCUACACAAGC | 7906 |
| 54790_3_396 | + | chr4: 105239174-105239194 | UCCAUUACUCUACACAAGCA | 7907 |
| 54790_3_400 | + | chr4: 105239197-105239217 | UACACUUAGCAUAAUUCUUA | 7908 |
| 54790_3_401 | + | chr4: 105239198-105239218 | ACACUUAGCAUAAUUCUUAA | 7909 |
| 54790_3_404 | + | chr4: 105239204-105239224 | AGCAUAAUUCUUAAGGGCCU | 7910 |
| 54790_3_410 | + | chr4: 105239218-105239238 | GGGCCUUGGAAUUUUCAGAA | 7911 |
| 54790_3_414 | + | chr4: 105239231-105239251 | UUCAGAAUGGUAAAUGAGUA | 7912 |
| 54790_3_416 | + | chr4: 105239232-105239252 | UCAGAAUGGUAAAUGAGUAU | 7913 |
| 54790_3_425 | + | chr4: 105239299-105239319 | UCAGCCUGUCCUUUGAAGCA | 7914 |
| 54790_3_430 | + | chr4: 105239331-105239351 | CUAUCUAUGAAAGUCUUAGA | 7915 |
| 54790_3_433 | + | chr4: 105239351-105239371 | UGGCACCUUGUUUCAAUAGU | 7916 |
| 54790_3_464 | + | chr4: 105239553-105239573 | CAUUCUCUUCAUAGAACUGA | 7917 |
| 54790_3_465 | + | chr4: 105239554-105239574 | AUUCUCUUCAUAGAACUGAA | 7918 |
| 54790_3_468 | + | chr4: 105239562-105239582 | CAUAGAACUGAAGGGAGUCA | 7919 |
| 54790_3_471 | + | chr4: 105239573-105239593 | AGGGAGUCAAGGCCUUGCUC | 7920 |
| 54790_3_472 | + | chr4: 105239585-105239605 | CCUUGCUCUGGAUUAAGCUU | 7921 |
| 54790_3_476 | + | chr4: 105239592-105239612 | CUGGAUUAAGCUUUGGCUUA | 7922 |
| 54790_3_478 | + | chr4: 105239602-105239622 | CUUUGGCUUAAGGAAUGUUG | 7923 |
| 54790_3_484 | + | chr4: 105239656-105239676 | CGCUCUCCAUAUCAGCAAUA | 7924 |
| 54790_3_491 | + | chr4: 105239691-105239711 | CUUACCUUUCAUGUGUUCAC | 7925 |
| 54790_3_502 | + | chr4: 105239734-105239754 | UUUCCUUUACAUUCACAACU | 7926 |
| 54790_3_508 | + | chr4: 105239742-105239762 | ACAUUCACAACUUGGCUAAC | 7927 |
| 54790_3_511 | + | chr4: 105239751-105239771 | ACUUGGCUAACUGGCAUGCA | 7928 |
| 54790_3_513 | + | chr4: 105239773-105239793 | GCCUAGCUUUCAGCCUGUCU | 7929 |
| 54790_3_522 | + | chr4: 105239829-105239849 | AUCUAGCUUUUGAUUUAAAG | 7930 |
| 54790_3_523 | + | chr4: 105239833-105239853 | AGCUUUUGAUUUAAAGUGGC | 7931 |
| 54790_3_531 | + | chr4: 105239868-105239888 | CCUUUCACUUGAACACUUAG | 7932 |
| 54790_3_536 | + | chr4: 105239878-105239898 | GAACACUUAGAGGCCACUGU | 7933 |
| 54790_3_538 | + | chr4: 105239879-105239899 | AACACUUAGAGGCCACUGUA | 7934 |
| 54790_3_540 | + | chr4: 105239890-105239910 | GCCACUGUAGGGUUAUUAAU | 7935 |
| 54790_3_546 | + | chr4: 105239918-105239938 | UUUCAAUAUUGUUGUGUUUU | 7936 |
| 54790_3_547 | + | chr4: 105239919-105239939 | UUCAAUAUUGUUGUGUUUUA | 7937 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_554 | + | chr4: 105239929-105239949 | UUGUGUUUUAGGGAAUAGAG | 7938 |
| 54790_3_557 | + | chr4: 105239935-105239955 | UUUAGGGAAUAGAGAGGCCC | 7939 |
| 54790_3_560 | + | chr4: 105239936-105239956 | UUAGGGAAUAGAGAGGCCCA | 7940 |
| 54790_3_567 | + | chr4: 105239941-105239961 | GAAUAGAGAGGCCCAGGGAG | 7941 |
| 54790_3_568 | + | chr4: 105239942-105239962 | AAUAGAGAGGCCCAGGGAGA | 7942 |
| 54790_3_572 | + | chr4: 105239957-105239977 | GGAGAGGGAGAGAGCCCAAA | 7943 |
| 54790_3_573 | + | chr4: 105239961-105239981 | AGGGAGAGAGCCCAAACGGC | 7944 |
| 54790_3_575 | + | chr4: 105239974-105239994 | AAACGGCUGGUUGAUAGAGC | 7945 |
| 54790_3_583 | + | chr4: 105240028-105240048 | UUGCACCAUUUACCAGAUUA | 7946 |
| 54790_3_584 | + | chr4: 105240029-105240049 | UGCACCAUUUACCAGAUUAU | 7947 |
| 54790_3_587 | + | chr4: 105240034-105240054 | CAUUUACCAGAUUAUGGGUA | 7948 |
| 54790_3_590 | + | chr4: 105240041-105240061 | CAGAUUAUGGGUACGGUUUG | 7949 |
| 54790_3_609 | + | chr4: 105240214-105240234 | UGAUAGACAUACUUAACACG | 7950 |
| 54790_3_611 | + | chr4: 105240215-105240235 | GAUAGACAUACUUAACACGU | 7951 |
| 54790_3_619 | + | chr4: 105240290-105240310 | GAACAAAGCACAAUAAAACG | 7952 |
| 54790_3_625 | + | chr4: 105240332-105240352 | AAAGCUUUUGUUAAAAUUC | 7953 |
| 54790_3_630 | + | chr4: 105240344-105240364 | UAAAAUUCAGGAUAUGUAAU | 7954 |
| 54790_3_635 | + | chr4: 105240352-105240372 | AGGAUAUGUAAUAGGUCUGU | 7955 |
| 54790_3_638 | + | chr4: 105240377-105240397 | UAGUGAAAUAUUUUUGCUGA | 7956 |
| 54790_3_644 | + | chr4: 105240395-105240415 | GAUGGAUGUAGAUAUAUACG | 7957 |
| 54790_3_654 | + | chr4: 105240478-105240498 | AGACAAAUGUUAAAUUAGUG | 7958 |
| 54790_3_664 | + | chr4: 105240541-105240561 | GAUACCCCACACUGUGUAGA | 7959 |
| 54790_3_667 | + | chr4: 105240545-105240565 | CCCCACACUGUGUAGAAGGA | 7960 |
| 54790_3_669 | + | chr4: 105240548-105240568 | CACACUGUGUAGAAGGAUGG | 7961 |
| 54790_3_672 | + | chr4: 105240549-105240569 | ACACUGUGUAGAAGGAUGGA | 7962 |
| 54790_3_674 | + | chr4: 105240552-105240572 | CUGUGUAGAAGGAUGGAGGG | 7963 |
| 54790_3_675 | + | chr4: 105240579-105240599 | CUACUGUCCCUCUUUGCGUG | 7964 |
| 54790_3_679 | + | chr4: 105240599-105240619 | UGGUUAUUAAGUUGCCUCAC | 7965 |
| 54790_3_680 | + | chr4: 105240600-105240620 | GGUUAUUAAGUUGCCUCACU | 7966 |
| 54790_3_684 | + | chr4: 105240634-105240654 | CACAUCUCAUAGAUAAUAUU | 7967 |
| 54790_3_691 | + | chr4: 105240703-105240723 | UCCCACUUUUCCAUCUUUGU | 7968 |
| 54790_3_702 | + | chr4: 105240740-105240760 | UUCUUUUUGCCUGACUCUCC | 7969 |
| 54790_3_713 | + | chr4: 105240784-105240804 | UUCUAAAGUACAUACUAAUA | 7970 |
| 54790_3_714 | + | chr4: 105240785-105240805 | UCUAAAGUACAUACUAAUAU | 7971 |
| 54790_3_717 | + | chr4: 105240790-105240810 | AGUACAUACUAAUAUGGGUC | 7972 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_725 | + | chr4: 105240833-105240853 | AAACAGCAAUUAAAUGUUAU | 7973 |
| 54790_3_727 | + | chr4: 105240834-105240854 | AACAGCAAUUAAAUGUUAUA | 7974 |
| 54790_3_730 | + | chr4: 105240841-105240861 | AUUAAAUGUUAUAGGGAAGU | 7975 |
| 54790_3_736 | + | chr4: 105240851-105240871 | AUAGGGAAGUAGGAAGAAAA | 7976 |
| 54790_3_737 | + | chr4: 105240852-105240872 | UAGGGAAGUAGGAAGAAAAA | 7977 |
| 54790_3_739 | + | chr4: 105240853-105240873 | AGGGAAGUAGGAAGAAAAAG | 7978 |
| 54790_3_742 | + | chr4: 105240885-105240905 | CAAUAAACCAAGCAAUAUUC | 7979 |
| 54790_3_744 | + | chr4: 105240886-105240906 | AAUAAACCAAGCAAUAUUCU | 7980 |
| 54790_3_746 | + | chr4: 105240887-105240907 | AUAAACCAAGCAAUAUUCUG | 7981 |
| 54790_3_747 | + | chr4: 105240888-105240908 | UAAACCAAGCAAUAUUCUGG | 7982 |
| 54790_3_750 | + | chr4: 105240891-105240911 | ACCAAGCAAUAUUCUGGGGG | 7983 |
| 54790_3_751 | + | chr4: 105240892-105240912 | CCAAGCAAUAUUCUGGGGGU | 7984 |
| 54790_3_755 | + | chr4: 105240902-105240922 | UUCUGGGGGUGGGAUAGAGC | 7985 |
| 54790_3_764 | + | chr4: 105240940-105240960 | UCUUUUAAAAUCCAAGUAAU | 7986 |
| 54790_3_765 | + | chr4: 105240944-105240964 | UUAAAAUCCAAGUAAUAGGU | 7987 |
| 54790_3_776 | + | chr4: 105240991-105241011 | UUUUUUCCAGCUCAAAAAAU | 7988 |
| 54790_3_789 | + | chr4: 105241063-105241083 | UUUGUUUAGUUUCAUUUAUU | 7989 |
| 54790_3_813 | + | chr4: 105241146-105241166 | UGUACAUAUACUUAAUUAUG | 7990 |
| 54790_3_831 | + | chr4: 105241237-105241257 | UAGAGCCCUUAAUGUGUAGU | 7991 |
| 54790_3_834 | + | chr4: 105241238-105241258 | AGAGCCCUUAAUGUGUAGUU | 7992 |
| 54790_3_836 | + | chr4: 105241239-105241259 | GAGCCCUUAAUGUGUAGUUG | 7993 |
| 54790_3_837 | + | chr4: 105241240-105241260 | AGCCCUUAAUGUGUAGUUGG | 7994 |
| 54790_3_840 | + | chr4: 105241253-105241273 | UAGUUGGGGUUAAGCUUUG | 7995 |
| 54790_3_846 | + | chr4: 105241283-105241303 | CUUUAUAUUUAGUAUAAUUG | 7996 |
| 54790_3_853 | − | chr4: 105237361-105237381 | CAUGUGUCUCAGUACAUUUC | 7997 |
| 54790_3_857 | − | chr4: 105237392-105237412 | GAAGAUAAAUUUGCUAAUUC | 7998 |
| 54790_3_862 | − | chr4: 105237429-105237449 | ACUCAAGAUUUAAAAAAAGA | 7999 |
| 54790_3_880 | − | chr4: 105237510-105237530 | CUUUCACAAGACACAAGCAU | 8000 |
| 54790_3_890 | − | chr4: 105237558-105237578 | GCACGAUUAUUUAAUUCUUU | 8001 |
| 54790_3_896 | − | chr4: 105237593-105237613 | UUUUACAGGAUCUGAAGAGA | 8002 |
| 54790_3_898 | − | chr4: 105237594-105237614 | AUUUUACAGGAUCUGAAGAG | 8003 |
| 54790_3_904 | − | chr4: 105237607-105237627 | CAGAUACAUUCAAAUUUUAC | 8004 |
| 54790_3_908 | − | chr4: 105237645-105237665 | UAAUAUACAAAGAGCUAAAU | 8005 |
| 54790_3_917 | − | chr4: 105237671-105237691 | UGCUGCCUAGCUGUCUCUCC | 8006 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_930 | - | chr4: 105237727-105237747 | UUCGUACAUUAGACUGCCUA | 8007 |
| 54790_3_953 | - | chr4: 105237874-105237894 | AAUGGAGAAAAGGAAACUUU | 8008 |
| 54790_3_956 | - | chr4: 105237884-105237904 | CAAAUGUAUAAAUGGAGAAA | 8009 |
| 54790_3_961 | - | chr4: 105237892-105237912 | CAACAUUCCAAAUGUAUAAA | 8010 |
| 54790_3_967 | - | chr4: 105237936-105237956 | AGAUGAAAUUUUAGAGAAAA | 8011 |
| 54790_3_969 | - | chr4: 105237937-105237957 | AAGAUGAAAUUUUAGAGAAA | 8012 |
| 54790_3_980 | - | chr4: 105237988-105238008 | GGUUUGGGUGUUAUAGAGAC | 8013 |
| 54790_3_989 | - | chr4: 105238013-105238033 | UAUAAGUAAAAUAACACCAU | 8014 |
| 54790_3_993 | - | chr4: 105238018-105238038 | AACAUUAUAAGUAAAAUAAC | 8015 |
| 54790_3_1022 | - | chr4: 105238180-105238200 | GAUUUCCGGGUCUAUUAACA | 8016 |
| 54790_3_1024 | - | chr4: 105238196-105238216 | UUUUCUAAUCGUGAGUGAUU | 8017 |
| 54790_3_1040 | - | chr4: 105238358-105238378 | UGUCUCUUUAGAAAACACUU | 8018 |
| 54790_3_1051 | - | chr4: 105238410-105238430 | AAAGUUUCUUUAAGACGACA | 8019 |
| 54790_3_1052 | - | chr4: 105238411-105238431 | AAAAGUUUCUUUAAGACGAC | 8020 |
| 54790_3_1059 | - | chr4: 105238445-105238465 | UUCGUCGUCGUGUCAAACUC | 8021 |
| 54790_3_1067 | - | chr4: 105238498-105238518 | UUGACGACUUUACUGUUGUU | 8022 |
| 54790_3_1074 | - | chr4: 105238547-105238567 | ACUUGUUUCUUACAAACUCU | 8023 |
| 54790_3_1084 | - | chr4: 105238571-105238591 | ACUAUUCUUCAACGAAGAAU | 8024 |
| 54790_3_1092 | - | chr4: 105238623-105238643 | UCUUCAUCUCGGACUUCUAC | 8025 |
| 54790_3_1093 | - | chr4: 105238624-105238644 | AUCUUCAUCUCGGACUUCUA | 8026 |
| 54790_3_1095 | - | chr4: 105238625-105238645 | AAUCUUCAUCUCGGACUUCU | 8027 |
| 54790_3_1106 | - | chr4: 105238670-105238690 | CCUCUCCAGUGACGUCUACU | 8028 |
| 54790_3_1108 | - | chr4: 105238671-105238691 | ACCUCUCCAGUGACGUCUAC | 8029 |
| 54790_3_1113 | - | chr4: 105238686-105238706 | UCAAGUUCUGAAGGCACCUC | 8030 |
| 54790_3_1118 | - | chr4: 105238691-105238711 | ACUCCUCAAGUUCUGAAGGC | 8031 |
| 54790_3_1122 | - | chr4: 105238709-105238729 | UUGGGAGUACCUAAUGAAAC | 8032 |
| 54790_3_1129 | - | chr4: 105238721-105238741 | CUUCAACUAAGGUUGGGAGU | 8033 |
| 54790_3_1134 | - | chr4: 105238750-105238770 | CAGUUAUAUAGUUGUAAUUG | 8034 |
| 54790_3_1139 | - | chr4: 105238772-105238792 | GUAAGUAUUAAGUACCCUCC | 8035 |
| 54790_3_1140 | - | chr4: 105238773-105238793 | UGUAAGUAUUAAGUACCCUC | 8036 |
| 54790_3_1142 | - | chr4: 105238774-105238794 | UUGUAAGUAUUAAGUACCCU | 8037 |
| 54790_3_1145 | - | chr4: 105238775-105238795 | CUUGUAAGUAUUAAGUACCC | 8038 |
| 54790_3_1148 | - | chr4: 105238778-105238798 | AUUCUUGUAAGUAUUAAGUA | 8039 |
| 54790_3_1151 | - | chr4: 105238779-105238799 | AAUUCUUGUAAGUAUUAAGU | 8040 |
| 54790_3_1161 | - | chr4: 105238821-105238841 | UGUAACUUUCGGAAGACCUU | 8041 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_1162 | - | chr4: 105238826-105238846 | UUUCAUGUAACUUUCGGAAG | 8042 |
| 54790_3_1167 | - | chr4: 105238850-105238870 | CUAUCAGAAGACUACCUAGG | 8043 |
| 54790_3_1168 | - | chr4: 105238851-105238871 | UCUAUCAGAAGACUACCUAG | 8044 |
| 54790_3_1170 | - | chr4: 105238857-105238877 | GACGGUUCUAUCAGAAGACU | 8045 |
| 54790_3_1186 | - | chr4: 105238934-105238954 | UAAGACGUCGGAUACCUAAU | 8046 |
| 54790_3_1189 | - | chr4: 105238941-105238961 | UUGUAACUAAGACGUCGGAU | 8047 |
| 54790_3_1197 | - | chr4: 105239004-105239024 | AUCAGUGGGUUCUCGAGGCU | 8048 |
| 54790_3_1203 | - | chr4: 105239031-105239051 | AAAGUUUUAUAAUGACGAGU | 8049 |
| 54790_3_1217 | - | chr4: 105239163-105239183 | UCAUUACCUUGUUGUUUCAG | 8050 |
| 54790_3_1221 | - | chr4: 105239178-105239198 | UGGGACGAACACAUCUCAUU | 8051 |
| 54790_3_1231 | - | chr4: 105239224-105239244 | AAUGGUAAGACUUUUAAGGU | 8052 |
| 54790_3_1241 | - | chr4: 105239287-105239307 | GUCCGACUGAGAGAACAAUG | 8053 |
| 54790_3_1244 | - | chr4: 105239306-105239326 | UUACGGAACGAAGUUUCCUG | 8054 |
| 54790_3_1245 | - | chr4: 105239311-105239331 | UUCAGUUACGGAACGAAGUU | 8055 |
| 54790_3_1252 | - | chr4: 105239359-105239379 | UUGUCGGAUGAUAACUUUGU | 8056 |
| 54790_3_1254 | - | chr4: 105239390-105239410 | CGAUUCUAGUGACUACUUCC | 8057 |
| 54790_3_1255 | - | chr4: 105239393-105239413 | GAUCGAUUCUAGUGACUACU | 8058 |
| 54790_3_1262 | - | chr4: 105239460-105239480 | AUUGUAUUUCCUGUUCCAC | 8059 |
| 54790_3_1264 | - | chr4: 105239465-105239485 | GAGAUAUUGUAUUUCCUGU | 8060 |
| 54790_3_1265 | - | chr4: 105239471-105239491 | UCGACAGAGAUAUUGUAUUU | 8061 |
| 54790_3_1275 | - | chr4: 105239515-105239535 | UCAACCUUCGAUCGUCUUCA | 8062 |
| 54790_3_1279 | - | chr4: 105239532-105239552 | CCUUCGACGUCUUCUCUUCA | 8063 |
| 54790_3_1289 | - | chr4: 105239553-105239573 | AGUCAAGAUACUUCUCUUAC | 8064 |
| 54790_3_1298 | - | chr4: 105239588-105239608 | GGUUUCGAAUUAGGUCUCGU | 8065 |
| 54790_3_1305 | - | chr4: 105239645-105239665 | ACCUCUCGCGAAAUCACCAG | 8066 |
| 54790_3_1308 | - | chr4: 105239650-105239670 | ACUAUACCUCUCGCGAAAUC | 8067 |
| 54790_3_1312 | - | chr4: 105239665-105239685 | UUUGCCGGAAUAACGACUAU | 8068 |
| 54790_3_1314 | - | chr4: 105239682-105239702 | ACUUCCAUUCUUUCGUUUU | 8069 |
| 54790_3_1317 | - | chr4: 105239698-105239718 | AUGAGGUCACUUGUGUACUU | 8070 |
| 54790_3_1322 | - | chr4: 105239725-105239745 | ACAUUCCUUUUUAAGAACU | 8071 |
| 54790_3_1329 | - | chr4: 105239740-105239760 | AUCGGUUCAACACUUACAUU | 8072 |
| 54790_3_1333 | - | chr4: 105239777-105239797 | CGGUUCUGUCCGACUUUCGA | 8073 |
| 54790_3_1335 | - | chr4: 105239789-105239809 | CCGUACAGUUUUCGGUUCUG | 8074 |
| 54790_3_1336 | - | chr4: 105239810-105239830 | AUACUGCUCGAUUCACUCCU | 8075 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_1337 | − | chr4: 105239814-105239834 | AUCUAUACUGCUCGAUUCAC | 8076 |
| 54790_3_1348 | − | chr4: 105239871-105239891 | GGAGAUUCACAAGUUCACUU | 8077 |
| 54790_3_1353 | − | chr4: 105239894-105239914 | CGGUUAAUUAUUGGGAUGUC | 8078 |
| 54790_3_1355 | − | chr4: 105239916-105239936 | UUGUGUUGUUAUAACUUUAA | 8079 |
| 54790_3_1360 | − | chr4: 105239955-105239975 | ACCCGAGAGAGGGAGAGGGA | 8080 |
| 54790_3_1361 | − | chr4: 105239956-105239976 | AACCCGAGAGAGGGAGAGGG | 8081 |
| 54790_3_1363 | − | chr4: 105239974-105239994 | CGAGAUAGUUGGUCGGCAAA | 8082 |
| 54790_3_1364 | − | chr4: 105239975-105239995 | ACGAGAUAGUUGGUCGGCAA | 8083 |
| 54790_3_1368 | − | chr4: 105240036-105240056 | GCAUGGGUAUUAGACCAUUU | 8084 |
| 54790_3_1369 | − | chr4: 105240043-105240063 | GUGUUUGGCAUGGGUAUUAG | 8085 |
| 54790_3_1376 | − | chr4: 105240069-105240089 | AAUGAUAAGAUUAAAAACCC | 8086 |
| 54790_3_1379 | − | chr4: 105240070-105240090 | CAAUGAUAAGAUUAAAAACC | 8087 |
| 54790_3_1381 | − | chr4: 105240071-105240091 | ACAAUGAUAAGAUUAAAAAC | 8088 |
| 54790_3_1382 | − | chr4: 105240072-105240092 | UACAAUGAUAAGAUUAAAAA | 8089 |
| 54790_3_1384 | − | chr4: 105240073-105240093 | CUACAAUGAUAAGAUUAAAA | 8090 |
| 54790_3_1396 | − | chr4: 105240118-105240138 | CAAAUAAUAAUAAAUACAAU | 8091 |
| 54790_3_1403 | − | chr4: 105240162-105240182 | GUACAGAGACAUAGUGUAAA | 8092 |
| 54790_3_1416 | − | chr4: 105240245-105240265 | AAAAUGUUUGACUUCCAAAC | 8093 |
| 54790_3_1418 | − | chr4: 105240252-105240272 | GACACUGAAAAUGUUUGACU | 8094 |
| 54790_3_1437 | − | chr4: 105240320-105240340 | AAAGCUUUUUUUAAAAAUAG | 8095 |
| 54790_3_1458 | − | chr4: 105240511-105240531 | AGGGAAAACAUGGCACGGGU | 8096 |
| 54790_3_1460 | − | chr4: 105240515-105240535 | CAAGAGGGAAAACAUGGCAC | 8097 |
| 54790_3_1461 | − | chr4: 105240516-105240536 | GCAAGAGGGAAAACAUGGCA | 8098 |
| 54790_3_1463 | − | chr4: 105240521-105240541 | UCAUUGCAAGAGGGAAAACA | 8099 |
| 54790_3_1465 | − | chr4: 105240530-105240550 | UGGGGUAUCUCAUUGCAAGA | 8100 |
| 54790_3_1467 | − | chr4: 105240531-105240551 | GUGGGGUAUCUCAUUGCAAG | 8101 |
| 54790_3_1471 | − | chr4: 105240548-105240568 | CCAUCCUUCUACACAGUGUG | 8102 |
| 54790_3_1472 | − | chr4: 105240549-105240569 | UCCAUCCUUCUACACAGUGU | 8103 |
| 54790_3_1473 | − | chr4: 105240550-105240570 | CUCCAUCCUUCUACACAGUG | 8104 |
| 54790_3_1476 | − | chr4: 105240581-105240601 | CACACGCAAAGAGGGACAGU | 8105 |
| 54790_3_1480 | − | chr4: 105240589-105240609 | UUAAUAACCACACGCAAAGA | 8106 |
| 54790_3_1481 | − | chr4: 105240590-105240610 | CUUAAUAACCACACGCAAAG | 8107 |
| 54790_3_1488 | − | chr4: 105240616-105240636 | UGUGGUGUUUUAGCCCAGUG | 8108 |
| 54790_3_1491 | − | chr4: 105240634-105240654 | AAUAUUAUCUAUGAGAUGUG | 8109 |
| 54790_3_1500 | − | chr4: 105240693-105240713 | AAAAGUGGGAAGAUAGGGGU | 8110 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_3_1501 | - | chr4: 105240694-105240714 | GAAAAGUGGGAAGAUAGGGG | 8111 |
| 54790_3_1503 | - | chr4: 105240697-105240717 | AUGGAAAAGUGGGAAGAUAG | 8112 |
| 54790_3_1504 | - | chr4: 105240698-105240718 | GAUGGAAAAGUGGGAAGAUA | 8113 |
| 54790_3_1505 | - | chr4: 105240699-105240719 | AGAUGGAAAAGUGGGAAGAU | 8114 |
| 54790_3_1509 | - | chr4: 105240707-105240727 | ACCAACAAAGAUGGAAAAGU | 8115 |
| 54790_3_1512 | - | chr4: 105240708-105240728 | AACCAACAAAGAUGGAAAAG | 8116 |
| 54790_3_1514 | - | chr4: 105240716-105240736 | CUGUUGCAAACCAACAAAGA | 8117 |
| 54790_3_1517 | - | chr4: 105240739-105240759 | GAGAGUCAGGCAAAAAGAAG | 8118 |
| 54790_3_1518 | - | chr4: 105240740-105240760 | GGAGAGUCAGGCAAAAAGAA | 8119 |
| 54790_3_1519 | - | chr4: 105240741-105240761 | UGGAGAGUCAGGCAAAAAGA | 8120 |
| 54790_3_1524 | - | chr4: 105240752-105240772 | AGAGAAAUCCUGGAGAGUC | 8121 |
| 54790_3_1529 | - | chr4: 105240761-105240781 | UUUAUGAUGAGAAAAUCC | 8122 |
| 54790_3_1557 | - | chr4: 105240882-105240902 | UAUUGCUUGGUUUAUUGUCA | 8123 |
| 54790_3_1559 | - | chr4: 105240895-105240915 | CCCACCCCCAGAAUAUUGCU | 8124 |
| 54790_3_1569 | - | chr4: 105240954-105240974 | CUGGAAGCCUACCUAUUACU | 8125 |
| 54790_3_1574 | - | chr4: 105240973-105240993 | AAAAAACAUUUAAAGCUAAC | 8126 |
| 54790_3_1581 | - | chr4: 105241000-105241020 | UACAAUCCAAUUUUUUGAGC | 8127 |
| 54790_3_1588 | - | chr4: 105241052-105241072 | CUAAACAAAGAAUACAGUGA | 8128 |
| 54790_3_1591 | - | chr4: 105241053-105241073 | ACUAAACAAAGAAUACAGUG | 8129 |
| 54790_3_1603 | - | chr4: 105241107-105241127 | AUAUAUUACAUUUCAGAUAU | 8130 |
| 54790_3_1605 | - | chr4: 105241108-105241128 | AAUAUAUUACAUUUCAGAUA | 8131 |
| 54790_3_1610 | - | chr4: 105241136-105241156 | UAUAUGUACAUGCUGGUUGU | 8132 |
| 54790_3_1612 | - | chr4: 105241143-105241163 | AAUUAAGUAUAUGUACAUGC | 8133 |
| 54790_3_1623 | - | chr4: 105241193-105241213 | CUUUAAAAUGAGUAGAUUGA | 8134 |
| 54790_3_1633 | - | chr4: 105241245-105241265 | AACCCCCAACUACACAUUAA | 8135 |
| 54790_3_1634 | - | chr4: 105241246-105241266 | UAACCCCCAACUACACAUUA | 8136 |
| 54790_3_1637 | - | chr4: 105241285-105241305 | CUCAAUUAUACUAAAUAUAA | 8137 |
| 54790_4_1 | + | chr4: 105241422-105241442 | AAGAAAGGUAAUUAACGCAA | 8138 |
| 54790_4_3 | + | chr4: 105241428-105241448 | GGUAAUUAACGCAAAGGCAC | 8139 |
| 54790_4_4 | + | chr4: 105241429-105241449 | GUAAUUAACGCAAAGGCACA | 8140 |
| 54790_4_21 | + | chr4: 105241523-105241543 | UAAAUUGAGUAAUUAUUAGU | 8141 |
| 54790_4_25 | + | chr4: 105241538-105241558 | UUAGUAGGCUUAGCUAUUCU | 8142 |
| 54790_4_26 | + | chr4: 105241539-105241559 | UAGUAGGCUUAGCUAUUCUA | 8143 |
| 54790_4_35 | + | chr4: 105241592-105241612 | AGAGAGUCACAAUAUUUGAC | 8144 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_4_38 | + | chr4: 105241612-105241632 | AGGACUAAUAGUCUGCUAGC | 8145 |
| 54790_4_39 | + | chr4: 105241618-105241638 | AAUAGUCUGCUAGCUGGCAC | 8146 |
| 54790_4_41 | + | chr4: 105241636-105241656 | ACAGGCUGCCCACUUUGCGA | 8147 |
| 54790_4_45 | + | chr4: 105241653-105241673 | CGAUGGAUGCCAGAAAACCC | 8148 |
| 54790_4_50 | + | chr4: 105241663-105241683 | CAGAAAACCCAGGCAUGAAC | 8149 |
| 54790_4_51 | + | chr4: 105241669-105241689 | ACCCAGGCAUGAACAGGAAU | 8150 |
| 54790_4_52 | + | chr4: 105241678-105241698 | UGAACAGGAAUCGGCCAGCC | 8151 |
| 54790_4_53 | + | chr4: 105241693-105241713 | CAGCCAGGCUGCCAGCCACA | 8152 |
| 54790_4_54 | + | chr4: 105241699-105241719 | GGCUGCCAGCCACAAGGUAC | 8153 |
| 54790_4_55 | + | chr4: 105241705-105241725 | CAGCCACAAGGUACUGGCAC | 8154 |
| 54790_4_58 | + | chr4: 105241718-105241738 | CUGGCACAGGCUCCAACGAG | 8155 |
| 54790_4_59 | + | chr4: 105241729-105241749 | UCCAACGAGAGGUCCCACUC | 8156 |
| 54790_4_64 | + | chr4: 105241770-105241790 | AAGUGUCAAAGCAGAAAGAC | 8157 |
| 54790_4_65 | + | chr4: 105241780-105241800 | GCAGAAAGACUGGUAAAGUG | 8158 |
| 54790_4_98 | + | chr4: 105241946-105241966 | UUUUUUUCGCUAUCAAUCAC | 8159 |
| 54790_4_115 | + | chr4: 105242012-105242032 | UGAGCGAGAUAAUGCAGAGA | 8160 |
| 54790_4_123 | + | chr4: 105242057-105242077 | CUCUGAGCUGUUCUUCUUCU | 8161 |
| 54790_4_124 | + | chr4: 105242058-105242078 | UCUGAGCUGUUCUUCUUCUA | 8162 |
| 54790_4_129 | + | chr4: 105242076-105242096 | UAGGGUGCCUUUUCAUUAAG | 8163 |
| 54790_4_130 | + | chr4: 105242080-105242100 | GUGCCUUUUCAUUAAGAGGU | 8164 |
| 54790_4_136 | + | chr4: 105242105-105242125 | GUAUUAUUAUUAAAGUACUU | 8165 |
| 54790_4_141 | + | chr4: 105242114-105242134 | UUAAAGUACUUAGGAUACAU | 8166 |
| 54790_4_142 | + | chr4: 105242115-105242135 | UAAAGUACUUAGGAUACAUU | 8167 |
| 54790_4_143 | + | chr4: 105242116-105242136 | AAAGUACUUAGGAUACAUUG | 8168 |
| 54790_4_146 | + | chr4: 105242124-105242144 | UAGGAUACAUUGGGGCAGCU | 8169 |
| 54790_4_160 | + | chr4: 105242210-105242230 | UUCACUAAAUAAUCAUCUAG | 8170 |
| 54790_4_162 | + | chr4: 105242215-105242235 | UAAAUAAUCAUCUAGUGGCC | 8171 |
| 54790_4_182 | + | chr4: 105242287-105242307 | UUGUUUUUAAACAAGCAGU | 8172 |
| 54790_4_186 | + | chr4: 105242290-105242310 | UUUUUUAAACAAGCAGUAGG | 8173 |
| 54790_4_192 | + | chr4: 105242298-105242318 | ACAAGCAGUAGGUGGUGCUU | 8174 |
| 54790_4_194 | + | chr4: 105242306-105242326 | UAGGUGGUGCUUUGGUCAUA | 8175 |
| 54790_4_197 | + | chr4: 105242307-105242327 | AGGUGGUGCUUUGGUCAUAA | 8176 |
| 54790_4_201 | + | chr4: 105242328-105242348 | GGAAGAUAUAGUCUAUUUCU | 8177 |
| 54790_4_204 | + | chr4: 105242351-105242371 | ACUAUUCCAUAUUUCCAUG | 8178 |
| 54790_4_206 | + | chr4: 105242355-105242375 | UUCCAUAUUUCCAUGUGGC | 8179 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_4_215 | + | chr4: 105242404-105242424 | UCUAAAUUGUGAGACAUUCU | 8180 |
| 54790_4_221 | + | chr4: 105242407-105242427 | AAAUUGUGAGACAUUCUUGG | 8181 |
| 54790_4_229 | + | chr4: 105242469-105242489 | UAAAAUAGCUAAAUUUAGUA | 8182 |
| 54790_4_233 | + | chr4: 105242470-105242490 | AAAAUAGCUAAAUUUAGUAA | 8183 |
| 54790_4_270 | + | chr4: 105242625-105242645 | AUCUGUACAUUUUGAUAUUG | 8184 |
| 54790_4_272 | + | chr4: 105242635-105242655 | UUUGAUAUUGAGGAAAAACA | 8185 |
| 54790_4_278 | + | chr4: 105242663-105242683 | AAACCAUUAUCCAGUUUGCU | 8186 |
| 54790_4_286 | + | chr4: 105242705-105242725 | UAAUAAACCGUUCAUUUCUC | 8187 |
| 54790_4_287 | + | chr4: 105242711-105242731 | ACCGUUCAUUUCUCAGGAUG | 8188 |
| 54790_4_308 | − | chr4: 105241470-105241490 | AAAAUUCUGACAUAUACAAA | 8189 |
| 54790_4_315 | − | chr4: 105241494-105241514 | ACUGCUUUGUGUGUGAAGGC | 8190 |
| 54790_4_318 | − | chr4: 105241498-105241518 | GUUUACUGCUUUGUGUGUGA | 8191 |
| 54790_4_325 | − | chr4: 105241568-105241588 | AAUAGCACAGUGUGUAGUGU | 8192 |
| 54790_4_328 | − | chr4: 105241593-105241613 | UGUCAAAUAUUGUGACUCUC | 8193 |
| 54790_4_333 | − | chr4: 105241647-105241667 | UCUGGCAUCCAUCGCAAAGU | 8194 |
| 54790_4_334 | − | chr4: 105241648-105241668 | UUCUGGCAUCCAUCGCAAAG | 8195 |
| 54790_4_338 | − | chr4: 105241665-105241685 | CUGUUCAUGCCUGGGUUUUC | 8196 |
| 54790_4_339 | − | chr4: 105241673-105241693 | GCCGAUUCCUGUUCAUGCCU | 8197 |
| 54790_4_340 | − | chr4: 105241674-105241694 | GGCCGAUUCCUGUUCAUGCC | 8198 |
| 54790_4_343 | − | chr4: 105241695-105241715 | CUUGUGGCUGGCAGCCUGGC | 8199 |
| 54790_4_344 | − | chr4: 105241699-105241719 | GUACCUUGUGGCUGGCAGCC | 8200 |
| 54790_4_345 | − | chr4: 105241707-105241727 | CUGUGCCAGUACCUUGUGGC | 8201 |
| 54790_4_347 | − | chr4: 105241711-105241731 | GAGCCUGUGCCAGUACCUUG | 8202 |
| 54790_4_348 | − | chr4: 105241733-105241753 | GCCAGAGUGGGACCUCUCGU | 8203 |
| 54790_4_352 | − | chr4: 105241745-105241765 | UCAGGUGGGAAAGCCAGAGU | 8204 |
| 54790_4_355 | − | chr4: 105241746-105241766 | AUCAGGUGGGAAAGCCAGAG | 8205 |
| 54790_4_361 | − | chr4: 105241759-105241779 | UUGACACUUUAUUAUCAGGU | 8206 |
| 54790_4_363 | − | chr4: 105241760-105241780 | UUUGACACUUUAUUAUCAGG | 8207 |
| 54790_4_368 | − | chr4: 105241763-105241783 | UGCUUUGACACUUUAUUAUC | 8208 |
| 54790_4_379 | − | chr4: 105241819-105241839 | ACUAGGUGAAUUUAAUUCAG | 8209 |
| 54790_4_383 | − | chr4: 105241836-105241856 | AAGUACUCAUUUGCAACACU | 8210 |
| 54790_4_392 | − | chr4: 105241878-105241898 | UCACACUUGCUCUCUUUUUA | 8211 |
| 54790_4_399 | − | chr4: 105241939-105241959 | AUAGCGAAAAAAAAAAAAAA | 8212 |
| 54790_4_403 | − | chr4: 105241986-105242006 | UCUUCUACAUGCAGGAGUAA | 8213 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_4_405 | − | chr4: 105241994-105242014 | CAUAAGAGUCUUCUACAUGC | 8214 |
| 54790_4_412 | − | chr4: 105242038-105242058 | GCUGUAUAAAUUUAUAUGAA | 8215 |
| 54790_4_422 | − | chr4: 105242086-105242106 | CUGCCUACCUCUUAAUGAAA | 8216 |
| 54790_4_433 | − | chr4: 105242173-105242193 | AGAAAUGAAUAAUUUGGAAA | 8217 |
| 54790_4_436 | − | chr4: 105242179-105242199 | UAAUUUAGAAAUGAAUAAUU | 8218 |
| 54790_4_449 | − | chr4: 105242236-105242256 | GGAAAUUCACUAUUUCUGCC | 8219 |
| 54790_4_450 | − | chr4: 105242257-105242277 | GUUGUUUUUUUGGCACUUA | 8220 |
| 54790_4_452 | − | chr4: 105242258-105242278 | UGUUGUUUUUUUGGCACUU | 8221 |
| 54790_4_455 | − | chr4: 105242266-105242286 | UGUUUUUUGUUGUUUUUU | 8222 |
| 54790_4_464 | − | chr4: 105242360-105242380 | AUCCAGCCACAUGGAAAAUA | 8223 |
| 54790_4_466 | − | chr4: 105242369-105242389 | AUAGUUAGUAUCCAGCCACA | 8224 |
| 54790_4_471 | − | chr4: 105242395-105242415 | CACAAUUUAGAAAAGGAGGC | 8225 |
| 54790_4_472 | − | chr4: 105242399-105242419 | GUCUCACAAUUUAGAAAAGG | 8226 |
| 54790_4_474 | − | chr4: 105242402-105242422 | AAUGUCUCACAAUUUAGAAA | 8227 |
| 54790_4_491 | − | chr4: 105242462-105242482 | UUUAGCUAUUUUAAAACUUG | 8228 |
| 54790_4_493 | − | chr4: 105242463-105242483 | AUUUAGCUAUUUUAAAACUU | 8229 |
| 54790_4_496 | − | chr4: 105242464-105242484 | AAUUUAGCUAUUUUAAAACU | 8230 |
| 54790_4_512 | − | chr4: 105242539-105242559 | UUUCACAAAGCACAAAAUUC | 8231 |
| 54790_4_518 | − | chr4: 105242583-105242603 | AAUUACAUGUGGGUGAAAAU | 8232 |
| 54790_4_520 | − | chr4: 105242584-105242604 | AAAUUACAUGUGGGUGAAAA | 8233 |
| 54790_4_525 | − | chr4: 105242593-105242613 | CUAUUUUGUAAAUUACAUGU | 8234 |
| 54790_4_526 | − | chr4: 105242594-105242614 | ACUAUUUUGUAAAUUACAUG | 8235 |
| 54790_4_539 | − | chr4: 105242669-105242689 | ACGCCAAGCAAACUGGAUAA | 8236 |
| 54790_4_541 | − | chr4: 105242676-105242696 | CAGGUCUACGCCAAGCAAAC | 8237 |
| 54790_4_550 | − | chr4: 105242695-105242715 | CGGUUUAUUAUUUUUUAAAC | 8238 |
| 54790_4_551 | − | chr4: 105242715-105242735 | ACCACAUCCUGAGAAAUGAA | 8239 |
| 54790_4_566 | − | chr4: 105242780-105242800 | AAUUAGCAAAUGAAUUCAAG | 8240 |
| 54790_5_2 | + | chr4: 105242931-105242951 | GUGUGACUUGAUAAAGCCUU | 8241 |
| 54790_5_5 | + | chr4: 105242944-105242964 | AAGCCUUUGGUCUUAAAUCU | 8242 |
| 54790_5_6 | + | chr4: 105242945-105242965 | AGCCUUUGGUCUUAAAUCUU | 8243 |
| 54790_5_18 | + | chr4: 105242979-105242999 | GUAAAUCUGACCCUGAGAAU | 8244 |
| 54790_5_20 | + | chr4: 105242980-105243000 | UAAAUCUGACCCUGAGAAUU | 8245 |
| 54790_5_34 | + | chr4: 105243059-105243079 | AUGUGUUAUCUCUUAAGAAG | 8246 |
| 54790_5_45 | + | chr4: 105243115-105243135 | AUUGAAUAAUUUAGUGAUG | 8247 |
| 54790_5_49 | + | chr4: 105243121-105243141 | AUAAUUUAGUGAUGAGGAAG | 8248 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_5_73 | + | chr4: 105243263-105243283 | AUGUAUCUUUCAUCUAGCUC | 8249 |
| 54790_5_77 | + | chr4: 105243275-105243295 | UCUAGCUCUGGUUUUAAUGC | 8250 |
| 54790_5_82 | + | chr4: 105243303-105243323 | UUUAAUUGUCCCCACUGUAC | 8251 |
| 54790_5_83 | + | chr4: 105243304-105243324 | UUAAUUGUCCCCACUGUACU | 8252 |
| 54790_5_89 | + | chr4: 105243326-105243346 | GUAUAGUCUGCUAAACAUUA | 8253 |
| 54790_5_95 | + | chr4: 105243361-105243381 | UCUCUCCUUGUUCUGAUACU | 8254 |
| 54790_5_96 | + | chr4: 105243362-105243382 | CUCUCCUUGUUCUGAUACUA | 8255 |
| 54790_5_100 | + | chr4: 105243386-105243406 | CAAAGCCCACUUUUUAUAGA | 8256 |
| 54790_5_101 | + | chr4: 105243387-105243407 | AAAGCCCACUUUUUAUAGAU | 8257 |
| 54790_5_102 | + | chr4: 105243397-105243417 | UUUUAUAGAUGGGCAGCAAA | 8258 |
| 54790_5_108 | + | chr4: 105243405-105243425 | AUGGGCAGCAAAAGGCACAU | 8259 |
| 54790_5_113 | + | chr4: 105243504-105243524 | AAGUGACCCUUGUUUUGUUU | 8260 |
| 54790_5_116 | + | chr4: 105243508-105243528 | GACCCUUGUUUUGUUUUGGU | 8261 |
| 54790_5_117 | + | chr4: 105243509-105243529 | ACCCUUGUUUUGUUUUGGUU | 8262 |
| 54790_5_118 | + | chr4: 105243510-105243530 | CCCUUGUUUUGUUUUGGUUG | 8263 |
| 54790_5_121 | + | chr4: 105243513-105243533 | UUGUUUUGUUUUGGUUGGGG | 8264 |
| 54790_5_122 | + | chr4: 105243514-105243534 | UGUUUUGUUUUGGUUGGGGU | 8265 |
| 54790_5_124 | + | chr4: 105243515-105243535 | GUUUUGUUUUGGUUGGGGUG | 8266 |
| 54790_5_126 | + | chr4: 105243516-105243536 | UUUUGUUUUGGUUGGGGUGG | 8267 |
| 54790_5_128 | + | chr4: 105243517-105243537 | UUUGUUUUGGUUGGGGUGGG | 8268 |
| 54790_5_133 | + | chr4: 105243524-105243544 | UGGUUGGGGUGGGGGUGUU | 8269 |
| 54790_5_136 | + | chr4: 105243525-105243545 | GGUUGGGGUGGGGGUGUUU | 8270 |
| 54790_5_141 | + | chr4: 105243529-105243549 | GGGGUGGGGGUGUUUGGGA | 8271 |
| 54790_5_143 | – | chr4: 105242915-105242935 | ACACUUACCCACUUAGCAAU | 8272 |
| 54790_5_148 | – | chr4: 105242950-105242970 | UGCCCAAGAUUUAAGACCAA | 8273 |
| 54790_5_154 | – | chr4: 105242992-105243012 | UCUGGGUAACCCAAUUCUCA | 8274 |
| 54790_5_155 | – | chr4: 105242993-105243013 | AUCUGGGUAACCCAAUUCUC | 8275 |
| 54790_5_159 | – | chr4: 105243009-105243029 | CUGGCAUGAGUCUUUGAUCU | 8276 |
| 54790_5_162 | – | chr4: 105243010-105243030 | ACUGGCAUGAGUCUUUGAUC | 8277 |
| 54790_5_166 | – | chr4: 105243028-105243048 | CAGGUAAUGUUCUUUUUAAC | 8278 |
| 54790_5_167 | – | chr4: 105243047-105243067 | UAACACAUGAUAAAAAAUAC | 8279 |
| 54790_5_187 | – | chr4: 105243148-105243168 | ACAUUUAGCAGGCACUAGAA | 8280 |
| 54790_5_191 | – | chr4: 105243159-105243179 | AGAAGGAUUAUACAUUUAGC | 8281 |
| 54790_5_194 | – | chr4: 105243176-105243196 | GACAACUUCACAUUCUAAGA | 8282 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_5_202 | − | chr4: 105243198-105243218 | UGAAGGUAUUUAAAAGUUUA | 8283 |
| 54790_5_204 | − | chr4: 105243215-105243235 | ACAAUAUAAAGAUUAACUGA | 8284 |
| 54790_5_211 | − | chr4: 105243250-105243270 | GAUACAUAAGUCUUAGUUCA | 8285 |
| 54790_5_218 | − | chr4: 105243315-105243335 | AGACUAUACCCAGUACAGUG | 8286 |
| 54790_5_219 | − | chr4: 105243316-105243336 | CAGACUAUACCCAGUACAGU | 8287 |
| 54790_5_222 | − | chr4: 105243317-105243337 | GCAGACUAUACCCAGUACAG | 8288 |
| 54790_5_228 | − | chr4: 105243369-105243389 | UUGACCCUAGUAUCAGAACA | 8289 |
| 54790_5_236 | − | chr4: 105243394-105243414 | GCUGCCCAUCUAUAAAAGU | 8290 |
| 54790_5_237 | − | chr4: 105243395-105243415 | UGCUGCCCAUCUAUAAAAG | 8291 |
| 54790_5_247 | − | chr4: 105243449-105243469 | UCAUGUUUAGAUCACAAUUA | 8292 |
| 54790_5_248 | − | chr4: 105243450-105243470 | AUCAUGUUUAGAUCACAAUU | 8293 |
| 54790_5_252 | − | chr4: 105243493-105243513 | GGGUCACUUGCAGCAGAUAA | 8294 |
| 54790_5_253 | − | chr4: 105243494-105243514 | AGGGUCACUUGCAGCAGAUA | 8295 |
| 54790_5_255 | − | chr4: 105243513-105243533 | CCCCAACCAAAACAAAACAA | 8296 |
| 54790_5_256 | − | chr4: 105243514-105243534 | ACCCCAACCAAAACAAAACA | 8297 |
| 54790_6_3 | + | chr4: 105243771-105243791 | AUGAAGAGUAAGUGAAGCCC | 8298 |
| 54790_6_4 | + | chr4: 105243772-105243792 | UGAAGAGUAAGUGAAGCCCA | 8299 |
| 54790_6_5 | + | chr4: 105243790-105243810 | CAGGGCCUCUCCCCUCUUUG | 8300 |
| 54790_6_7 | + | chr4: 105243801-105243821 | CCCUCUUUGCGGCCACUGAU | 8301 |
| 54790_6_11 | + | chr4: 105243817-105243837 | UGAUAGGAAAGCCCAAUCUU | 8302 |
| 54790_6_14 | + | chr4: 105243825-105243845 | AAGCCCAAUCUUUGGUUGAA | 8303 |
| 54790_6_23 | + | chr4: 105243863-105243883 | GCACUUUUACAUUUAUAAAA | 8304 |
| 54790_6_24 | + | chr4: 105243864-105243884 | CACUUUUACAUUUAUAAAAU | 8305 |
| 54790_6_30 | + | chr4: 105243883-105243903 | UGGGCAUCAAAAUGCCUGUU | 8306 |
| 54790_6_45 | + | chr4: 105243972-105243992 | GUACAGUUUAGCCAUUAAUU | 8307 |
| 54790_6_53 | + | chr4: 105244000-105244020 | UCAGAGUGUCUGUAACCACA | 8308 |
| 54790_6_60 | + | chr4: 105244057-105244077 | UGCUCACAUGCUACAAGUGA | 8309 |
| 54790_6_61 | + | chr4: 105244072-105244092 | AGUGACGGCUCCUGUGUGCC | 8310 |
| 54790_6_73 | + | chr4: 105244151-105244171 | GUAAGUCUAAUGAGAAACUU | 8311 |
| 54790_6_75 | + | chr4: 105244152-105244172 | UAAGUCUAAUGAGAAACUUU | 8312 |
| 54790_6_76 | + | chr4: 105244161-105244181 | UGAGAAACUUUGGGAUUCCC | 8313 |
| 54790_6_102 | + | chr4: 105244325-105244345 | CUAAAUGAUCAGCAAAUUAC | 8314 |
| 54790_6_104 | + | chr4: 105244331-105244351 | GAUCAGCAAAUUACUGGAUA | 8315 |
| 54790_6_107 | + | chr4: 105244350-105244370 | AUGGAUAUAUAUUAUUUCC | 8316 |
| 54790_6_135 | + | chr4: 105244470-105244490 | AUGAAGUCUAAACCUUCAGU | 8317 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_147 | + | chr4: 105244548-105244568 | AAAGAAUAGAUGAAUGUUCA | 8318 |
| 54790_6_161 | + | chr4: 105244596-105244616 | UUUUUUUUUUUUUUUUGAGA | 8319 |
| 54790_6_180 | + | chr4: 105244618-105244638 | GAGUUUCGCUCUUGUUGCCC | 8320 |
| 54790_6_183 | + | chr4: 105244622-105244642 | UUCGCUCUUGUUGCCCAGGC | 8321 |
| 54790_6_187 | + | chr4: 105244632-105244652 | UUGCCCAGGCUGGAGUGCAA | 8322 |
| 54790_6_189 | + | chr4: 105244643-105244663 | GGAGUGCAAUGGCGCGAUCU | 8323 |
| 54790_6_191 | + | chr4: 105244668-105244688 | CACCGCGACCUCCACCUCCC | 8324 |
| 54790_6_197 | + | chr4: 105244707-105244727 | GCCUCAGCCUCCCUAGUAGC | 8325 |
| 54790_6_199 | + | chr4: 105244708-105244728 | CCUCAGCCUCCCUAGUAGCU | 8326 |
| 54790_6_200 | + | chr4: 105244716-105244736 | UCCCUAGUAGCUGGGAUUAC | 8327 |
| 54790_6_201 | + | chr4: 105244735-105244755 | CAGGCAUGUGCCACCACACC | 8328 |
| 54790_6_205 | + | chr4: 105244763-105244783 | UUUGUAUUUUUAGUAGAGAC | 8329 |
| 54790_6_206 | + | chr4: 105244764-105244784 | UUGUAUUUUUAGUAGAGACA | 8330 |
| 54790_6_214 | + | chr4: 105244778-105244798 | GAGACAGGGUUUCUCCAUGU | 8331 |
| 54790_6_215 | + | chr4: 105244783-105244803 | AGGGUUUCUCCAUGUUGGUC | 8332 |
| 54790_6_216 | + | chr4: 105244787-105244807 | UUUCUCCAUGUUGGUCAGGC | 8333 |
| 54790_6_221 | + | chr4: 105244808-105244828 | GGUCUCGAACUCCCGACCUC | 8334 |
| 54790_6_222 | + | chr4: 105244824-105244844 | CCUCAGGUGAUUGCCCACCU | 8335 |
| 54790_6_224 | + | chr4: 105244845-105244865 | GGCCUCCCAAAGUGCCUUAC | 8336 |
| 54790_6_227 | + | chr4: 105244864-105244884 | CAGGCAUGAGCCGCCGCGCC | 8337 |
| 54790_6_230 | + | chr4: 105244899-105244919 | CAAGUUAUUUUGCCCACGAU | 8338 |
| 54790_6_267 | + | chr4: 105245061-105245081 | GUUUAAAACUCUAACUAGCA | 8339 |
| 54790_6_276 | + | chr4: 105245099-105245119 | GUUAACACAGUUUCUCUCUC | 8340 |
| 54790_6_277 | + | chr4: 105245100-105245120 | UUAACACAGUUUCUCUCUCU | 8341 |
| 54790_6_280 | + | chr4: 105245106-105245126 | CAGUUUCUCUCUCUGGGUUG | 8342 |
| 54790_6_282 | + | chr4: 105245107-105245127 | AGUUUCUCUCUCUGGGUUGU | 8343 |
| 54790_6_284 | + | chr4: 105245108-105245128 | GUUUCUCUCUCUGGGUUGUG | 8344 |
| 54790_6_301 | + | chr4: 105245208-105245228 | AUUAUGAUCCAAAAAUUUUA | 8345 |
| 54790_6_308 | + | chr4: 105245243-105245263 | CACUUUUACAAAUGAUUAAU | 8346 |
| 54790_6_309 | + | chr4: 105245247-105245267 | UUUACAAAUGAUUAAUUGGA | 8347 |
| 54790_6_320 | + | chr4: 105245292-105245312 | UGUAACUUAUAAACUUAUGA | 8348 |
| 54790_6_341 | + | chr4: 105245353-105245373 | AGAGUUUCACUCUGUCACCC | 8349 |
| 54790_6_344 | + | chr4: 105245357-105245377 | UUUCACUCUGUCACCCAGGC | 8350 |
| 54790_6_347 | + | chr4: 105245367-105245387 | UCACCCAGGCUGGAGUGCAA | 8351 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_348 | + | chr4: 105245378-105245398 | GGAGUGCAAUGGUGCGAUCU | 8352 |
| 54790_6_350 | + | chr4: 105245402-105245422 | UCACUGCAACCUCCAUCUCC | 8353 |
| 54790_6_351 | + | chr4: 105245403-105245423 | CACUGCAACCUCCAUCUCCU | 8354 |
| 54790_6_356 | + | chr4: 105245442-105245462 | GCCUCAGCCUCCCGAAUAGC | 8355 |
| 54790_6_358 | + | chr4: 105245443-105245463 | CCUCAGCCUCCCGAAUAGCU | 8356 |
| 54790_6_359 | + | chr4: 105245451-105245471 | UCCCGAAUAGCUGGGAUUAC | 8357 |
| 54790_6_363 | + | chr4: 105245498-105245518 | UUUGUAUUUUAGUAGAGAC | 8358 |
| 54790_6_364 | + | chr4: 105245499-105245519 | UUGUAUUUUAGUAGAGACA | 8359 |
| 54790_6_372 | + | chr4: 105245518-105245538 | AGGGUUUCUCCAUGUUGAUC | 8360 |
| 54790_6_373 | + | chr4: 105245522-105245542 | UUUCUCCAUGUUGAUCAGGC | 8361 |
| 54790_6_378 | + | chr4: 105245527-105245547 | CCAUGUUGAUCAGGCUGGUC | 8362 |
| 54790_6_381 | + | chr4: 105245542-105245562 | UGGUCUGGAACUCCUGACCU | 8363 |
| 54790_6_382 | + | chr4: 105245543-105245563 | GGUCUGGAACUCCUGACCUC | 8364 |
| 54790_6_383 | + | chr4: 105245560-105245580 | CUCGGGUGAUCCGCCCGCCU | 8365 |
| 54790_6_387 | + | chr4: 105245576-105245596 | GCCUCGGCCUCCCAGAGUGC | 8366 |
| 54790_6_388 | + | chr4: 105245577-105245597 | CCUCGGCCUCCCAGAGUGCU | 8367 |
| 54790_6_389 | + | chr4: 105245585-105245605 | UCCCAGAGUGCUGGGAUUAC | 8368 |
| 54790_6_405 | + | chr4: 105245678-105245698 | AAAUUUUAAAAAUGUAUGU | 8369 |
| 54790_6_414 | + | chr4: 105245712-105245732 | AGAAAAAAAUUAAAAAUUA | 8370 |
| 54790_6_417 | + | chr4: 105245731-105245751 | AAGGCAACUUGUGCUCAUAU | 8371 |
| 54790_6_429 | + | chr4: 105245803-105245823 | AUAAUAUCUCUUAGACUUGA | 8372 |
| 54790_6_451 | + | chr4: 105245911-105245931 | UUGAUUUCUUGAAGUUUCC | 8373 |
| 54790_6_477 | + | chr4: 105246002-105246022 | UCACCACAACCUCCACCUCC | 8374 |
| 54790_6_478 | + | chr4: 105246003-105246023 | CACCACAACCUCCACCUCCC | 8375 |
| 54790_6_484 | + | chr4: 105246051-105246071 | UCCCGAGUAGCUAGAAUUAC | 8376 |
| 54790_6_485 | + | chr4: 105246062-105246082 | UAGAAUUACAGGCACCCACC | 8377 |
| 54790_6_489 | + | chr4: 105246091-105246111 | UUUGUAUUUUAGUAGAGAC | 8378 |
| 54790_6_491 | + | chr4: 105246092-105246112 | UUGUAUUUUAGUAGAGACA | 8379 |
| 54790_6_499 | + | chr4: 105246106-105246126 | GAGACAGGGUUUCACCAUGU | 8380 |
| 54790_6_504 | + | chr4: 105246129-105246149 | CCAGAUUGAUCUCGAACUCC | 8381 |
| 54790_6_505 | + | chr4: 105246136-105246156 | GAUCUCGAACUCCUGGCUUC | 8382 |
| 54790_6_507 | + | chr4: 105246153-105246173 | UUCAGGUAACCCACCCACCC | 8383 |
| 54790_6_510 | + | chr4: 105246169-105246189 | ACCCUGGCCUCCCAAAGUGC | 8384 |
| 54790_6_512 | + | chr4: 105246170-105246190 | CCCUGGCCUCCCAAAGUGCU | 8385 |
| 54790_6_513 | + | chr4: 105246178-105246198 | UCCCAAAGUGCUGGGAUUAC | 8386 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_514 | + | chr4: 105246184-105246204 | AGUGCUGGGAUUACAGGUGU | 8387 |
| 54790_6_523 | + | chr4: 105246240-105246260 | AUAAAUGCCAAUGCCUGAAA | 8388 |
| 54790_6_538 | + | chr4: 105246311-105246331 | UGAAAACCAUGAAAAAUAGU | 8389 |
| 54790_6_548 | + | chr4: 105246365-105246385 | GUUUAACUGCUCUAAAUGUC | 8390 |
| 54790_6_557 | + | chr4: 105246455-105246475 | UUGCUUUUGUCUAGUUUCA | 8391 |
| 54790_6_591 | + | chr4: 105246644-105246664 | CAUAAAUAGAUUUUAUUUUA | 8392 |
| 54790_6_592 | + | chr4: 105246648-105246668 | AAUAGAUUUUAUUUUAUGGC | 8393 |
| 54790_6_615 | + | chr4: 105246706-105246726 | AGAAUAGAAUAAUCUCAAAU | 8394 |
| 54790_6_616 | + | chr4: 105246707-105246727 | GAAUAGAAUAAUCUCAAAUU | 8395 |
| 54790_6_617 | + | chr4: 105246708-105246728 | AAUAGAAUAAUCUCAAAUUG | 8396 |
| 54790_6_619 | + | chr4: 105246714-105246734 | AUAAUCUCAAAUUGGGGCUG | 8397 |
| 54790_6_637 | + | chr4: 105246838-105246858 | CUCUGAGUGCAUCUUUCAGU | 8398 |
| 54790_6_664 | + | chr4: 105246950-105246970 | AAGUCUAACCAGUAUUUUU | 8399 |
| 54790_6_668 | + | chr4: 105246966-105246986 | UUUUUGGCAAGUAAGAGUUG | 8400 |
| 54790_6_669 | + | chr4: 105246967-105246987 | UUUUGGCAAGUAAGAGUUGU | 8401 |
| 54790_6_680 | + | chr4: 105246988-105247008 | GGAGUGUAUCUGUCAUCAUA | 8402 |
| 54790_6_683 | + | chr4: 105247019-105247039 | GCCAGAAAUGCCUUCUGCCA | 8403 |
| 54790_6_685 | + | chr4: 105247022-105247042 | AGAAAUGCCUUCUGCCAUGG | 8404 |
| 54790_6_686 | + | chr4: 105247023-105247043 | GAAAUGCCUUCUGCCAUGGU | 8405 |
| 54790_6_690 | + | chr4: 105247043-105247063 | GGGUGAUGUUAAACAUUUCA | 8406 |
| 54790_6_699 | + | chr4: 105247078-105247098 | UAAAAUUGUCAAACAUAAA | 8407 |
| 54790_6_703 | + | chr4: 105247105-105247125 | GUGCAAUAUAAUGAAUUCCA | 8408 |
| 54790_6_725 | + | chr4: 105247237-105247257 | AUCUUACCUGUUAACAUUUC | 8409 |
| 54790_6_728 | + | chr4: 105247253-105247273 | UUUCAGGAUGUAUUUCUAAC | 8410 |
| 54790_6_759 | + | chr4: 105247420-105247440 | CCCAGUUCAUGUCCAUUGUC | 8411 |
| 54790_6_761 | + | chr4: 105247421-105247441 | CCAGUUCAUGUCCAUUGUCU | 8412 |
| 54790_6_800 | + | chr4: 105247590-105247610 | CUGUAAAUUCCCCACAUUC | 8413 |
| 54790_6_801 | + | chr4: 105247596-105247616 | AAUUCCCCACAUUCUGGAUU | 8414 |
| 54790_6_804 | + | chr4: 105247611-105247631 | GGAUUUGGCCGAUUUCAUCU | 8415 |
| 54790_6_820 | + | chr4: 105247660-105247680 | UCUAUCCCAGUAUCUUCUG | 8416 |
| 54790_6_821 | + | chr4: 105247665-105247685 | CCCCAGUAUCUUCUGUGGAC | 8417 |
| 54790_6_822 | + | chr4: 105247677-105247697 | CUGUGGACUGGUAGUUUGAC | 8418 |
| 54790_6_842 | + | chr4: 105247724-105247744 | UUUUUUUUUUUUUUUGAGAC | 8419 |
| 54790_6_860 | + | chr4: 105247744-105247764 | AGGCUCUCGCUCUGUCGCUU | 8420 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_863 | + | chr4: 105247748-105247768 | UCUCGCUCUGUCGCUUAGGC | 8421 |
| 54790_6_864 | + | chr4: 105247758-105247778 | UCGCUUAGGCUGGAGUGCAG | 8422 |
| 54790_6_866 | + | chr4: 105247794-105247814 | CACUGCAACCUCCACCUCCC | 8423 |
| 54790_6_872 | + | chr4: 105247833-105247853 | GCCUCAGCCUCCUGAGUAAC | 8424 |
| 54790_6_873 | + | chr4: 105247834-105247854 | CCUCAGCCUCCUGAGUAACU | 8425 |
| 54790_6_877 | + | chr4: 105247889-105247909 | UUUUGUACUUUUAGUAGAGA | 8426 |
| 54790_6_878 | + | chr4: 105247890-105247910 | UUUGUACUUUUAGUAGAGAC | 8427 |
| 54790_6_880 | + | chr4: 105247891-105247911 | UUGUACUUUUAGUAGAGACG | 8428 |
| 54790_6_887 | + | chr4: 105247905-105247925 | GAGACGGGGUUUCGCCAUGU | 8429 |
| 54790_6_888 | + | chr4: 105247910-105247930 | GGGGUUUCGCCAUGUUGGCC | 8430 |
| 54790_6_889 | + | chr4: 105247914-105247934 | UUUCGCCAUGUUGGCCAGGC | 8431 |
| 54790_6_893 | + | chr4: 105247919-105247939 | CCAUGUUGGCCAGGCUGGUC | 8432 |
| 54790_6_896 | + | chr4: 105247928-105247948 | CCAGGCUGGUCUGGAACUCC | 8433 |
| 54790_6_897 | + | chr4: 105247952-105247972 | CUCAAGUGAUCCGCCCACCU | 8434 |
| 54790_6_899 | + | chr4: 105247968-105247988 | ACCUUGGCCUCCCAAAGUGC | 8435 |
| 54790_6_901 | + | chr4: 105247969-105247989 | CCUUGGCCUCCCAAAGUGCU | 8436 |
| 54790_6_903 | + | chr4: 105247977-105247997 | UCCCAAAGUGCUGGGAUUAC | 8437 |
| 54790_6_910 | + | chr4: 105248044-105248064 | UGUGCAUGUAUAGUAUACAU | 8438 |
| 54790_6_915 | + | chr4: 105248095-105248115 | UCAUCUUAUUUAUAUACAUC | 8439 |
| 54790_6_984 | + | chr4: 105248410-105248430 | AAGUCCAAAUAGUAAAUCAA | 8440 |
| 54790_6_1048 | + | chr4: 105248755-105248775 | ACGUUUCAUCAUUCCCAGA | 8441 |
| 54790_6_1054 | + | chr4: 105248774-105248794 | AAGGAAACCCUGUAUUUAUU | 8442 |
| 54790_6_1060 | + | chr4: 105248815-105248835 | CCCUUCUUCCUUCCUCUAAG | 8443 |
| 54790_6_1065 | + | chr4: 105248845-105248865 | AAAUAAACAUUCAGUUUCUC | 8444 |
| 54790_6_1068 | + | chr4: 105248860-105248880 | UUCUCUGGAUUUACCUAUUC | 8445 |
| 54790_6_1069 | + | chr4: 105248861-105248881 | UCUCUGGAUUUACCUAUUCU | 8446 |
| 54790_6_1079 | + | chr4: 105248891-105248911 | UAUUAGUGAAAUCAUGUAUU | 8447 |
| 54790_6_1081 | + | chr4: 105248904-105248924 | AUGUAUUGGCCUUUCUCUC | 8448 |
| 54790_6_1127 | + | chr4: 105249050-105249070 | AGAGUCUCGCUCUGUUGCCC | 8449 |
| 54790_6_1129 | + | chr4: 105249055-105249075 | CUCGCUCUGUUGCCCAGGCU | 8450 |
| 54790_6_1130 | + | chr4: 105249056-105249076 | UCGCUCUGUUGCCCAGGCUA | 8451 |
| 54790_6_1131 | + | chr4: 105249064-105249084 | UUGCCCAGGCUAGGGUGCAA | 8452 |
| 54790_6_1134 | + | chr4: 105249099-105249119 | UCACUGCAACCUCUGUCUCC | 8453 |
| 54790_6_1135 | + | chr4: 105249100-105249120 | CACUGCAACCUCUGUCUCCC | 8454 |
| 54790_6_1139 | + | chr4: 105249138-105249158 | UGCCUCAGCCCCAAGUAGU | 8455 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_1141 | + | chr4: 105249139-105249159 | GCCUCAGCCCCCAAGUAGUU | 8456 |
| 54790_6_1147 | + | chr4: 105249195-105249215 | UUUGUAUUUUUAGUAGAGAC | 8457 |
| 54790_6_1149 | + | chr4: 105249196-105249216 | UUGUAUUUUUAGUAGAGACA | 8458 |
| 54790_6_1157 | + | chr4: 105249210-105249230 | GAGACAGGGUUUCACCAUGU | 8459 |
| 54790_6_1158 | + | chr4: 105249215-105249235 | AGGGUUUCACCAUGUUGGCU | 8460 |
| 54790_6_1159 | + | chr4: 105249219-105249239 | UUUCACCAUGUUGGCUAGGC | 8461 |
| 54790_6_1165 | + | chr4: 105249271-105249291 | ACCUUAGCCUCCUAAAGUGC | 8462 |
| 54790_6_1167 | + | chr4: 105249272-105249292 | CCUUAGCCUCCUAAAGUGCU | 8463 |
| 54790_6_1179 | + | chr4: 105249340-105249360 | UUUAUUAGUUAAUUGACAUU | 8464 |
| 54790_6_1185 | + | chr4: 105249358-105249378 | UUUGGAUCGUUUCUACUUUU | 8465 |
| 54790_6_1196 | + | chr4: 105249389-105249409 | AAUUAUGCUGCAAUGAACAU | 8466 |
| 54790_6_1205 | + | chr4: 105249429-105249449 | GAACAUGUUUUCAGUUACCU | 8467 |
| 54790_6_1206 | + | chr4: 105249430-105249450 | AACAUGUUUUCAGUUACCUU | 8468 |
| 54790_6_1212 | + | chr4: 105249443-105249463 | UUACCUUGGGAUAUACACCU | 8469 |
| 54790_6_1215 | + | chr4: 105249465-105249485 | GAGUGACAUUGUUAGUAAUA | 8470 |
| 54790_6_1237 | + | chr4: 105249554-105249574 | UUUCUGCCAACAAUGUAUGA | 8471 |
| 54790_6_1246 | + | chr4: 105249619-105249639 | UUUAAUUGUAACCAUCCAAG | 8472 |
| 54790_6_1247 | + | chr4: 105249620-105249640 | UUAAUUGUAACCAUCCAAGU | 8473 |
| 54790_6_1256 | + | chr4: 105249663-105249683 | UUUGAUUUGCAUUUUCCUAA | 8474 |
| 54790_6_1263 | + | chr4: 105249673-105249693 | AUUUUCCUAAUGGCUGAUAU | 8475 |
| 54790_6_1264 | + | chr4: 105249674-105249694 | UUUUCCUAAUGGCUGAUAUU | 8476 |
| 54790_6_1300 | + | chr4: 105249801-105249821 | CUUGAACUUUGUCAAAUGCC | 8477 |
| 54790_6_1306 | + | chr4: 105249830-105249850 | GAUAUUUCUCCUAUCCCAC | 8478 |
| 54790_6_1323 | + | chr4: 105249911-105249931 | AAACUCAAUUUCUUUUUAAU | 8479 |
| 54790_6_1328 | + | chr4: 105249927-105249947 | UAAUUGGCAGCUUGUGCAUU | 8480 |
| 54790_6_1331 | + | chr4: 105249928-105249948 | AAUUGGCAGCUUGUGCAUUU | 8481 |
| 54790_6_1333 | + | chr4: 105249929-105249949 | AUUGGCAGCUUGUGCAUUUG | 8482 |
| 54790_6_1364 | + | chr4: 105250054-105250074 | UUAAUGUUGAGUUAAUUUGA | 8483 |
| 54790_6_1391 | + | chr4: 105250161-105250181 | AAUUAACUGACCAAGAUGUA | 8484 |
| 54790_6_1392 | + | chr4: 105250162-105250182 | AUUAACUGACCAAGAUGUAU | 8485 |
| 54790_6_1395 | + | chr4: 105250173-105250193 | AAGAUGUAUGGGUUUAUUUC | 8486 |
| 54790_6_1412 | + | chr4: 105250269-105250289 | GUAAAUUUGAAAUCAAGAC | 8487 |
| 54790_6_1420 | + | chr4: 105250311-105250331 | CUUUUGCCUACCAUGUUUCU | 8488 |
| 54790_6_1421 | + | chr4: 105250312-105250332 | UUUUGCCUACCAUGUUUCUU | 8489 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_1434 | + | chr4: 105250356-105250376 | CAGCUUCUCCGUUUCCUUUC | 8490 |
| 54790_6_1448 | + | chr4: 105250390-105250410 | UUUUUUUUUUUUUUUUUUUU | 8491 |
| 54790_6_1452 | + | chr4: 105250393-105250413 | UUUUUUUUUUUUUUUUUUGG | 8492 |
| 54790_6_1462 | + | chr4: 105250399-105250419 | UUUUUUUUUUUGGUGGAGC | 8493 |
| 54790_6_1477 | + | chr4: 105250424-105250444 | UCUUACUAUAUUACCCAAGC | 8494 |
| 54790_6_1481 | + | chr4: 105250438-105250458 | CCAAGCUGGUUUUGAACUCC | 8495 |
| 54790_6_1486 | + | chr4: 105250461-105250481 | CUAAAGAGAUCCUCCCUCCU | 8496 |
| 54790_6_1491 | + | chr4: 105250477-105250497 | UCCUAGGCUUCCCAGAGAGC | 8497 |
| 54790_6_1492 | + | chr4: 105250478-105250498 | CCUAGGCUUCCCAGAGAGCU | 8498 |
| 54790_6_1493 | + | chr4: 105250479-105250499 | CUAGGCUUCCCAGAGAGCUG | 8499 |
| 54790_6_1494 | + | chr4: 105250486-105250506 | UCCCAGAGAGCUGGGGUUAC | 8500 |
| 54790_6_1500 | + | chr4: 105250516-105250536 | CACCACAUCCAACCCCCUUC | 8501 |
| 54790_6_1501 | + | chr4: 105250517-105250537 | ACCACAUCCAACCCCCUUCU | 8502 |
| 54790_6_1503 | + | chr4: 105250528-105250548 | CCCCCUUCUGGGACUUUGAC | 8503 |
| 54790_6_1505 | + | chr4: 105250529-105250549 | CCCCUUCUGGGACUUUGACU | 8504 |
| 54790_6_1506 | + | chr4: 105250530-105250550 | CCCUUCUGGGACUUUGACUG | 8505 |
| 54790_6_1511 | + | chr4: 105250548-105250568 | UGGGGUUCUGUUGAAUCUGU | 8506 |
| 54790_6_1514 | + | chr4: 105250557-105250577 | GUUGAAUCUGUUGGUCAAUU | 8507 |
| 54790_6_1525 | + | chr4: 105250604-105250624 | AGCUUCCAAUUUAUGAACAC | 8508 |
| 54790_6_1538 | + | chr4: 105250648-105250668 | AAUUUCUUUCAGUAAUGUUU | 8509 |
| 54790_6_1562 | + | chr4: 105250763-105250783 | CUCACUGCAACCUCCACCUC | 8510 |
| 54790_6_1563 | + | chr4: 105250764-105250784 | UCACUGCAACCUCCACCUCC | 8511 |
| 54790_6_1566 | + | chr4: 105250791-105250811 | AGUGAUUCUCCUGCCUCAGC | 8512 |
| 54790_6_1569 | + | chr4: 105250800-105250820 | CCUGCCUCAGCUGGAACUAC | 8513 |
| 54790_6_1570 | + | chr4: 105250819-105250839 | CAGGUGCGCGCCACCAUGCC | 8514 |
| 54790_6_1571 | + | chr4: 105250840-105250860 | GGCUAAUUGUUUUGUGUUUU | 8515 |
| 54790_6_1574 | + | chr4: 105250843-105250863 | UAAUUGUUUUGUGUUUUUGG | 8516 |
| 54790_6_1577 | + | chr4: 105250850-105250870 | UUUGUGUUUUGGUGGAGAC | 8517 |
| 54790_6_1578 | + | chr4: 105250851-105250871 | UUGUGUUUUUGGUGGAGACA | 8518 |
| 54790_6_1586 | + | chr4: 105250865-105250885 | GAGACAGGGUUUCACCAUGU | 8519 |
| 54790_6_1587 | + | chr4: 105250870-105250890 | AGGGUUUCACCAUGUUGGCC | 8520 |
| 54790_6_1588 | + | chr4: 105250874-105250894 | UUUCACCAUGUUGGCCAGGC | 8521 |
| 54790_6_1592 | + | chr4: 105250888-105250908 | CCAGGCUGGUCUCAAACACC | 8522 |
| 54790_6_1593 | + | chr4: 105250912-105250932 | CUCAAGUGACCUGACUGCCU | 8523 |
| 54790_6_1595 | + | chr4: 105250928-105250948 | GCCUUGGCCUCCCAAAGUAC | 8524 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_1597 | + | chr4: 105250929-105250949 | CCUUGGCCUCCCAAAGUACU | 8525 |
| 54790_6_1599 | + | chr4: 105250937-105250957 | UCCCAAAGUACUGGGAUUAC | 8526 |
| 54790_6_1602 | + | chr4: 105250956-105250976 | CAGGCAUGAGCCACCACGCC | 8527 |
| 54790_6_1618 | + | chr4: 105251035-105251055 | AAUUUUUGUUGAUAAUAUA | 8528 |
| 54790_6_1625 | + | chr4: 105251061-105251081 | UAAAUUUCAUUUUUAUAUAU | 8529 |
| 54790_6_1635 | + | chr4: 105251114-105251134 | UUAUUAGCACUAACUUUUUU | 8530 |
| 54790_6_1639 | + | chr4: 105251127-105251147 | CUUUUUUGGUAGAUUCCUU | 8531 |
| 54790_6_1653 | + | chr4: 105251194-105251214 | UUGUUUCUUCACUUCCAAUC | 8532 |
| 54790_6_1655 | + | chr4: 105251195-105251215 | UGUUUCUUCACUUCCAAUCU | 8533 |
| 54790_6_1658 | + | chr4: 105251198-105251218 | UUCUUCACUUCCAAUCUGGG | 8534 |
| 54790_6_1676 | + | chr4: 105251253-105251273 | UAGAACUUCCAGAAAAUGUC | 8535 |
| 54790_6_1698 | + | chr4: 105251342-105251362 | UUAAGUAUGAUACUAGUUGU | 8536 |
| 54790_6_1715 | + | chr4: 105251421-105251441 | UUGAAUAAUUUUAUCACGAA | 8537 |
| 54790_6_1717 | + | chr4: 105251422-105251442 | UGAAUAAUUUUAUCACGAAA | 8538 |
| 54790_6_1723 | + | chr4: 105251448-105251468 | UGAACUUUCUCAAAUGCUG | 8539 |
| 54790_6_1730 | + | chr4: 105251500-105251520 | UCUCCUUUAUUCUAUUAAUA | 8540 |
| 54790_6_1745 | + | chr4: 105251550-105251570 | UUAGAUUAACAUUAUAUUUC | 8541 |
| 54790_6_1749 | + | chr4: 105251566-105251586 | UUUCUGGAAUAAAUCCCACU | 8542 |
| 54790_6_1754 | + | chr4: 105251599-105251619 | UAUUACUUUUUAUAUAUUGC | 8543 |
| 54790_6_1761 | + | chr4: 105251613-105251633 | UAUUGCUGGAGUCUGUUUGC | 8544 |
| 54790_6_1765 | + | chr4: 105251626-105251646 | UGUUUGCAGGUAUUUCAUUG | 8545 |
| 54790_6_1771 | + | chr4: 105251650-105251670 | CUUUCGCAUCUCUGUUGAUA | 8546 |
| 54790_6_1775 | + | chr4: 105251685-105251705 | UAGUUCUCUUGUGAUAUCUU | 8547 |
| 54790_6_1779 | + | chr4: 105251691-105251711 | UCUUGUGAUAUCUUUGGUUU | 8548 |
| 54790_6_1790 | + | chr4: 105251726-105251746 | UCUGAGUUCACAAAAUGCAU | 8549 |
| 54790_6_1791 | + | chr4: 105251727-105251747 | CUGAGUUCACAAAAUGCAUU | 8550 |
| 54790_6_1797 | + | chr4: 105251752-105251772 | AUGUUCCUUCUCUAUCUUU | 8551 |
| 54790_6_1803 | + | chr4: 105251767-105251787 | UCUUUUGGAAGAGUUUACAA | 8552 |
| 54790_6_1805 | + | chr4: 105251772-105251792 | UGGAAGAGUUUACAAAGGAU | 8553 |
| 54790_6_1813 | + | chr4: 105251798-105251818 | AACUCUUUUUAAAUGUUUG | 8554 |
| 54790_6_1823 | + | chr4: 105251815-105251835 | UUGAGGAAAUUCUCUACCCC | 8555 |
| 54790_6_1824 | + | chr4: 105251816-105251836 | UGAGGAAAUUCUCUACCCCU | 8556 |
| 54790_6_1830 | + | chr4: 105251829-105251849 | UACCCCUGGGCUUUCCUUUG | 8557 |
| 54790_6_1832 | + | chr4: 105251830-105251850 | ACCCCUGGGCUUUCCUUUGU | 8558 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_6_1846 | + | chr4: 105251877-105251897 | AUUAUUUUUAAAGCAAUUUU | 8559 |
| 54790_6_1847 | + | chr4: 105251878-105251898 | UUAUUUUUAAAGCAAUUUUA | 8560 |
| 54790_6_1858 | + | chr4: 105251900-105251920 | GUAAAAGCACAUUGAAUGAA | 8561 |
| 54790_6_1865 | + | chr4: 105251977-105251997 | AUCAACAUCCUUUACCAGAA | 8562 |
| 54790_6_1877 | + | chr4: 105252050-105252070 | CAUAGUUUAGAGUUCACCUU | 8563 |
| 54790_6_1886 | + | chr4: 105252073-105252093 | UGUUAUGUAUUCUGUGAGUC | 8564 |
| 54790_6_1914 | + | chr4: 105252244-105252264 | AUUCCAGAAUGUCAUAUAGU | 8565 |
| 54790_6_1918 | + | chr4: 105252261-105252281 | AGUUGGAAUGAUACAGUAUA | 8566 |
| 54790_6_1920 | + | chr4: 105252277-105252297 | UAUAUGGAGCCUUUUCAGAC | 8567 |
| 54790_6_1942 | + | chr4: 105252367-105252387 | UUGAAUAAUAUUCCAUUGUC | 8568 |
| 54790_6_1961 | + | chr4: 105252465-105252485 | AAGCUGUUAUAAAAGUAUGU | 8569 |
| 54790_6_1964 | + | chr4: 105252476-105252496 | AAAGUAUGUAGGUUUUUGUG | 8570 |
| 54790_6_2000 | + | chr4: 105252639-105252659 | UUUUAAUUUUAAUGAAGUCU | 8571 |
| 54790_6_2009 | + | chr4: 105252670-105252690 | UAAUUCAUGAAUAAUGUUUU | 8572 |
| 54790_6_2017 | + | chr4: 105252698-105252718 | UAUCUAAAAGUCAACACCA | 8573 |
| 54790_6_2026 | + | chr4: 105252758-105252778 | UAGUUCUGCAUUUUACAUUU | 8574 |
| 54790_6_2028 | + | chr4: 105252759-105252779 | AGUUCUGCAUUUUACAUUUA | 8575 |
| 54790_6_2044 | + | chr4: 105252830-105252850 | UAGAUUCACUUGUUUGCAUG | 8576 |
| 54790_6_2065 | + | chr4: 105252930-105252950 | AUCAGUUGAUUAUAAUUAAG | 8577 |
| 54790_6_2068 | + | chr4: 105252941-105252961 | AUAAUUAAGUGGUCUGUUUC | 8578 |
| 54790_6_2082 | + | chr4: 105253012-105253032 | CCACACUAUCUUGUUAACUU | 8579 |
| 54790_6_2092 | + | chr4: 105253084-105253104 | UUUCUCCUUCAGUAUUGAGU | 8580 |
| 54790_6_2106 | + | chr4: 105253129-105253149 | GUAAAAAAGCAGUCUGAAA | 8581 |
| 54790_6_2107 | + | chr4: 105253152-105253172 | CUAUAUAUACAGUCAUUUAU | 8582 |
| 54790_6_2122 | + | chr4: 105253213-105253233 | CAGUAUCCUCAAAAUCUUGC | 8583 |
| 54790_6_2139 | + | chr4: 105253299-105253319 | CAUCUUCCUAUCCAUGAACA | 8584 |
| 54790_6_2142 | + | chr4: 105253315-105253335 | AACAUGGAACAUCUCUUUCU | 8585 |
| 54790_6_2159 | + | chr4: 105253393-105253413 | UUAUACAUAAAUAUUUCAUU | 8586 |
| 54790_6_2161 | + | chr4: 105253394-105253414 | UAUACAUAAAUAUUUCAUUU | 8587 |
| 54790_6_2162 | + | chr4: 105253395-105253415 | AUACAUAAAUAUUUCAUUUG | 8588 |
| 54790_6_2167 | + | chr4: 105253396-105253416 | UACAUAAAUAUUUCAUUUGG | 8589 |
| 54790_6_2168 | + | chr4: 105253397-105253417 | ACAUAAAUAUUUCAUUUGGG | 8590 |
| 54790_6_2169 | + | chr4: 105253398-105253418 | CAUAAAUAUUUCAUUUGGGG | 8591 |
| 54790_6_2170 | + | chr4: 105253407-105253427 | UUCAUUUGGGGGGGUGCUAA | 8592 |
| 54790_6_2179 | + | chr4: 105253447-105253467 | AGAUUCUGCUUGUACAUUGC | 8593 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_2193 | + | chr4: 105253538-105253558 | AGAUCCAGUUUUUUUUUUUU | 8594 |
| 54790_6_2207 | + | chr4: 105253560-105253580 | GUCAUUCUUUCAUAUUUUCU | 8595 |
| 54790_6_2228 | + | chr4: 105253661-105253681 | AUUUCCAGUAUGAUGUUGAA | 8596 |
| 54790_6_2231 | + | chr4: 105253667-105253687 | AGUAUGAUGUUGAAAGGCAU | 8597 |
| 54790_6_2234 | + | chr4: 105253674-105253694 | UGUUGAAAGGCAUUGGUGAG | 8598 |
| 54790_6_2238 | + | chr4: 105253707-105253727 | GCCUUGUUCCUGAUCUCAGC | 8599 |
| 54790_6_2243 | + | chr4: 105253736-105253756 | UCAAUUUAUGUUAGCUCUA | 8600 |
| 54790_6_2256 | + | chr4: 105253781-105253801 | CAUUAAAUAUGUUAGCUGUA | 8601 |
| 54790_6_2260 | + | chr4: 105253804-105253824 | UUUUGUAUAUAUUCUUUAUC | 8602 |
| 54790_6_2264 | + | chr4: 105253810-105253830 | AUAUAUUCUUUAUCAGGUUC | 8603 |
| 54790_6_2272 | + | chr4: 105253842-105253862 | UCUUUUCCUAGUUUACUGAG | 8604 |
| 54790_6_2281 | + | chr4: 105253869-105253889 | UGAAAAUCAUUAAUCAGUGU | 8605 |
| 54790_6_2301 | + | chr4: 105253940-105253960 | UCUUUAGCUUAUUAACGAAA | 8606 |
| 54790_6_2312 | + | chr4: 105253978-105253998 | UUUCAAAUUUUGAACUAGAC | 8607 |
| 54790_6_2318 | + | chr4: 105253987-105254007 | UUGAACUAGACUGGCAUACC | 8608 |
| 54790_6_2322 | + | chr4: 105254003-105254023 | UACCUGGAGCAAAUCCCACA | 8609 |
| 54790_6_2325 | + | chr4: 105254035-105254055 | AUUAUUUAUGAAUGCAUUCA | 8610 |
| 54790_6_2327 | + | chr4: 105254041-105254061 | UAUGAAUGCAUUCAUGGUCA | 8611 |
| 54790_6_2333 | + | chr4: 105254083-105254103 | AUCUUUUAUUGUAAAGACUU | 8612 |
| 54790_6_2335 | + | chr4: 105254089-105254109 | UAUUGUAAAGACUUUGGUGU | 8613 |
| 54790_6_2340 | + | chr4: 105254097-105254117 | AGACUUUGGUGUUGGUAUUA | 8614 |
| 54790_6_2361 | + | chr4: 105254196-105254216 | UAAUUUCUUCCUUAAAACUU | 8615 |
| 54790_6_2373 | + | chr4: 105254226-105254246 | CAGAAUGAACCAUCUGUGUC | 8616 |
| 54790_6_2382 | + | chr4: 105254277-105254297 | UCAAUUUCUUUCAUAGAUAU | 8617 |
| 54790_6_2390 | + | chr4: 105254310-105254330 | UUAUUAUUUUGCAUAAAUAU | 8618 |
| 54790_6_2398 | + | chr4: 105254328-105254348 | AUUGGUAGUUGUGUCCUUCA | 8619 |
| 54790_6_2400 | + | chr4: 105254334-105254354 | AGUUGUGUCCUUCAAGGAAU | 8620 |
| 54790_6_2406 | + | chr4: 105254364-105254384 | CACCUUGAUUAUUAAAUGUG | 8621 |
| 54790_6_2408 | + | chr4: 105254365-105254385 | ACCUUGAUUAUUAAAUGUGU | 8622 |
| 54790_6_2421 | + | chr4: 105254413-105254433 | UUAUCCUUUGUUUUUGAGAC | 8623 |
| 54790_6_2422 | + | chr4: 105254414-105254434 | UAUCCUUUGUUUUUGAGACA | 8624 |
| 54790_6_2426 | + | chr4: 105254425-105254445 | UUUGAGACAGGGUCUCACUC | 8625 |
| 54790_6_2431 | + | chr4: 105254434-105254454 | GGGUCUCACUCUGGUUGCCC | 8626 |
| 54790_6_2434 | + | chr4: 105254438-105254458 | CUCACUCUGGUUGCCCAGGC | 8627 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_2437 | + | chr4: 105254483-105254503 | UCACUGCAGCCUUGACUUCC | 8628 |
| 54790_6_2438 | + | chr4: 105254484-105254504 | CACUGCAGCCUUGACUUCCU | 8629 |
| 54790_6_2444 | + | chr4: 105254524-105254544 | CCUCAGCCUCCCAAGUAGCU | 8630 |
| 54790_6_2445 | + | chr4: 105254532-105254552 | UCCCAAGUAGCUCGGACUAC | 8631 |
| 54790_6_2446 | + | chr4: 105254551-105254571 | CAGGCACAUGCCACCAUGCC | 8632 |
| 54790_6_2449 | + | chr4: 105254579-105254599 | UUUUUUAUUAUUAUUAGAGA | 8633 |
| 54790_6_2460 | + | chr4: 105254604-105254624 | UUUUCCUAUGUUGCCCAGUG | 8634 |
| 54790_6_2467 | + | chr4: 105254618-105254638 | CCAGUGUGGUCUUGAACUCC | 8635 |
| 54790_6_2471 | + | chr4: 105254659-105254679 | CCUCAGCCUCCAAAGAGUGA | 8636 |
| 54790_6_2473 | + | chr4: 105254660-105254680 | CUCAGCCUCCAAAGAGUGAU | 8637 |
| 54790_6_2474 | + | chr4: 105254668-105254688 | CCAAAGAGUGAUGGGAUUGC | 8638 |
| 54790_6_2477 | + | chr4: 105254695-105254715 | AGCCAUCACACCUAGCCUGA | 8639 |
| 54790_6_2481 | + | chr4: 105254709-105254729 | GCCUGAUGGCAGAACUUUUU | 8640 |
| 54790_6_2484 | + | chr4: 105254722-105254742 | ACUUUUUAGGAACAAUAGAA | 8641 |
| 54790_6_2487 | + | chr4: 105254729-105254749 | AGGAACAAUAGAAUGGUAUA | 8642 |
| 54790_6_2495 | + | chr4: 105254763-105254783 | AUUGUUUCCCCUCCUCCUA | 8643 |
| 54790_6_2503 | + | chr4: 105254774-105254794 | CUCCUCCUAUGGAAGCAUGA | 8644 |
| 54790_6_2504 | + | chr4: 105254775-105254795 | UCCUCCUAUGGAAGCAUGAA | 8645 |
| 54790_6_2511 | + | chr4: 105254812-105254832 | UUCAUUGUGAGAACCUCAUC | 8646 |
| 54790_6_2520 | + | chr4: 105254846-105254866 | AGAAAACUCACAAAACUGUG | 8647 |
| 54790_6_2522 | + | chr4: 105254862-105254882 | UGUGAGGAACCUAUUAUGAC | 8648 |
| 54790_6_2524 | + | chr4: 105254872-105254892 | CUAUUAUGACUGGAUGCCUU | 8649 |
| 54790_6_2535 | + | chr4: 105254938-105254958 | AGAUUUCCUAUCCCAACAC | 8650 |
| 54790_6_2541 | + | chr4: 105254950-105254970 | CCCAACACUGGUUCCUACAG | 8651 |
| 54790_6_2546 | + | chr4: 105254998-105255018 | UUUUUAUCCAUCUGCUUCCU | 8652 |
| 54790_6_2553 | + | chr4: 105255006-105255026 | CAUCUGCUUCCUUGGUUGUG | 8653 |
| 54790_6_2554 | + | chr4: 105255007-105255027 | AUCUGCUUCCUUGGUUGUGA | 8654 |
| 54790_6_2564 | + | chr4: 105255082-105255102 | UACAUCUUUUAACCUGUUGU | 8655 |
| 54790_6_2595 | + | chr4: 105255213-105255233 | UCGAGUUUUCAUUUACAACA | 8656 |
| 54790_6_2608 | + | chr4: 105255259-105255279 | UUUUUGAUUCCUGACUGUAU | 8657 |
| 54790_6_2648 | + | chr4: 105255393-105255413 | ACUUGACAUACAGUCCAUCC | 8658 |
| 54790_6_2659 | + | chr4: 105255441-105255461 | GAAUGUGUAUAUUCAGCUGU | 8659 |
| 54790_6_2661 | + | chr4: 105255444-105255464 | UGUGUAUAUUCAGCUGUUGG | 8660 |
| 54790_6_2662 | + | chr4: 105255445-105255465 | GUGUAUAUUCAGCUGUUGGU | 8661 |
| 54790_6_2663 | + | chr4: 105255448-105255468 | UAUAUUCAGCUGUUGGUGGG | 8662 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_6_2669 | + | chr4: 105255481-105255501 | AGAUGUCUGUUAGACCUAGU | 8663 |
| 54790_6_2690 | + | chr4: 105255552-105255572 | CUUUUAGCCAUUAUUGAAAG | 8664 |
| 54790_6_2704 | + | chr4: 105255611-105255631 | AUUUUUUGCUUCAUGUAUUU | 8665 |
| 54790_6_2719 | + | chr4: 105255663-105255683 | CAUUUGUUACAUCAUUUUAA | 8666 |
| 54790_6_2752 | + | chr4: 105255795-105255815 | AUUUAACAUAAUUAUUGAUA | 8667 |
| 54790_6_2755 | + | chr4: 105255799-105255819 | AACAUAAUUAUUGAUAAGGU | 8668 |
| 54790_6_2783 | + | chr4: 105255911-105255931 | AAAUUUUUGAUGUUCUUAA | 8669 |
| 54790_6_2789 | + | chr4: 105255920-105255940 | GAUGUUCUUAAUGGUUUCCC | 8670 |
| 54790_6_2792 | + | chr4: 105255921-105255941 | AUGUUCUUAAUGGUUUCCCU | 8671 |
| 54790_6_2794 | + | chr4: 105255922-105255942 | UGUUCUUAAUGGUUUCCCUG | 8672 |
| 54790_6_2803 | + | chr4: 105255981-105256001 | ACCAAUUUCAUUACAAUAUA | 8673 |
| 54790_6_2844 | + | chr4: 105256184-105256204 | ACCUAUGUAAUUAUCUUUAC | 8674 |
| 54790_6_2849 | + | chr4: 105256203-105256223 | CUGGUGCUCUUUAAGUUCUU | 8675 |
| 54790_6_2852 | + | chr4: 105256214-105256234 | UAAGUUCUUAGGUGUAUUUG | 8676 |
| 54790_6_2865 | + | chr4: 105256271-105256291 | AUACAUUUAGUAUUUUUUGU | 8677 |
| 54790_6_2888 | + | chr4: 105256371-105256391 | UUUGCAAAAUACAGAAUUCU | 8678 |
| 54790_6_2891 | + | chr4: 105256375-105256395 | CAAAAUACAGAAUUCUUGGU | 8679 |
| 54790_6_2894 | + | chr4: 105256392-105256412 | GGUUGGCAGUCUUUUUCUUG | 8680 |
| 54790_6_2903 | + | chr4: 105256418-105256438 | UAUGUCAUUCUACUGCCUUC | 8681 |
| 54790_6_2913 | + | chr4: 105256461-105256481 | AGAUCAGCUAUUAAUCUUAU | 8682 |
| 54790_6_2914 | + | chr4: 105256462-105256482 | GAUCAGCUAUUAAUCUUAUU | 8683 |
| 54790_6_2919 | + | chr4: 105256512-105256532 | UUUUCAUGAUUUCUUGUGU | 8684 |
| 54790_6_2926 | + | chr4: 105256527-105256547 | UGUGUUGGCUUUCAGCAGUU | 8685 |
| 54790_6_2935 | + | chr4: 105256558-105256578 | UUUAUAUGUAUGCAUAUCUU | 8686 |
| 54790_6_2936 | + | chr4: 105256559-105256579 | UUAUAUGUAUGCAUAUCUUU | 8687 |
| 54790_6_2940 | + | chr4: 105256573-105256593 | AUCUUUGGGUUUAUGUUACA | 8688 |
| 54790_6_2949 | + | chr4: 105256592-105256612 | AUGGAGUUAGUUGAGCUUCU | 8689 |
| 54790_6_2958 | + | chr4: 105256635-105256655 | CAUCAAAUUUGAGAAGUUUU | 8690 |
| 54790_6_2974 | + | chr4: 105256688-105256708 | UUAUUCUUCAUCCUCUACUU | 8691 |
| 54790_6_2976 | + | chr4: 105256689-105256709 | UAUUCUUCAUCCUCUACUUU | 8692 |
| 54790_6_2978 | + | chr4: 105256690-105256710 | AUUCUUCAUCCUCUACUUUG | 8693 |
| 54790_6_2985 | + | chr4: 105256712-105256732 | GACCUGCAUUAUGUCUAUGU | 8694 |
| 54790_6_2987 | + | chr4: 105256724-105256744 | GUCUAUGUUGGUAUGCUUUA | 8695 |
| 54790_6_2991 | + | chr4: 105256744-105256764 | UGGUCUUCCACAGAUCUCUG | 8696 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
| --- | --- | --- | --- | --- |
| 54790_6_3049 | + | chr4: 105256982-105257002 | UACAGUUUUCUUUCAUUAUU | 8697 |
| 54790_6_3050 | + | chr4: 105256983-105257003 | ACAGUUUUCUUUCAUUAUUU | 8698 |
| 54790_6_3060 | + | chr4: 105257022-105257042 | GACUUAAAGUCUUUGUCCAG | 8699 |
| 54790_6_3063 | + | chr4: 105257034-105257054 | UUGUCCAGUGGCCUAACAUC | 8700 |
| 54790_6_3068 | + | chr4: 105257045-105257065 | CCUAACAUCUGGACUUUUUC | 8701 |
| 54790_6_3074 | + | chr4: 105257072-105257092 | GCCUCUAUUGACUACUUUAU | 8702 |
| 54790_6_3076 | + | chr4: 105257073-105257093 | CCUCUAUUGACUACUUUAUA | 8703 |
| 54790_6_3077 | + | chr4: 105257074-105257094 | CUCUAUUGACUACUUUAUAG | 8704 |
| 54790_6_3091 | + | chr4: 105257130-105257150 | GACAUUUUAAACUAAUGUAA | 8705 |
| 54790_6_3097 | + | chr4: 105257143-105257163 | AAUGUAAUGGCUGAGAGCAG | 8706 |
| 54790_6_3100 | + | chr4: 105257174-105257194 | UGUAAUCCCAGCACGUUGAG | 8707 |
| 54790_6_3103 | + | chr4: 105257184-105257204 | GCACGUUGAGAGGCCAAAGC | 8708 |
| 54790_6_3106 | + | chr4: 105257203-105257223 | CAGGAGCAUCACUUAAGCCC | 8709 |
| 54790_6_3110 | + | chr4: 105257221-105257241 | CCAGGAGUUCAAGACUAGCC | 8710 |
| 54790_6_3111 | + | chr4: 105257222-105257242 | CAGGAGUUCAAGACUAGCCU | 8711 |
| 54790_6_3114 | + | chr4: 105257280-105257300 | AUAAAUAAAAUAAUAUAAUC | 8712 |
| 54790_6_3119 | + | chr4: 105257333-105257353 | CCAGAAUAUGUUACUGUUUC | 8713 |
| 54790_6_3120 | + | chr4: 105257336-105257356 | GAAUAUGUUACUGUUUCUGG | 8714 |
| 54790_6_3140 | + | chr4: 105257414-105257434 | UAGCCAUCGAAGUCUUUGCU | 8715 |
| 54790_6_3142 | + | chr4: 105257426-105257446 | UCUUUGCUUGGUUAACUUAG | 8716 |
| 54790_6_3147 | + | chr4: 105257436-105257456 | GUUAACUUAGAGGUCAGCUA | 8717 |
| 54790_6_3152 | + | chr4: 105257456-105257476 | AGGAUUAGACAGAAUUCCUU | 8718 |
| 54790_6_3159 | + | chr4: 105257490-105257510 | AAUAAGUCAGUCUUUGACAA | 8719 |
| 54790_6_3160 | + | chr4: 105257491-105257511 | AUAAGUCAGUCUUUGACAAA | 8720 |
| 54790_6_3161 | + | chr4: 105257492-105257512 | UAAGUCAGUCUUUGACAAAG | 8721 |
| 54790_6_3166 | + | chr4: 105257508-105257528 | AAAGGGGUCUGUAUGUGUGU | 8722 |
| 54790_6_3167 | + | chr4: 105257509-105257529 | AAGGGGUCUGUAUGUGUGUU | 8723 |
| 54790_6_3168 | + | chr4: 105257510-105257530 | AGGGGUCUGUAUGUGUGUUG | 8724 |
| 54790_6_3170 | + | chr4: 105257533-105257553 | CAUGCAUUCAACACUCAGCC | 8725 |
| 54790_6_3173 | + | chr4: 105257549-105257569 | AGCCAGGCUAUUUGCAGCUC | 8726 |
| 54790_6_3180 | + | chr4: 105257586-105257606 | CCUGCUUGUGCAGAGUCUCA | 8727 |
| 54790_6_3183 | + | chr4: 105257597-105257617 | AGAGUCUCAAGGUUAGACUG | 8728 |
| 54790_6_3187 | + | chr4: 105257609-105257629 | UUAGACUGUGGUGAGAGUUU | 8729 |
| 54790_6_3188 | + | chr4: 105257610-105257630 | UAGACUGUGGUGAGAGUUUA | 8730 |
| 54790_6_3191 | + | chr4: 105257620-105257640 | UGAGAGUUUAGGGCUUUCUG | 8731 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_3194 | + | chr4: 105257630-105257650 | GGGCUUUCUGAGGUCUUUUG | 8732 |
| 54790_6_3196 | + | chr4: 105257631-105257651 | GGCUUUCUGAGGUCUUUUGU | 8733 |
| 54790_6_3201 | + | chr4: 105257649-105257669 | GUGGGCCCUACAGUUGCAUG | 8734 |
| 54790_6_3205 | + | chr4: 105257666-105257686 | AUGUGGCUUUCUAAAUUCCC | 8735 |
| 54790_6_3211 | + | chr4: 105257691-105257711 | UAUAUUUCAAAGCCUCCUG | 8736 |
| 54790_6_3215 | + | chr4: 105257709-105257729 | UGUGGAUCAUCUCAUUUCCC | 8737 |
| 54790_6_3238 | + | chr4: 105257825-105257845 | UUAUUUGACAAAUGCCUCUG | 8738 |
| 54790_6_3242 | + | chr4: 105257831-105257851 | GACAAAUGCCUCUGUGGAAA | 8739 |
| 54790_6_3244 | + | chr4: 105257834-105257854 | AAAUGCCUCUGUGGAAAAGG | 8740 |
| 54790_6_3245 | + | chr4: 105257845-105257865 | UGGAAAAGGUGGUUCACACU | 8741 |
| 54790_6_3251 | + | chr4: 105257887-105257907 | AGUAAAGAUAACCUUACUAG | 8742 |
| 54790_6_3252 | + | chr4: 105257888-105257908 | GUAAAGAUAACCUUACUAGU | 8743 |
| 54790_6_3254 | + | chr4: 105257898-105257918 | CCUUACUAGUGGGAUCUUCC | 8744 |
| 54790_6_3257 | + | chr4: 105257913-105257933 | CUUCCAGGAAACUACCAAAC | 8745 |
| 54790_6_3259 | + | chr4: 105257928-105257948 | CAAACAGGUCAAAUAAUGUA | 8746 |
| 54790_6_3263 | + | chr4: 105257941-105257961 | UAAUGUAAGGUCUCUGUGAA | 8747 |
| 54790_6_3264 | + | chr4: 105257942-105257962 | AAUGUAAGGUCUCUGUGAAU | 8748 |
| 54790_6_3269 | + | chr4: 105257989-105258009 | UAGAGUAUAUCCAACCAAUC | 8749 |
| 54790_6_3270 | + | chr4: 105258002-105258022 | ACCAAUCUGGCCUCCUCUAG | 8750 |
| 54790_6_3271 | + | chr4: 105258010-105258030 | GGCCUCCUCUAGUGGCAGCC | 8751 |
| 54790_6_3273 | + | chr4: 105258035-105258055 | GCUGCUUUUCAUAAUAAAUG | 8752 |
| 54790_6_3274 | + | chr4: 105258036-105258056 | CUGCUUUUCAUAAUAAAUGU | 8753 |
| 54790_6_3279 | + | chr4: 105258053-105258073 | UGUGGGCUGUUUUGAUUUGA | 8754 |
| 54790_6_3285 | + | chr4: 105258070-105258090 | UGAAGGCUACCAUAGAGCUG | 8755 |
| 54790_6_3288 | + | chr4: 105258071-105258091 | GAAGGCUACCAUAGAGCUGU | 8756 |
| 54790_6_3290 | + | chr4: 105258072-105258092 | AAGGCUACCAUAGAGCUGUG | 8757 |
| 54790_6_3319 | + | chr4: 105258230-105258250 | CAGUACUUUUAUUGCUUUUA | 8758 |
| 54790_6_3321 | + | chr4: 105258233-105258253 | UACUUUUAUUGCUUUUAUGG | 8759 |
| 54790_6_3343 | + | chr4: 105258328-105258348 | UUCCUUUUGCAUUUAUUAGC | 8760 |
| 54790_6_3350 | + | chr4: 105258341-105258361 | UAUUAGCUGGAAUACUUUAC | 8761 |
| 54790_6_3369 | + | chr4: 105258408-105258428 | AGAAUGAUAGAAUAAAUGCA | 8762 |
| 54790_6_3378 | + | chr4: 105258447-105258467 | UCAAAUUUCAGAGAUUUUGA | 8763 |
| 54790_6_3379 | + | chr4: 105258448-105258468 | CAAAUUUCAGAGAUUUUGAU | 8764 |
| 54790_6_3391 | + | chr4: 105258499-105258519 | UCUAGAUGUGCUCCCUGCUA | 8765 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_6_3393 | + | chr4: 105258502-105258522 | AGAUGUGCUCCCUGCUAUGG | 8766 |
| 54790_6_3394 | + | chr4: 105258518-105258538 | AUGGAGGUGUCAUUACUUUU | 8767 |
| 54790_6_3396 | + | chr4: 105258530-105258550 | UUACUUUUAGGCUUUUUUAA | 8768 |
| 54790_6_3397 | + | chr4: 105258531-105258551 | UACUUUUAGGCUUUUUUAAU | 8769 |
| 54790_6_3436 | + | chr4: 105258671-105258691 | CUCUUGUACACUGAAAUUCU | 8770 |
| 54790_6_3477 | + | chr4: 105258829-105258849 | UCAUUAGAAUGUAUCAAACU | 8771 |
| 54790_6_3479 | + | chr4: 105258830-105258850 | CAUUAGAAUGUAUCAAACUA | 8772 |
| 54790_6_3484 | + | chr4: 105258869-105258889 | CUAUAUUUUAGCCAGAAACU | 8773 |
| 54790_6_3488 | + | chr4: 105258896-105258916 | AGCACUCAAAUGCCCAUCAA | 8774 |
| 54790_6_3492 | + | chr4: 105258927-105258947 | UUCAUCACAUUUUUAUAAGA | 8775 |
| 54790_6_3495 | + | chr4: 105258934-105258954 | CAUUUUUAUAAGAUGGAAUA | 8776 |
| 54790_6_3503 | + | chr4: 105258979-105258999 | UACAACUACAUGCAGUGAUU | 8777 |
| 54790_6_3505 | + | chr4: 105258983-105259003 | ACUACAUGCAGUGAUUUGGA | 8778 |
| 54790_6_3509 | + | chr4: 105259001-105259021 | GAUGGAUAUCCCAAACAUAA | 8779 |
| 54790_6_3514 | + | chr4: 105259073-105259093 | UAUAUAUCAAGUAUAAAAGU | 8780 |
| 54790_6_3515 | + | chr4: 105259092-105259112 | UAGGCAAAACAAGCUACUGA | 8781 |
| 54790_6_3516 | + | chr4: 105259095-105259115 | GCAAAACAAGCUACUGAUGG | 8782 |
| 54790_6_3518 | + | chr4: 105259122-105259142 | CACCUAUAGUUCCAGCUAUU | 8783 |
| 54790_6_3520 | + | chr4: 105259123-105259143 | ACCUAUAGUUCCAGCUAUUU | 8784 |
| 54790_6_3522 | + | chr4: 105259126-105259146 | UAUAGUUCCAGCUAUUUGGG | 8785 |
| 54790_6_3524 | + | chr4: 105259132-105259152 | UCCAGCUAUUUGGGAGGCUG | 8786 |
| 54790_6_3527 | + | chr4: 105259135-105259155 | AGCUAUUUGGGAGGCUGAGG | 8787 |
| 54790_6_3530 | + | chr4: 105259136-105259156 | GCUAUUUGGGAGGCUGAGGC | 8788 |
| 54790_6_3535 | + | chr4: 105259163-105259183 | UCACUUGAGCCCAGAAGUUC | 8789 |
| 54790_6_3542 | + | chr4: 105259229-105259249 | AGCAUUAUUAACAUAAAAAU | 8790 |
| 54790_6_3550 | + | chr4: 105259265-105259285 | UUCUUAGAGAAGUUACUGUU | 8791 |
| 54790_6_3552 | + | chr4: 105259266-105259286 | UCUUAGAGAAGUUACUGUUA | 8792 |
| 54790_6_3559 | + | chr4: 105259291-105259311 | ACAGACAGUGAGUGACUGAA | 8793 |
| 54790_6_3562 | + | chr4: 105259301-105259321 | AGUGACUGAAAGGCAAAAUG | 8794 |
| 54790_6_3564 | + | chr4: 105259302-105259322 | GUGACUGAAAGGCAAAAUGA | 8795 |
| 54790_6_3567 | + | chr4: 105259303-105259323 | UGACUGAAAGGCAAAAUGAG | 8796 |
| 54790_6_3569 | + | chr4: 105259313-105259333 | GCAAAAUGAGGGGAAAUUCC | 8797 |
| 54790_6_3572 | + | chr4: 105259314-105259334 | CAAAAUGAGGGGAAAUUCCA | 8798 |
| 54790_6_3573 | + | chr4: 105259315-105259335 | AAAAUGAGGGGAAAUUCCAG | 8799 |
| 54790_6_3576 | + | chr4: 105259343-105259363 | AAAUAUUUGUUUCUUAGUG | 8800 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_3577 | + | chr4: 105259344-105259364 | AAUAUUUGUUUCUUAGUGU | 8801 |
| 54790_6_3584 | + | chr4: 105259358-105259378 | UAGUGUGGGUUCUACUUAAC | 8802 |
| 54790_6_3585 | + | chr4: 105259359-105259379 | AGUGUGGGUUCUACUUAACU | 8803 |
| 54790_6_3604 | + | chr4: 105259461-105259481 | AAUUGAAAUAGUUCUGUGUG | 8804 |
| 54790_6_3620 | + | chr4: 105259579-105259599 | GCUAUCCAUAGCAAUGAAUU | 8805 |
| 54790_6_3621 | - | chr4: 105243768-105243788 | CUUCACUUACUCUUCAUUCA | 8806 |
| 54790_6_3622 | - | chr4: 105243791-105243811 | GCAAAGAGGGGAGAGGCCCU | 8807 |
| 54790_6_3623 | - | chr4: 105243792-105243812 | CGCAAAGAGGGGAGAGGCCC | 8808 |
| 54790_6_3625 | - | chr4: 105243798-105243818 | AGUGGCCGCAAAGAGGGGAG | 8809 |
| 54790_6_3630 | - | chr4: 105243803-105243823 | CUAUCAGUGGCCGCAAAGAG | 8810 |
| 54790_6_3632 | - | chr4: 105243804-105243824 | CCUAUCAGUGGCCGCAAAGA | 8811 |
| 54790_6_3633 | - | chr4: 105243805-105243825 | UCCUAUCAGUGGCCGCAAAG | 8812 |
| 54790_6_3638 | - | chr4: 105243816-105243836 | AGAUUGGGCUUUCCUAUCAG | 8813 |
| 54790_6_3642 | - | chr4: 105243831-105243851 | CUUCCUUUCAACCAAAGAUU | 8814 |
| 54790_6_3643 | - | chr4: 105243832-105243852 | UCUUCCUUUCAACCAAAGAU | 8815 |
| 54790_6_3654 | - | chr4: 105243900-105243920 | UUAUCGCAUGACUGCCAAAC | 8816 |
| 54790_6_3661 | - | chr4: 105243986-105244006 | CUCUGACUGCUCCUAAUUAA | 8817 |
| 54790_6_3665 | - | chr4: 105244018-105244038 | AUGGUAUAACUGAGGCCAUG | 8818 |
| 54790_6_3668 | - | chr4: 105244026-105244046 | UCAAGUUUAUGGUAUAACUG | 8819 |
| 54790_6_3670 | - | chr4: 105244037-105244057 | CAUAAACAAUUUCAAGUUUA | 8820 |
| 54790_6_3674 | - | chr4: 105244085-105244105 | AAUAUAGUGGCCAGGCACAC | 8821 |
| 54790_6_3676 | - | chr4: 105244093-105244113 | UACAUACUAAUAUAGUGGCC | 8822 |
| 54790_6_3677 | - | chr4: 105244098-105244118 | GUCAAUACAUACUAAUAUAG | 8823 |
| 54790_6_3681 | - | chr4: 105244122-105244142 | CAGAUACUGCAACAUGGAAG | 8824 |
| 54790_6_3685 | - | chr4: 105244128-105244148 | CUGUUUCAGAUACUGCAACA | 8825 |
| 54790_6_3694 | - | chr4: 105244181-105244201 | AUAUGGAAGGUAUUUGACCU | 8826 |
| 54790_6_3697 | - | chr4: 105244182-105244202 | CAUAUGGAAGGUAUUUGACC | 8827 |
| 54790_6_3706 | - | chr4: 105244194-105244214 | UUUUGCUACAUACAUAUGGA | 8828 |
| 54790_6_3707 | - | chr4: 105244198-105244218 | UUGUUUUGCUACAUACAUA | 8829 |
| 54790_6_3716 | - | chr4: 105244230-105244250 | UCUAUUUCUACAGAACUUCU | 8830 |
| 54790_6_3729 | - | chr4: 105244289-105244309 | AGCAGUUUUGAUUACUAUUG | 8831 |
| 54790_6_3743 | - | chr4: 105244371-105244391 | AUUCUAAAUUCUUAUAUUCC | 8832 |
| 54790_6_3752 | - | chr4: 105244433-105244453 | UAAACAAAACAUUAGCAAC | 8833 |
| 54790_6_3757 | - | chr4: 105244460-105244480 | UAGACUUCAUGCAAAGUGGA | 8834 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_3758 | − | chr4: 105244464-105244484 | GGUUUAGACUUCAUGCAAAG | 8835 |
| 54790_6_3764 | − | chr4: 105244485-105244505 | AUGAGGCUUUUUCCAACUGA | 8836 |
| 54790_6_3767 | − | chr4: 105244502-105244522 | GUAGAGGAAUAUUAAAAAUG | 8837 |
| 54790_6_3772 | − | chr4: 105244518-105244538 | CAGGAUUAUCAGCACAGUAG | 8838 |
| 54790_6_3780 | − | chr4: 105244537-105244557 | CUAUUCUUUUAGUGUUAUAC | 8839 |
| 54790_6_3788 | − | chr4: 105244638-105244658 | CGCGGUAACGUGAGGUCGGA | 8840 |
| 54790_6_3789 | − | chr4: 105244639-105244659 | GCGCGGUAACGUGAGGUCGG | 8841 |
| 54790_6_3793 | − | chr4: 105244673-105244693 | UUGGACCCUCCACCUCCAGC | 8842 |
| 54790_6_3794 | − | chr4: 105244679-105244699 | GAGAACUUGGACCCUCCACC | 8843 |
| 54790_6_3795 | − | chr4: 105244682-105244702 | UUAGAGAACUUGGACCCUCC | 8844 |
| 54790_6_3798 | − | chr4: 105244685-105244705 | CUCUUAGAGAACUUGGACCC | 8845 |
| 54790_6_3799 | − | chr4: 105244688-105244708 | GUCCUCUUAGAGAACUUGGA | 8846 |
| 54790_6_3801 | − | chr4: 105244689-105244709 | CGUCCUCUUAGAGAACUUGG | 8847 |
| 54790_6_3807 | − | chr4: 105244707-105244727 | CGAUGAUCCCUCCGACUCCG | 8848 |
| 54790_6_3809 | − | chr4: 105244711-105244731 | GGGUCGAUGAUCCCUCCGAC | 8849 |
| 54790_6_3811 | − | chr4: 105244717-105244737 | ACAUUAGGGUCGAUGAUCCC | 8850 |
| 54790_6_3813 | − | chr4: 105244720-105244740 | CGGACAUUAGGGUCGAUGAU | 8851 |
| 54790_6_3814 | − | chr4: 105244721-105244741 | ACGGACAUUAGGGUCGAUGA | 8852 |
| 54790_6_3818 | − | chr4: 105244748-105244768 | UGUUUUAAUCGGCCCACACC | 8853 |
| 54790_6_3819 | − | chr4: 105244751-105244771 | UUAUGUUUUAAUCGGCCCAC | 8854 |
| 54790_6_3820 | − | chr4: 105244756-105244776 | GAUUUUUAUGUUUUAAUCGG | 8855 |
| 54790_6_3821 | − | chr4: 105244757-105244777 | UGAUUUUUAUGUUUUAAUCG | 8856 |
| 54790_6_3826 | − | chr4: 105244795-105244815 | GCUCUGGUCGGACUGGUUGU | 8857 |
| 54790_6_3829 | − | chr4: 105244822-105244842 | CACCCGUUAGUGGACUCCAG | 8858 |
| 54790_6_3831 | − | chr4: 105244823-105244843 | CCACCCGUUAGUGGACUCCA | 8859 |
| 54790_6_3834 | − | chr4: 105244827-105244847 | GGCUCCACCCGUUAGUGGAC | 8860 |
| 54790_6_3838 | − | chr4: 105244840-105244860 | CGUGAAACCCUCCGGCUCCA | 8861 |
| 54790_6_3839 | − | chr4: 105244841-105244861 | CCGUGAAACCCUCCGGCUCC | 8862 |
| 54790_6_3841 | − | chr4: 105244844-105244864 | AUUCCGUGAAACCCUCCGGC | 8863 |
| 54790_6_3843 | − | chr4: 105244850-105244870 | ACGGACAUUCCGUGAAACCC | 8864 |
| 54790_6_3844 | − | chr4: 105244853-105244873 | AGUACGGACAUUCCGUGAAA | 8865 |
| 54790_6_3846 | − | chr4: 105244854-105244874 | GAGUACGGACAUUCCGUGAA | 8866 |
| 54790_6_3849 | − | chr4: 105244862-105244882 | GCGCCGCCGAGUACGGACAU | 8867 |
| 54790_6_3853 | − | chr4: 105244877-105244897 | AGAUUUCUCCGGUCCGCGCC | 8868 |
| 54790_6_3854 | − | chr4: 105244880-105244900 | GUAAGAUUUCUCCGGUCCGC | 8869 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_3855 | − | chr4: 105244885-105244905 | AACUUGUAAGAUUUCUCCGG | 8870 |
| 54790_6_3856 | − | chr4: 105244890-105244910 | AAAAUAACUUGUAAGAUUUC | 8871 |
| 54790_6_3862 | − | chr4: 105244914-105244934 | AUUAUUUUAAAACCAAUCGU | 8872 |
| 54790_6_3863 | − | chr4: 105244915-105244935 | AAUUAUUUUAAAACCAAUCG | 8873 |
| 54790_6_3865 | − | chr4: 105244955-105244975 | UGCAGAGAAAAGACACUAA | 8874 |
| 54790_6_3873 | − | chr4: 105244979-105244999 | CAAAUGAUUCUAUAGUUGG | 8875 |
| 54790_6_3875 | − | chr4: 105244982-105245002 | CAGCAAAUGAUUCUAUAGUU | 8876 |
| 54790_6_3887 | − | chr4: 105245046-105245066 | UAAACAGCAAAGGACAAAUU | 8877 |
| 54790_6_3889 | − | chr4: 105245056-105245076 | GUUAGAGUUUUAAACAGCAA | 8878 |
| 54790_6_3919 | − | chr4: 105245219-105245239 | GGUACACACCAUAAAAUUUU | 8879 |
| 54790_6_3924 | − | chr4: 105245240-105245260 | AAUCAUUUGUAAAAGUGGUC | 8880 |
| 54790_6_3926 | − | chr4: 105245245-105245265 | CAAUUAAUCAUUUGUAAAAG | 8881 |
| 54790_6_3941 | − | chr4: 105245373-105245393 | CGUGGUAACGUGAGGUCGGA | 8882 |
| 54790_6_3942 | − | chr4: 105245374-105245394 | GCGUGGUAACGUGAGGUCGG | 8883 |
| 54790_6_3949 | − | chr4: 105245414-105245434 | ACGAACUUGGGUCCUCUACC | 8884 |
| 54790_6_3950 | − | chr4: 105245417-105245437 | UUAACGAACUUGGGUCCUCU | 8885 |
| 54790_6_3954 | − | chr4: 105245423-105245443 | GUCCUCUUAACGAACUUGGG | 8886 |
| 54790_6_3959 | − | chr4: 105245442-105245462 | CGAUAAGCCCUCCGACUCCG | 8887 |
| 54790_6_3962 | − | chr4: 105245446-105245466 | GGGUCGAUAAGCCCUCCGAC | 8888 |
| 54790_6_3964 | − | chr4: 105245452-105245472 | ACAUUAGGGUCGAUAAGCCC | 8889 |
| 54790_6_3966 | − | chr4: 105245455-105245475 | CGGACAUUAGGGUCGAUAAG | 8890 |
| 54790_6_3967 | − | chr4: 105245456-105245476 | ACGGACAUUAGGGUCGAUAA | 8891 |
| 54790_6_3971 | − | chr4: 105245486-105245506 | UUAUGUUUUAAUCGACCCAC | 8892 |
| 54790_6_3972 | − | chr4: 105245491-105245511 | GAUUUUUAUGUUUUAAUCGA | 8893 |
| 54790_6_3973 | − | chr4: 105245492-105245512 | UGAUUUUUAUGUUUUAAUCG | 8894 |
| 54790_6_3978 | − | chr4: 105245530-105245550 | GGUCUGGUCGGACUAGUUGU | 8895 |
| 54790_6_3980 | − | chr4: 105245557-105245577 | GCCCGCCUAGUGGGCUCCAG | 8896 |
| 54790_6_3983 | − | chr4: 105245562-105245582 | GCUCCGCCCGCCUAGUGGGC | 8897 |
| 54790_6_3985 | − | chr4: 105245573-105245593 | GAGACCCUCCGGCUCCGCCC | 8898 |
| 54790_6_3987 | − | chr4: 105245576-105245596 | CGUGAGACCCUCCGGCUCCG | 8899 |
| 54790_6_3988 | − | chr4: 105245577-105245597 | UCGUGAGACCCUCCGGCUCC | 8900 |
| 54790_6_3990 | − | chr4: 105245580-105245600 | GGGUCGUGAGACCCUCCGGC | 8901 |
| 54790_6_3992 | − | chr4: 105245586-105245606 | ACAUUAGGGUCGUGAGACCC | 8902 |
| 54790_6_3993 | − | chr4: 105245589-105245609 | CGGACAUUAGGGUCGUGAGA | 8903 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_3995 | − | chr4: 105245590-105245610 | ACGGACAUUAGGGUCGUGAG | 8904 |
| 54790_6_4000 | − | chr4: 105245617-105245637 | AUAUUUCACCGACCCGUGUC | 8905 |
| 54790_6_4002 | − | chr4: 105245625-105245645 | UUAAAAAAAUAUUUCACCGA | 8906 |
| 54790_6_4003 | − | chr4: 105245626-105245646 | AUUAAAAAAAUAUUUCACCG | 8907 |
| 54790_6_4005 | − | chr4: 105245630-105245650 | GUAGAUUAAAAAAAUAUUUC | 8908 |
| 54790_6_4008 | − | chr4: 105245652-105245672 | AGAAAGAGCAAGAGGAGUCA | 8909 |
| 54790_6_4010 | − | chr4: 105245653-105245673 | CAGAAAGAGCAAGAGGAGUC | 8910 |
| 54790_6_4015 | − | chr4: 105245660-105245680 | UUUUCUUCAGAAAGAGCAAG | 8911 |
| 54790_6_4036 | − | chr4: 105245706-105245726 | UUAAUUUUUUUCUAAUUAA | 8912 |
| 54790_6_4062 | − | chr4: 105245854-105245874 | AAAACUAUCAUUUUCACAAG | 8913 |
| 54790_6_4074 | − | chr4: 105245899-105245919 | AAAAUCAAACAUUUUGCAAU | 8914 |
| 54790_6_4081 | − | chr4: 105245932-105245952 | AUGAAUGAAAUAUAGUUUCC | 8915 |
| 54790_6_4096 | − | chr4: 105246008-105246028 | UUGGGCCCUCCACCUCCAAC | 8916 |
| 54790_6_4097 | − | chr4: 105246014-105246034 | GUGAACUUGGGCCCUCCACC | 8917 |
| 54790_6_4099 | − | chr4: 105246017-105246037 | UUAGUGAACUUGGGCCCUCC | 8918 |
| 54790_6_4101 | − | chr4: 105246020-105246040 | CUCUUAGUGAACUUGGGCCC | 8919 |
| 54790_6_4103 | − | chr4: 105246023-105246043 | GUACUCUUAGUGAACUUGGG | 8920 |
| 54790_6_4104 | − | chr4: 105246024-105246044 | CGUACUCUUAGUGAACUUGG | 8921 |
| 54790_6_4111 | − | chr4: 105246046-105246066 | AGAUCGAUGAGCCCUCCGAC | 8922 |
| 54790_6_4112 | − | chr4: 105246052-105246072 | ACAUUAAGAUCGAUGAGCCC | 8923 |
| 54790_6_4114 | − | chr4: 105246055-105246075 | CGGACAUUAAGAUCGAUGAG | 8924 |
| 54790_6_4115 | − | chr4: 105246056-105246076 | ACGGACAUUAAGAUCGAUGA | 8925 |
| 54790_6_4118 | − | chr4: 105246079-105246099 | UUAUGUUUUUACUCGGCCCA | 8926 |
| 54790_6_4119 | − | chr4: 105246080-105246100 | UUUAUGUUUUUACUCGGCCC | 8927 |
| 54790_6_4121 | − | chr4: 105246083-105246103 | AUUUUAUGUUUUUACUCGG | 8928 |
| 54790_6_4122 | − | chr4: 105246084-105246104 | GAUUUUAUGUUUUUACUCG | 8929 |
| 54790_6_4127 | − | chr4: 105246123-105246143 | GCUCUAGUUAGACCGGUUGU | 8930 |
| 54790_6_4128 | − | chr4: 105246132-105246152 | GGUCCUCAAGCUCUAGUUAG | 8931 |
| 54790_6_4131 | − | chr4: 105246150-105246170 | ACCCACCCAAUGGACUUCGG | 8932 |
| 54790_6_4137 | − | chr4: 105246165-105246185 | AAACCCUCCGGUCCCACCCA | 8933 |
| 54790_6_4138 | − | chr4: 105246166-105246186 | GAAACCCUCCGGUCCCACCC | 8934 |
| 54790_6_4140 | − | chr4: 105246169-105246189 | CGUGAAACCCUCCGGUCCCA | 8935 |
| 54790_6_4141 | − | chr4: 105246170-105246190 | UCGUGAAACCCUCCGGUCCC | 8936 |
| 54790_6_4143 | − | chr4: 105246173-105246193 | GGGUCGUGAAACCCUCCGGU | 8937 |
| 54790_6_4144 | − | chr4: 105246174-105246194 | AGGGUCGUGAAACCCUCCGG | 8938 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_4146 | − | chr4: 105246179-105246199 | ACAUUAGGGUCGUGAAACCC | 8939 |
| 54790_6_4148 | − | chr4: 105246182-105246202 | UGGACAUUAGGGUCGUGAAA | 8940 |
| 54790_6_4150 | − | chr4: 105246183-105246203 | GUGGACAUUAGGGUCGUGAA | 8941 |
| 54790_6_4153 | − | chr4: 105246210-105246230 | GAAAAGCUCCGACCCGUACC | 8942 |
| 54790_6_4154 | − | chr4: 105246213-105246233 | AUGGAAAAGCUCCGACCCGU | 8943 |
| 54790_6_4155 | − | chr4: 105246218-105246238 | GAAUUAUGGAAAAGCUCCGA | 8944 |
| 54790_6_4158 | − | chr4: 105246219-105246239 | AGAAUUAUGGAAAAGCUCCG | 8945 |
| 54790_6_4160 | − | chr4: 105246223-105246243 | UAUAAGAAUUAUGGAAAAGC | 8946 |
| 54790_6_4162 | − | chr4: 105246232-105246252 | AUUGGCAUUUAUAAGAAUUA | 8947 |
| 54790_6_4169 | − | chr4: 105246250-105246270 | UCAGAUUCCAUUUCAGGCAU | 8948 |
| 54790_6_4175 | − | chr4: 105246256-105246276 | UAUAUGUCAGAUUCCAUUUC | 8949 |
| 54790_6_4185 | − | chr4: 105246320-105246340 | UCUGGUCCAACUAUUUUUCA | 8950 |
| 54790_6_4188 | − | chr4: 105246338-105246358 | CUACAAGCUUUCUGAGACUC | 8951 |
| 54790_6_4230 | − | chr4: 105246543-105246563 | AGUAUUAAAAUUUUUUAUUU | 8952 |
| 54790_6_4239 | − | chr4: 105246594-105246614 | AGUAAAGUCUGUAUUGACAU | 8953 |
| 54790_6_4248 | − | chr4: 105246644-105246664 | UAAAAUAAAAUCUAUUUAUG | 8954 |
| 54790_6_4249 | − | chr4: 105246645-105246665 | AUAAAAUAAAAUCUAUUUAU | 8955 |
| 54790_6_4251 | − | chr4: 105246646-105246666 | CAUAAAAUAAAAUCUAUUUA | 8956 |
| 54790_6_4266 | − | chr4: 105246699-105246719 | AUUAUUCUAUUCUCUGUUCU | 8957 |
| 54790_6_4275 | − | chr4: 105246769-105246789 | UUUGUAAGAACUCAGUGAUG | 8958 |
| 54790_6_4281 | − | chr4: 105246793-105246813 | GUUUGGAGCAUGUGGACACA | 8959 |
| 54790_6_4282 | − | chr4: 105246794-105246814 | GGUUUGGAGCAUGUGGACAC | 8960 |
| 54790_6_4285 | − | chr4: 105246801-105246821 | AGUGGGUGGUUUGGAGCAUG | 8961 |
| 54790_6_4291 | − | chr4: 105246810-105246830 | UGAACUCACAGUGGGUGGUU | 8962 |
| 54790_6_4294 | − | chr4: 105246815-105246835 | UUUUCUGAACUCACAGUGGG | 8963 |
| 54790_6_4295 | − | chr4: 105246818-105246838 | UUCUUUUCUGAACUCACAGU | 8964 |
| 54790_6_4296 | − | chr4: 105246819-105246839 | GUUCUUUUCUGAACUCACAG | 8965 |
| 54790_6_4309 | − | chr4: 105246889-105246909 | AAACAGCUGGUUUGGCUCAA | 8966 |
| 54790_6_4314 | − | chr4: 105246897-105246917 | UAAAGAAGAAACAGCUGGUU | 8967 |
| 54790_6_4315 | − | chr4: 105246902-105246922 | AUCUUUAAAGAAGAAACAGC | 8968 |
| 54790_6_4321 | − | chr4: 105246927-105246947 | CAUAAAAUGGAAAUCUCAAA | 8969 |
| 54790_6_4322 | − | chr4: 105246928-105246948 | UCAUAAAAUGGAAAUCUCAA | 8970 |
| 54790_6_4327 | − | chr4: 105246940-105246960 | GGUUAGACUUAGUCAUAAAA | 8971 |
| 54790_6_4331 | − | chr4: 105246961-105246981 | CUUACUUGCCAAAAAAUAC | 8972 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_4339 | − | chr4: 105247023-105247043 | ACCAUGGCAGAAGGCAUUUC | 8973 |
| 54790_6_4342 | − | chr4: 105247032-105247052 | ACAUCACCCACCAUGGCAGA | 8974 |
| 54790_6_4346 | − | chr4: 105247039-105247059 | AUGUUUAACAUCACCCACCA | 8975 |
| 54790_6_4365 | − | chr4: 105247125-105247145 | CUACGACACACUACCCAGGU | 8976 |
| 54790_6_4369 | − | chr4: 105247132-105247152 | UUUAUAACUACGACACACUA | 8977 |
| 54790_6_4370 | − | chr4: 105247133-105247153 | AUUUAUAACUACGACACACU | 8978 |
| 54790_6_4376 | − | chr4: 105247190-105247210 | UGUGAUCACCCUCACCUACA | 8979 |
| 54790_6_4379 | − | chr4: 105247191-105247211 | UUGUGAUCACCCUCACCUAC | 8980 |
| 54790_6_4382 | − | chr4: 105247197-105247217 | GAAAGUUUGUGAUCACCCUC | 8981 |
| 54790_6_4385 | − | chr4: 105247202-105247222 | AAGACGAAAGUUUGUGAUCA | 8982 |
| 54790_6_4386 | − | chr4: 105247203-105247223 | GAAGACGAAAGUUUGUGAUC | 8983 |
| 54790_6_4391 | − | chr4: 105247238-105247258 | ACUUUACAAUUGUCCAUUCU | 8984 |
| 54790_6_4392 | − | chr4: 105247246-105247266 | UAUGUAGGACUUUACAAUUG | 8985 |
| 54790_6_4420 | − | chr4: 105247387-105247407 | CUUCACAGUUAGUACACCUU | 8986 |
| 54790_6_4421 | − | chr4: 105247388-105247408 | UCUUCACAGUUAGUACACCU | 8987 |
| 54790_6_4424 | − | chr4: 105247392-105247412 | UGAGUCUUCACAGUUAGUAC | 8988 |
| 54790_6_4428 | − | chr4: 105247423-105247443 | GGUCUGUUACCUGUACUUGA | 8989 |
| 54790_6_4430 | − | chr4: 105247424-105247444 | GGGUCUGUUACCUGUACUUG | 8990 |
| 54790_6_4438 | − | chr4: 105247435-105247455 | AAUUAUCGAUAGGGUCUGUU | 8991 |
| 54790_6_4444 | − | chr4: 105247467-105247487 | UUACCUCUCUUAAAAUACUC | 8992 |
| 54790_6_4454 | − | chr4: 105247485-105247505 | GUGUCUUAAAUAGAAGAUUU | 8993 |
| 54790_6_4460 | − | chr4: 105247517-105247537 | CCCGAUAAUAUUUAUUUUUC | 8994 |
| 54790_6_4464 | − | chr4: 105247537-105247557 | UUAAGUAUUUCUUUCCCCUU | 8995 |
| 54790_6_4465 | − | chr4: 105247538-105247558 | UUUAAGUAUUUCUUUCCCCU | 8996 |
| 54790_6_4468 | − | chr4: 105247542-105247562 | UAAGUUUAAGUAUUUCUUUC | 8997 |
| 54790_6_4470 | − | chr4: 105247543-105247563 | UUAAGUUUAAGUAUUUCUUU | 8998 |
| 54790_6_4471 | − | chr4: 105247544-105247564 | UUUAAGUUUAAGUAUUUCUU | 8999 |
| 54790_6_4485 | − | chr4: 105247603-105247623 | AGCCGGUUUAGGUCUUACAC | 9000 |
| 54790_6_4487 | − | chr4: 105247604-105247624 | UAGCCGGUUUAGGUCUUACA | 9001 |
| 54790_6_4489 | − | chr4: 105247605-105247625 | UUAGCCGGUUUAGGUCUUAC | 9002 |
| 54790_6_4492 | − | chr4: 105247622-105247642 | GUUUCUUGGUUCUACUUUA | 9003 |
| 54790_6_4497 | − | chr4: 105247655-105247675 | CUAUGACCCCUAUCUCCUUA | 9004 |
| 54790_6_4499 | − | chr4: 105247661-105247681 | UGUCUUCUAUGACCCCUAUC | 9005 |
| 54790_6_4502 | − | chr4: 105247668-105247688 | GGUCAGGUGUCUUCUAUGAC | 9006 |
| 54790_6_4503 | − | chr4: 105247669-105247689 | UGGUCAGGUGUCUUCUAUGA | 9007 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_6_4506 | - | chr4: 105247670-105247690 | AUGGUCAGGUGUCUUCUAUG | 9008 |
| 54790_6_4519 | - | chr4: 105247784-105247804 | CCAACGUCACUCGACUCUAA | 9009 |
| 54790_6_4520 | - | chr4: 105247785-105247805 | UCCAACGUCACUCGACUCUA | 9010 |
| 54790_6_4525 | - | chr4: 105247805-105247825 | UCGAACUUGGACCCUCCACC | 9011 |
| 54790_6_4526 | - | chr4: 105247808-105247828 | UUAUCGAACUUGGACCCUCC | 9012 |
| 54790_6_4529 | - | chr4: 105247811-105247831 | CUCUUAUCGAACUUGGACCC | 9013 |
| 54790_6_4530 | - | chr4: 105247814-105247834 | GUACUCUUAUCGAACUUGGA | 9014 |
| 54790_6_4532 | - | chr4: 105247815-105247835 | CGUACUCUUAUCGAACUUGG | 9015 |
| 54790_6_4539 | - | chr4: 105247837-105247857 | GGGUCAAUGAGUCCUCCGAC | 9016 |
| 54790_6_4542 | - | chr4: 105247843-105247863 | ACGUCAGGGUCAAUGAGUCC | 9017 |
| 54790_6_4543 | - | chr4: 105247846-105247866 | CGAACGUCAGGGUCAAUGAG | 9018 |
| 54790_6_4546 | - | chr4: 105247874-105247894 | GUUUUUAGUCGUCCUACUCC | 9019 |
| 54790_6_4547 | - | chr4: 105247877-105247897 | CAUGUUUUUAGUCGUCCUAC | 9020 |
| 54790_6_4549 | - | chr4: 105247883-105247903 | GAUUUUCAUGUUUUUAGUCG | 9021 |
| 54790_6_4553 | - | chr4: 105247922-105247942 | GGUCUGGUCGGACCGGUUGU | 9022 |
| 54790_6_4555 | - | chr4: 105247931-105247951 | GGUCCUCAAGGUCUGGUCGG | 9023 |
| 54790_6_4557 | - | chr4: 105247949-105247969 | ACCCGCCUAGUGAACUCCGG | 9024 |
| 54790_6_4559 | - | chr4: 105247954-105247974 | GUUCCACCCGCCUAGUGAAC | 9025 |
| 54790_6_4563 | - | chr4: 105247965-105247985 | GAAACCCUCCGGUUCCACCC | 9026 |
| 54790_6_4565 | - | chr4: 105247968-105247988 | CGUGAAACCCUCCGGUUCCA | 9027 |
| 54790_6_4566 | - | chr4: 105247969-105247989 | UCGUGAAACCCUCCGGUUCC | 9028 |
| 54790_6_4568 | - | chr4: 105247972-105247992 | GGGUCGUGAAACCCUCCGGU | 9029 |
| 54790_6_4569 | - | chr4: 105247978-105247998 | ACAUUAGGGUCGUGAAACCC | 9030 |
| 54790_6_4571 | - | chr4: 105247981-105248001 | CGGACAUUAGGGUCGUGAAA | 9031 |
| 54790_6_4573 | - | chr4: 105247982-105248002 | ACGGACAUUAGGGUCGUGAA | 9032 |
| 54790_6_4578 | - | chr4: 105248017-105248037 | UAUAAUGAAUUUUUAGUCGA | 9033 |
| 54790_6_4579 | - | chr4: 105248018-105248038 | AUAUAAUGAAUUUUUAGUCG | 9034 |
| 54790_6_4593 | - | chr4: 105248144-105248164 | UGAGAAUUAUAGUGAUUUUA | 9035 |
| 54790_6_4595 | - | chr4: 105248145-105248165 | GUGAGAAUUAUAGUGAUUUU | 9036 |
| 54790_6_4598 | - | chr4: 105248189-105248209 | CUUCUUGUAUUACUACCUAG | 9037 |
| 54790_6_4600 | - | chr4: 105248195-105248215 | AAACUACUUCUUGUAUUACU | 9038 |
| 54790_6_4607 | - | chr4: 105248224-105248244 | AGUUAACUACACUUUGAUAG | 9039 |
| 54790_6_4610 | - | chr4: 105248256-105248276 | GAAUUGUUUAUUAUCUUUG | 9040 |
| 54790_6_4630 | - | chr4: 105248379-105248399 | AUAUUUUUAAAGUAAAAAUU | 9041 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_4641 | − | chr4: 105248417-105248437 | UUAACCUUUGAUUUACUAUU | 9042 |
| 54790_6_4648 | − | chr4: 105248485-105248505 | CUCAUGGUAAAUGAUAUAAA | 9043 |
| 54790_6_4649 | − | chr4: 105248486-105248506 | GCUCAUGGUAAAUGAUAUAA | 9044 |
| 54790_6_4653 | − | chr4: 105248501-105248521 | AUGACUUGAAAUUUGGCUCA | 9045 |
| 54790_6_4656 | − | chr4: 105248508-105248528 | UUUUAAUAUGACUUGAAAUU | 9046 |
| 54790_6_4669 | − | chr4: 105248568-105248588 | AGGUAUAUUUAUUUUGAUAG | 9047 |
| 54790_6_4670 | − | chr4: 105248569-105248589 | AAGGUAUAUUUAUUUUGAUA | 9048 |
| 54790_6_4671 | − | chr4: 105248570-105248590 | AAAGGUAUAUUUAUUUUGAU | 9049 |
| 54790_6_4677 | − | chr4: 105248588-105248608 | CUAAUAAAGUGGCUACUAAA | 9050 |
| 54790_6_4680 | − | chr4: 105248599-105248619 | AAGUUGAUUUCUAAUAAAG | 9051 |
| 54790_6_4682 | − | chr4: 105248631-105248651 | AGUUAUAGAAAAAAACAUGG | 9052 |
| 54790_6_4685 | − | chr4: 105248632-105248652 | GAGUUAUAGAAAAAACAUG | 9053 |
| 54790_6_4687 | − | chr4: 105248633-105248653 | AGAGUUAUAGAAAAAACAU | 9054 |
| 54790_6_4690 | − | chr4: 105248634-105248654 | UAGAGUUAUAGAAAAAACA | 9055 |
| 54790_6_4699 | − | chr4: 105248669-105248689 | GAAAUUUCCCAUUUAAAAU | 9056 |
| 54790_6_4701 | − | chr4: 105248681-105248701 | GACUUAACAUAUGAAAUUUU | 9057 |
| 54790_6_4702 | − | chr4: 105248682-105248702 | UGACUUAACAUAUGAAAUUU | 9058 |
| 54790_6_4712 | − | chr4: 105248740-105248760 | UUGCAAGACUUUGAUCCAUC | 9059 |
| 54790_6_4714 | − | chr4: 105248746-105248766 | CUACUUUUGCAAGACUUUGA | 9060 |
| 54790_6_4720 | − | chr4: 105248772-105248792 | AUUUAUGUCCCAAAGGAAGA | 9061 |
| 54790_6_4722 | − | chr4: 105248773-105248793 | UAUUUAUGUCCCAAAGGAAG | 9062 |
| 54790_6_4725 | − | chr4: 105248784-105248804 | CACUGACGGAUUAUUUAUGU | 9063 |
| 54790_6_4726 | − | chr4: 105248785-105248805 | UCACUGACGGAUUAUUUAUG | 9064 |
| 54790_6_4730 | − | chr4: 105248809-105248829 | CCUUCCUUCUUCCCCUCUUC | 9065 |
| 54790_6_4731 | − | chr4: 105248810-105248830 | UCCUUCCUUCUUCCCCUCUU | 9066 |
| 54790_6_4733 | − | chr4: 105248811-105248831 | CUCCUUCCUUCUUCCCCUCU | 9067 |
| 54790_6_4739 | − | chr4: 105248817-105248837 | GUGAAUCUCCUUCCUUCUUC | 9068 |
| 54790_6_4741 | − | chr4: 105248818-105248838 | GGUGAAUCUCCUUCCUUCUU | 9069 |
| 54790_6_4743 | − | chr4: 105248819-105248839 | CGGUGAAUCUCCUUCCUUCU | 9070 |
| 54790_6_4753 | − | chr4: 105248826-105248846 | ACACCAACGGUGAAUCUCCU | 9071 |
| 54790_6_4756 | − | chr4: 105248830-105248850 | AUAAACACCAACGGUGAAUC | 9072 |
| 54790_6_4759 | − | chr4: 105248844-105248864 | UCUUUGACUUACAAAUAAAC | 9073 |
| 54790_6_4764 | − | chr4: 105248876-105248896 | AUUAUGUUUUACGGGUCUUA | 9074 |
| 54790_6_4767 | − | chr4: 105248917-105248937 | UACUUUCUUCGGUCUCUCUU | 9075 |
| 54790_6_4776 | − | chr4: 105248943-105248963 | UUACUCUGAACUUUUGUAAC | 9076 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_6_4791 | - | chr4: 105248989-105249009 | UUUUUUUCUUUUUCUUUUU | 9077 |
| 54790_6_4794 | - | chr4: 105249020-105249040 | UACACCACACUUAUAUAUGC | 9078 |
| 54790_6_4797 | - | chr4: 105249037-105249057 | UCUGAGACAGAGUUUUUAC | 9079 |
| 54790_6_4802 | - | chr4: 105249070-105249090 | CGUGGUAACGUGGGAUCGGA | 9080 |
| 54790_6_4803 | - | chr4: 105249071-105249091 | ACGUGGUAACGUGGGAUCGG | 9081 |
| 54790_6_4806 | - | chr4: 105249095-105249115 | UGUCUCCAACGUCACUCGAC | 9082 |
| 54790_6_4810 | - | chr4: 105249111-105249131 | GUGAACUUGGGCCCUCUGUC | 9083 |
| 54790_6_4813 | - | chr4: 105249120-105249140 | GUACUCUUAGUGAACUUGGG | 9084 |
| 54790_6_4815 | - | chr4: 105249121-105249141 | CGUACUCUUAGUGAACUUGG | 9085 |
| 54790_6_4821 | - | chr4: 105249143-105249163 | AGGGUUGAUGAACCCCCGAC | 9086 |
| 54790_6_4823 | - | chr4: 105249149-105249169 | GACAUUAGGGUUGAUGAACC | 9087 |
| 54790_6_4824 | - | chr4: 105249150-105249170 | UGACAUUAGGGUUGAUGAAC | 9088 |
| 54790_6_4825 | - | chr4: 105249151-105249171 | UUGACAUUAGGGUUGAUGAA | 9089 |
| 54790_6_4828 | - | chr4: 105249152-105249172 | GUUGACAUUAGGGUUGAUGA | 9090 |
| 54790_6_4831 | - | chr4: 105249179-105249199 | GUUUUUAAUCGACCCACACC | 9091 |
| 54790_6_4832 | - | chr4: 105249182-105249202 | UAUGUUUUUAAUCGACCCAC | 9092 |
| 54790_6_4833 | - | chr4: 105249187-105249207 | AUUUUUAUGUUUUUAAUCGA | 9093 |
| 54790_6_4834 | - | chr4: 105249188-105249208 | GAUUUUUAUGUUUUUAAUCG | 9094 |
| 54790_6_4839 | - | chr4: 105249227-105249247 | ACUCUGGUCGGAUCGGUUGU | 9095 |
| 54790_6_4843 | - | chr4: 105249257-105249277 | AUUCCAUCUUCCUAGUGAAC | 9096 |
| 54790_6_4847 | - | chr4: 105249268-105249288 | GAAAUCCUCCGAUUCCAUCU | 9097 |
| 54790_6_4851 | - | chr4: 105249275-105249295 | GGGUCGUGAAAUCCUCCGAU | 9098 |
| 54790_6_4853 | - | chr4: 105249281-105249301 | ACAUUAGGGUCGUGAAAUCC | 9099 |
| 54790_6_4855 | - | chr4: 105249284-105249304 | CGAACAUUAGGGUCGUGAAA | 9100 |
| 54790_6_4857 | - | chr4: 105249312-105249332 | CUUUUACACCGACCCGUGUC | 9101 |
| 54790_6_4858 | - | chr4: 105249320-105249340 | ACCUUUUCUUUUACACCGA | 9102 |
| 54790_6_4859 | - | chr4: 105249321-105249341 | UACCUUUUCUUUUACACCG | 9103 |
| 54790_6_4861 | - | chr4: 105249325-105249345 | UAUUUACCUUUUCUUUUAC | 9104 |
| 54790_6_4865 | - | chr4: 105249340-105249360 | UUACAGUUAAUUGAUUAUUU | 9105 |
| 54790_6_4875 | - | chr4: 105249449-105249469 | UGAGGAUCCACAUAUAGGGU | 9106 |
| 54790_6_4877 | - | chr4: 105249463-105249483 | AAUGAUUGUUACAGUGAGGA | 9107 |
| 54790_6_4886 | - | chr4: 105249521-105249541 | UCGAUGAAACCUUUUGUCAA | 9108 |
| 54790_6_4887 | - | chr4: 105249533-105249553 | CAUUUUCGUAUUUCGAUGAA | 9109 |
| 54790_6_4894 | - | chr4: 105249563-105249583 | GACCUUGGAAGUAUGUAACA | 9110 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_4899 | - | chr4: 105249582-105249602 | AACUCCUACACCUCUAUGUG | 9111 |
| 54790_6_4903 | - | chr4: 105249593-105249613 | UAUUGUAAAAGAACUCCUAC | 9112 |
| 54790_6_4906 | - | chr4: 105249599-105249619 | UUCUGUUAUUGUAAAAGAAC | 9113 |
| 54790_6_4912 | - | chr4: 105249633-105249653 | UUUGAAGUAUGGGUGAACCU | 9114 |
| 54790_6_4913 | - | chr4: 105249637-105249657 | UCUAUUUGAAGUAUGGGUGA | 9115 |
| 54790_6_4918 | - | chr4: 105249681-105249701 | CUACGGGUUAUAGUCGGUAA | 9116 |
| 54790_6_4924 | - | chr4: 105249722-105249742 | UGAAAAGAGUUUUUUAUGU | 9117 |
| 54790_6_4931 | - | chr4: 105249822-105249842 | CCUCUUUUAUAGACGUUUGG | 9118 |
| 54790_6_4933 | - | chr4: 105249843-105249863 | CUUCGCUGUUGGACACCCUA | 9119 |
| 54790_6_4937 | - | chr4: 105249848-105249868 | UUUCACUUCGCUGUUGGACA | 9120 |
| 54790_6_4939 | - | chr4: 105249849-105249869 | GUUUCACUUCGCUGUUGGAC | 9121 |
| 54790_6_4949 | - | chr4: 105249879-105249899 | AAAUUUGAAAACAUGAAAU | 9122 |
| 54790_6_4963 | - | chr4: 105249975-105249995 | UUAGAAAGUCUAGAACUUAC | 9123 |
| 54790_6_4967 | - | chr4: 105250002-105250022 | UAUGAGACUCUUCUUUCGUA | 9124 |
| 54790_6_4980 | - | chr4: 105250094-105250114 | AUGAACGUUUCCUUACUUCA | 9125 |
| 54790_6_4984 | - | chr4: 105250105-105250125 | UUGACCUGUCGAUGAACGUU | 9126 |
| 54790_6_4989 | - | chr4: 105250122-105250142 | UGUUUACCACGACUCUUUUG | 9127 |
| 54790_6_4993 | - | chr4: 105250137-105250157 | UUUUUGUCAGAAAAUUGUUU | 9128 |
| 54790_6_4998 | - | chr4: 105250174-105250194 | UCUUUAUUUGGGUAUGUAGA | 9129 |
| 54790_6_5005 | - | chr4: 105250236-105250256 | CUUAGUCGUGUCACACCAUG | 9130 |
| 54790_6_5006 | - | chr4: 105250242-105250262 | GAUGUCCUUAGUCGUGUCAC | 9131 |
| 54790_6_5012 | - | chr4: 105250258-105250278 | UUUUAAAUGAUGUUUUGAUG | 9132 |
| 54790_6_5018 | - | chr4: 105250303-105250323 | CCAUCCGUUUUCAUGUUUCA | 9133 |
| 54790_6_5020 | - | chr4: 105250320-105250340 | CCUUUGGGUUCUUUGUACCA | 9134 |
| 54790_6_5021 | - | chr4: 105250324-105250344 | UAUACCUUUGGGUUCUUUGU | 9135 |
| 54790_6_5024 | - | chr4: 105250341-105250361 | UCGACUAGAAUUUUACGUAU | 9136 |
| 54790_6_5029 | - | chr4: 105250367-105250387 | UUUUUUUAGGUCUUUCCUUU | 9137 |
| 54790_6_5033 | - | chr4: 105250373-105250393 | UUUUUUUUUUUUAGGUCUU | 9138 |
| 54790_6_5040 | - | chr4: 105250440-105250460 | GUCCUCAAGUUUUGGUCGAA | 9139 |
| 54790_6_5041 | - | chr4: 105250441-105250461 | GGUCCUCAAGUUUUGGUCGA | 9140 |
| 54790_6_5043 | - | chr4: 105250459-105250479 | CUCCCUCCUAGAGAAAUCGG | 9141 |
| 54790_6_5046 | - | chr4: 105250474-105250494 | GAGACCCUUCGGAUCCUCCC | 9142 |
| 54790_6_5049 | - | chr4: 105250477-105250497 | CGAGAGACCCUUCGGAUCCU | 9143 |
| 54790_6_5050 | - | chr4: 105250478-105250498 | UCGAGAGACCCUUCGGAUCC | 9144 |
| 54790_6_5054 | - | chr4: 105250481-105250501 | GGGUCGAGAGACCCUUCGGA | 9145 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_5057 | - | chr4: 105250490-105250510 | CGGACAUUGGGGUCGAGAGA | 9146 |
| 54790_6_5059 | - | chr4: 105250491-105250511 | ACGGACAUUGGGGUCGAGAG | 9147 |
| 54790_6_5062 | - | chr4: 105250518-105250538 | GUCUUCCCCCAACCUACACC | 9148 |
| 54790_6_5063 | - | chr4: 105250521-105250541 | AGGGUCUUCCCCCAACCUAC | 9149 |
| 54790_6_5064 | - | chr4: 105250527-105250547 | AGUUUCAGGGUCUUCCCCCA | 9150 |
| 54790_6_5066 | - | chr4: 105250531-105250551 | GGUCAGUUUCAGGGUCUUCC | 9151 |
| 54790_6_5067 | - | chr4: 105250532-105250552 | GGGUCAGUUUCAGGGUCUUC | 9152 |
| 54790_6_5068 | - | chr4: 105250533-105250553 | GGGGUCAGUUUCAGGGUCUU | 9153 |
| 54790_6_5070 | - | chr4: 105250534-105250554 | UGGGGUCAGUUUCAGGGUCU | 9154 |
| 54790_6_5084 | - | chr4: 105250612-105250632 | UUAUCGGACACAAGUAUUUA | 9155 |
| 54790_6_5091 | - | chr4: 105250638-105250658 | CUUUCUUUAAAUUCUUAUUU | 9156 |
| 54790_6_5101 | - | chr4: 105250692-105250712 | AAUUUUUUUUAUUUUUCACG | 9157 |
| 54790_6_5104 | - | chr4: 105250735-105250755 | CGUCGUGACGUGAGACCUGA | 9158 |
| 54790_6_5105 | - | chr4: 105250736-105250756 | CCGUCGUGACGUGAGACCUG | 9159 |
| 54790_6_5107 | - | chr4: 105250741-105250761 | CUCUACCGUCGUGACGUGAG | 9160 |
| 54790_6_5110 | - | chr4: 105250757-105250777 | CUCCAACGUCACUCGACUCU | 9161 |
| 54790_6_5114 | - | chr4: 105250776-105250796 | AGUGAACUUGGGCCUCCACC | 9162 |
| 54790_6_5116 | - | chr4: 105250779-105250799 | CUUAGUGAACUUGGGCCUCC | 9163 |
| 54790_6_5118 | - | chr4: 105250782-105250802 | CCUCUUAGUGAACUUGGGCC | 9164 |
| 54790_6_5120 | - | chr4: 105250785-105250805 | CGUCCUCUUAGUGAACUUGG | 9165 |
| 54790_6_5125 | - | chr4: 105250803-105250823 | GGACAUCAAGGUCGACUCCG | 9166 |
| 54790_6_5128 | - | chr4: 105250807-105250827 | GCGUGGACAUCAAGGUCGAC | 9167 |
| 54790_6_5131 | - | chr4: 105250832-105250852 | UUUGUUAAUCGGUCCGUACC | 9168 |
| 54790_6_5132 | - | chr4: 105250835-105250855 | UGUUUUGUUAAUCGGUCCGU | 9169 |
| 54790_6_5133 | - | chr4: 105250840-105250860 | UUUUGUGUUUUGUUAAUCGG | 9170 |
| 54790_6_5137 | - | chr4: 105250882-105250902 | ACUCUGGUCGGACCGGUUGU | 9171 |
| 54790_6_5138 | - | chr4: 105250891-105250911 | GGUCCACAAACUCUGGUCGG | 9172 |
| 54790_6_5141 | - | chr4: 105250909-105250929 | GUCAGUCCAGUGAACUCCGG | 9173 |
| 54790_6_5142 | - | chr4: 105250914-105250934 | GUUCCGUCAGUCCAGUGAAC | 9174 |
| 54790_6_5146 | - | chr4: 105250924-105250944 | AAACCCUCCGGUUCCGUCAG | 9175 |
| 54790_6_5147 | - | chr4: 105250932-105250952 | GGGUCAUGAAACCCUCCGGU | 9176 |
| 54790_6_5148 | - | chr4: 105250938-105250958 | ACAUUAGGGUCAUGAAACCC | 9177 |
| 54790_6_5150 | - | chr4: 105250941-105250961 | CGGACAUUAGGGUCAUGAAA | 9178 |
| 54790_6_5151 | - | chr4: 105250942-105250962 | ACGGACAUUAGGGUCAUGAA | 9179 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_5154 | - | chr4: 105250969-105250989 | CUUCAUGUCCGGUCCGCACC | 9180 |
| 54790_6_5158 | - | chr4: 105250972-105250992 | UGUCUUCAUGUCCGGUCCGC | 9181 |
| 54790_6_5159 | - | chr4: 105250977-105250997 | AAAAUUGUCUUCAUGUCCGG | 9182 |
| 54790_6_5160 | - | chr4: 105250982-105251002 | UUUUUAAAAUUGUCUUCAUG | 9183 |
| 54790_6_5169 | - | chr4: 105251023-105251043 | UUUUUUAAACUAAAACGUUA | 9184 |
| 54790_6_5178 | - | chr4: 105251095-105251115 | UCGAUCAAGUCGUUCAACCA | 9185 |
| 54790_6_5180 | - | chr4: 105251099-105251119 | UUAUUCGAUCAAGUCGUUCA | 9186 |
| 54790_6_5183 | - | chr4: 105251146-105251166 | GAACAUACGUCGUUUAGGAU | 9187 |
| 54790_6_5191 | - | chr4: 105251211-105251231 | UUUGUAUUUCGGUGGGUCUA | 9188 |
| 54790_6_5196 | - | chr4: 105251242-105251262 | CUUCAAGAUUGACCCAUUAG | 9189 |
| 54790_6_5199 | - | chr4: 105251250-105251270 | UAAAAGACCUUCAAGAUUGA | 9190 |
| 54790_6_5200 | - | chr4: 105251251-105251271 | GUAAAAGACCUUCAAGAUUG | 9191 |
| 54790_6_5206 | - | chr4: 105251264-105251284 | AUUAACAUGGACUGUAAAAG | 9192 |
| 54790_6_5214 | - | chr4: 105251301-105251321 | AAAGAUUUUACUUAUUCUGU | 9193 |
| 54790_6_5219 | - | chr4: 105251342-105251362 | UGUUGAUCAUAGUAUGAAUU | 9194 |
| 54790_6_5232 | - | chr4: 105251405-105251425 | AGUUGUUUGAUCGUUGUCUU | 9195 |
| 54790_6_5233 | - | chr4: 105251406-105251426 | AAGUUGUUUGAUCGUUGUCU | 9196 |
| 54790_6_5253 | - | chr4: 105251506-105251526 | UAUGGUAUAAUUAUCUUAUU | 9197 |
| 54790_6_5263 | - | chr4: 105251583-105251603 | UUAUGUGUGACUCCGGUUCA | 9198 |
| 54790_6_5264 | - | chr4: 105251584-105251604 | AUUAUGUGUGACUCCGGUUC | 9199 |
| 54790_6_5267 | - | chr4: 105251592-105251612 | UAUUUUCAUUAUGUGUGAC | 9200 |
| 54790_6_5285 | - | chr4: 105251760-105251780 | GAGAAGGUUUUCUAUCUCUU | 9201 |
| 54790_6_5288 | - | chr4: 105251761-105251781 | UGAGAAGGUUUUCUAUCUCU | 9202 |
| 54790_6_5304 | - | chr4: 105251834-105251854 | AGGGUGUUUCCUUUCGGGUC | 9203 |
| 54790_6_5305 | - | chr4: 105251835-105251855 | AAGGGUGUUUCCUUUCGGGU | 9204 |
| 54790_6_5308 | - | chr4: 105251836-105251856 | UAAGGGUGUUUCCUUUCGGG | 9205 |
| 54790_6_5312 | - | chr4: 105251846-105251866 | AUGUUUUUUUAAGGGUGUU | 9206 |
| 54790_6_5328 | - | chr4: 105251936-105251956 | UGUCCCCGUCGUACAUGAAU | 9207 |
| 54790_6_5330 | - | chr4: 105251952-105251972 | CCCUCCGAUACGUGUAUGUC | 9208 |
| 54790_6_5331 | - | chr4: 105251953-105251973 | UCCCUCCGAUACGUGUAUGU | 9209 |
| 54790_6_5332 | - | chr4: 105251954-105251974 | CUCCCUCCGAUACGUGUAUG | 9210 |
| 54790_6_5336 | - | chr4: 105251969-105251989 | UUCCUACAACUAUUACUCCC | 9211 |
| 54790_6_5338 | - | chr4: 105251972-105251992 | CAUUCCUACAACUAUUACU | 9212 |
| 54790_6_5341 | - | chr4: 105251973-105251993 | CCAUUCCUACAACUAUUAC | 9213 |
| 54790_6_5344 | - | chr4: 105251988-105252008 | GUUUACAUGGUAAGACCAUU | 9214 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_5347 | − | chr4: 105251994-105252014 | GACGUUGUUUACAUGGUAAG | 9215 |
| 54790_6_5352 | − | chr4: 105252025-105252045 | AGUAGCUGUUAACAGUUACG | 9216 |
| 54790_6_5355 | − | chr4: 105252069-105252089 | GUGUCUUAUGUAUUGUGGUU | 9217 |
| 54790_6_5358 | − | chr4: 105252101-105252121 | ACUUACUCAUAGUAAUUUGU | 9218 |
| 54790_6_5363 | − | chr4: 105252124-105252144 | AUGAGACUUACUAUGACAUU | 9219 |
| 54790_6_5369 | − | chr4: 105252156-105252176 | AUCCCAUGUCUCCUGAAAAU | 9220 |
| 54790_6_5370 | − | chr4: 105252166-105252186 | CUUUUUAUCCAUCCCAUGUC | 9221 |
| 54790_6_5373 | − | chr4: 105252174-105252194 | CAUCCUCUCUUUUUAUCCAU | 9222 |
| 54790_6_5374 | − | chr4: 105252175-105252195 | CCAUCCUCUCUUUUUAUCCA | 9223 |
| 54790_6_5377 | − | chr4: 105252179-105252199 | CACCCCAUCCUCUCUUUUUA | 9224 |
| 54790_6_5382 | − | chr4: 105252192-105252212 | AACGAUUCCCAAUCACCCCA | 9225 |
| 54790_6_5385 | − | chr4: 105252196-105252216 | AACCAACGAUUCCCAAUCAC | 9226 |
| 54790_6_5386 | − | chr4: 105252197-105252217 | UAACCAACGAUUCCCAAUCA | 9227 |
| 54790_6_5388 | − | chr4: 105252198-105252218 | GUAACCAACGAUUCCCAAUC | 9228 |
| 54790_6_5390 | − | chr4: 105252205-105252225 | UUUUCUAGUAACCAACGAUU | 9229 |
| 54790_6_5391 | − | chr4: 105252206-105252226 | UUUUUCUAGUAACCAACGAU | 9230 |
| 54790_6_5395 | − | chr4: 105252215-105252235 | AUAACUCUAUUUUUCUAGUA | 9231 |
| 54790_6_5399 | − | chr4: 105252244-105252264 | UGAUAUACUGUAAGACCUUA | 9232 |
| 54790_6_5401 | − | chr4: 105252250-105252270 | UAAGGUUGAUAUACUGUAAG | 9233 |
| 54790_6_5403 | − | chr4: 105252289-105252309 | ACUGUUUUGGUCAGACUUU | 9234 |
| 54790_6_5410 | − | chr4: 105252336-105252356 | UUACUUGCUAGUACUGUACC | 9235 |
| 54790_6_5412 | − | chr4: 105252339-105252359 | UCUUUACUUGCUAGUACUGU | 9236 |
| 54790_6_5419 | − | chr4: 105252382-105252402 | UUGACACUAUUUGGUCUGUU | 9237 |
| 54790_6_5423 | − | chr4: 105252412-105252432 | CUACAGAAAGUGAUACACUU | 9238 |
| 54790_6_5432 | − | chr4: 105252445-105252465 | AUAAGUAUUAACAGUUUUGA | 9239 |
| 54790_6_5444 | − | chr4: 105252518-105252538 | CGAGACACAAUAAAUGAGUU | 9240 |
| 54790_6_5460 | − | chr4: 105252619-105252639 | GAAAGACAAACAAGACGUUU | 9241 |
| 54790_6_5474 | − | chr4: 105252718-105252738 | UGUCUUGUAUAUCUACUGGA | 9242 |
| 54790_6_5479 | − | chr4: 105252749-105252769 | UACGCUUGAUAUUUUAAAG | 9243 |
| 54790_6_5488 | − | chr4: 105252791-105252811 | AACGUUUUAAUUACGUUUUA | 9244 |
| 54790_6_5489 | − | chr4: 105252792-105252812 | AAACGUUUUAAUUACGUUUU | 9245 |
| 54790_6_5496 | − | chr4: 105252862-105252882 | UCUUUACCAUGCCCUUGUUG | 9246 |
| 54790_6_5498 | − | chr4: 105252871-105252891 | AUCAGAAAUUCUUUACCAUG | 9247 |
| 54790_6_5501 | − | chr4: 105252872-105252892 | UAUCAGAAAUUCUUUACCAU | 9248 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_5503 | - | chr4: 105252877-105252897 | GUUUCUAUCAGAAAUUCUUU | 9249 |
| 54790_6_5507 | - | chr4: 105252913-105252933 | CUAGAAACUGUUUCAUCGUU | 9250 |
| 54790_6_5513 | - | chr4: 105252982-105253002 | UCAGAUCUGUUUAUAUAGUU | 9251 |
| 54790_6_5519 | - | chr4: 105253009-105253029 | AAUUGUUCUAUCACACCAUA | 9252 |
| 54790_6_5520 | - | chr4: 105253015-105253035 | GGAUUCAAUUGUUCUAUCAC | 9253 |
| 54790_6_5523 | - | chr4: 105253073-105253093 | UUCCUCUUUUUGUUACAGUC | 9254 |
| 54790_6_5528 | - | chr4: 105253092-105253112 | UUAUCGGUUGAGUUAUGACU | 9255 |
| 54790_6_5539 | - | chr4: 105253121-105253141 | ACGAAAAAAUGAAUCAUUA | 9256 |
| 54790_6_5548 | - | chr4: 105253185-105253205 | UAAAAUUUCAAAUAUAGUUC | 9257 |
| 54790_6_5554 | - | chr4: 105253222-105253242 | UUUUAAGGACGUUCUAAAAC | 9258 |
| 54790_6_5561 | - | chr4: 105253286-105253306 | CUUCUACACAUAACAGUUCU | 9259 |
| 54790_6_5564 | - | chr4: 105253308-105253328 | CUACAAGGUACAAGUACCUA | 9260 |
| 54790_6_5567 | - | chr4: 105253313-105253333 | UUUCUCUACAAGGUACAAGU | 9261 |
| 54790_6_5572 | - | chr4: 105253345-105253365 | UUUUACGUUUUAAGAUUACU | 9262 |
| 54790_6_5576 | - | chr4: 105253368-105253388 | UAUACAUGUACCAGAUAUAC | 9263 |
| 54790_6_5578 | - | chr4: 105253369-105253389 | UUAUACAUGUACCAGAUAUA | 9264 |
| 54790_6_5579 | - | chr4: 105253370-105253390 | AUUAUACAUGUACCAGAUAU | 9265 |
| 54790_6_5584 | - | chr4: 105253379-105253399 | CAUAUUUAGAUUAUACAUGU | 9266 |
| 54790_6_5599 | - | chr4: 105253514-105253534 | ACUAAUAUAUUGUACCAACG | 9267 |
| 54790_6_5601 | - | chr4: 105253521-105253541 | AGAUUUCACUAAUAUAUUGU | 9268 |
| 54790_6_5602 | - | chr4: 105253545-105253565 | UACUGGUUUUUUUUUUUUG | 9269 |
| 54790_6_5615 | - | chr4: 105253630-105253650 | GUAAUUCUGUUCUUUUAUUU | 9270 |
| 54790_6_5619 | - | chr4: 105253668-105253688 | UUACGGAAAGUUGUAGUAUG | 9271 |
| 54790_6_5625 | - | chr4: 105253711-105253731 | AGGACGACUCUAGUCCUUGU | 9272 |
| 54790_6_5628 | - | chr4: 105253718-105253738 | CUUCUAAAGGACGACUCUAG | 9273 |
| 54790_6_5638 | - | chr4: 105253841-105253861 | AGUCAUUUGAUCCUUUUCUC | 9274 |
| 54790_6_5640 | - | chr4: 105253842-105253862 | GAGUCAUUUGAUCCUUUUCU | 9275 |
| 54790_6_5643 | - | chr4: 105253843-105253863 | AGAGUCAUUUGAUCCUUUUC | 9276 |
| 54790_6_5650 | - | chr4: 105253851-105253871 | GUUUCGGAGAGUCAUUUGA | 9277 |
| 54790_6_5655 | - | chr4: 105253915-105253935 | GUAUACCAUUAUAGUUAUCC | 9278 |
| 54790_6_5658 | - | chr4: 105253918-105253938 | UUAGUAUACCAUUAUAGUUA | 9279 |
| 54790_6_5660 | - | chr4: 105253931-105253951 | AUUCGAUUUCUUUUUAGUAU | 9280 |
| 54790_6_5671 | - | chr4: 105254008-105254028 | UUGGUACACCCUAAACGAGG | 9281 |
| 54790_6_5672 | - | chr4: 105254020-105254040 | UAUUACUAGUGUUGGUACA | 9282 |
| 54790_6_5673 | - | chr4: 105254021-105254041 | UUAUUACAUAGUGUUGGUAC | 9283 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_6_5685 | - | chr4: 105254131-105254151 | GAAGUAUUGAAUAAGAUACU | 9284 |
| 54790_6_5686 | - | chr4: 105254132-105254152 | UGAAGUAUUGAAUAAGAUAC | 9285 |
| 54790_6_5705 | - | chr4: 105254208-105254228 | ACUAAAGAUGGUUUCAAAAU | 9286 |
| 54790_6_5709 | - | chr4: 105254238-105254258 | UUGUUUCAUGGUCUGUGUCU | 9287 |
| 54790_6_5718 | - | chr4: 105254303-105254323 | ACGUUUUAUUAUUAGAUUUA | 9288 |
| 54790_6_5721 | - | chr4: 105254345-105254365 | CUUUACCUGGUUAAGGAACU | 9289 |
| 54790_6_5726 | - | chr4: 105254361-105254381 | UAAAUUAUUAGUUCCACUUU | 9290 |
| 54790_6_5729 | - | chr4: 105254369-105254389 | CGGGUGUGUAAAUUAUUAGU | 9291 |
| 54790_6_5733 | - | chr4: 105254420-105254440 | UCUGGGACAGAGUUUUUGUU | 9292 |
| 54790_6_5737 | - | chr4: 105254454-105254474 | UAUGAUGACGUGAGGUCGGA | 9293 |
| 54790_6_5738 | - | chr4: 105254455-105254475 | GUAUGAUGACGUGAGGUCGG | 9294 |
| 54790_6_5743 | - | chr4: 105254495-105254515 | GUGAACUCGGGUCCUUCAGU | 9295 |
| 54790_6_5745 | - | chr4: 105254504-105254524 | ACCCAUUUAGUGAACUCGGG | 9296 |
| 54790_6_5749 | - | chr4: 105254523-105254543 | CGAUGAACCCUCCGACUCCA | 9297 |
| 54790_6_5750 | - | chr4: 105254524-105254544 | UCGAUGAACCCUCCGACUCC | 9298 |
| 54790_6_5752 | - | chr4: 105254527-105254547 | GGCUCGAUGAACCCUCCGAC | 9299 |
| 54790_6_5754 | - | chr4: 105254533-105254553 | ACAUCAGGCUCGAUGAACCC | 9300 |
| 54790_6_5756 | - | chr4: 105254536-105254556 | CGGACAUCAGGCUCGAUGAA | 9301 |
| 54790_6_5757 | - | chr4: 105254537-105254557 | ACGGACAUCAGGCUCGAUGA | 9302 |
| 54790_6_5762 | - | chr4: 105254564-105254584 | UUUUUUAAUCGGUCCGUACC | 9303 |
| 54790_6_5763 | - | chr4: 105254567-105254587 | UAUUUUUUAAUCGGUCCGU | 9304 |
| 54790_6_5764 | - | chr4: 105254572-105254592 | AUUAUUAUUUUUUAAUCGG | 9305 |
| 54790_6_5766 | - | chr4: 105254611-105254631 | UUCUGGUGUGACCCGUUGUA | 9306 |
| 54790_6_5769 | - | chr4: 105254620-105254640 | GUCCUCAAGUUCUGGUGUGA | 9307 |
| 54790_6_5771 | - | chr4: 105254621-105254641 | GGUCCUCAAGUUCUGGUGUG | 9308 |
| 54790_6_5775 | - | chr4: 105254639-105254659 | GUCCGUCUAACGAACUCAGG | 9309 |
| 54790_6_5780 | - | chr4: 105254658-105254678 | GUGAGAAACCUCCGACUCCG | 9310 |
| 54790_6_5781 | - | chr4: 105254662-105254682 | GGUAGUGAGAAACCUCCGAC | 9311 |
| 54790_6_5783 | - | chr4: 105254668-105254688 | CGUUAGGGUAGUGAGAAACC | 9312 |
| 54790_6_5784 | - | chr4: 105254671-105254691 | GGACGUUAGGGUAGUGAGAA | 9313 |
| 54790_6_5788 | - | chr4: 105254700-105254720 | ACGGUAGUCCGAUCCACACU | 9314 |
| 54790_6_5790 | - | chr4: 105254708-105254728 | UUUUCAAGACGGUAGUCCGA | 9315 |
| 54790_6_5792 | - | chr4: 105254713-105254733 | AGGAUUUUCAAGACGGUAG | 9316 |
| 54790_6_5801 | - | chr4: 105254774-105254794 | AGUACGAAGGUAUCCUCCUC | 9317 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_6_5804 | − | chr4: 105254775-105254795 | AAGUACGAAGGUAUCCUCCU | 9318 |
| 54790_6_5805 | − | chr4: 105254776-105254796 | GAAGUACGAAGGUAUCCUCC | 9319 |
| 54790_6_5809 | − | chr4: 105254779-105254799 | AGGGAAGUACGAAGGUAUCC | 9320 |
| 54790_6_5811 | − | chr4: 105254782-105254802 | UUUAGGGAAGUACGAAGGUA | 9321 |
| 54790_6_5822 | − | chr4: 105254828-105254848 | GAUGUAAGUCCUCGGUCUAC | 9322 |
| 54790_6_5828 | − | chr4: 105254840-105254860 | AAACACUCAAAAGAUGUAAG | 9323 |
| 54790_6_5832 | − | chr4: 105254874-105254894 | GUUUCCGUAGGUCAGUAUUA | 9324 |
| 54790_6_5834 | − | chr4: 105254891-105254911 | AAGUCACACUUGUUGAGGUU | 9325 |
| 54790_6_5838 | − | chr4: 105254914-105254934 | AUAUUAACUACUUAACGACC | 9326 |
| 54790_6_5840 | − | chr4: 105254917-105254937 | UUUAUAUUAACUACUUAACG | 9327 |
| 54790_6_5845 | − | chr4: 105254948-105254968 | CAUCCUUGGUCACAACCCUA | 9328 |
| 54790_6_5848 | − | chr4: 105254953-105254973 | GGAGACAUCCUUGGUCACAA | 9329 |
| 54790_6_5849 | − | chr4: 105254954-105254974 | UGGAGACAUCCUUGGUCACA | 9330 |
| 54790_6_5854 | − | chr4: 105254966-105254986 | UGACCUCGUCUUUGGAGACA | 9331 |
| 54790_6_5858 | − | chr4: 105254984-105255004 | AUUUUUCUUAAUGUCGAAUG | 9332 |
| 54790_6_5862 | − | chr4: 105255008-105255028 | GAGUGUUGGUUCCUUCGUCU | 9333 |
| 54790_6_5864 | − | chr4: 105255018-105255038 | UUAGUGACGGGAGUGUUGGU | 9334 |
| 54790_6_5867 | − | chr4: 105255043-105255063 | CAGUCUCUUUACUCCAGUGU | 9335 |
| 54790_6_5869 | − | chr4: 105255044-105255064 | ACAGUCUCUUUACUCCAGUG | 9336 |
| 54790_6_5873 | − | chr4: 105255051-105255071 | AAUCUAGACAGUCUCUUUAC | 9337 |
| 54790_6_5878 | − | chr4: 105255097-105255117 | UUAGACUUAUAUGGAUGUUG | 9338 |
| 54790_6_5897 | − | chr4: 105255193-105255213 | GUAUGAGUAUAAAAUAACCU | 9339 |
| 54790_6_5899 | − | chr4: 105255197-105255217 | AGCUGUAUGAGUAUAAAAUA | 9340 |
| 54790_6_5908 | − | chr4: 105255271-105255291 | UUUAUAUGAGGAUAUGUCAG | 9341 |
| 54790_6_5912 | − | chr4: 105255297-105255317 | UUGUUCGUUUAAACCCAUUA | 9342 |
| 54790_6_5914 | − | chr4: 105255304-105255324 | GUACUUAUUGUUCGUUUAAA | 9343 |
| 54790_6_5915 | − | chr4: 105255305-105255325 | UGUACUUAUUGUUCGUUUAA | 9344 |
| 54790_6_5924 | − | chr4: 105255410-105255430 | UGCACUUUGUAAGAGGUCCU | 9345 |
| 54790_6_5926 | − | chr4: 105255414-105255434 | CGUGUGCACUUUGUAAGAGG | 9346 |
| 54790_6_5933 | − | chr4: 105255498-105255518 | UUUUUGUGAUAUUGGUUGA | 9347 |
| 54790_6_5944 | − | chr4: 105255562-105255582 | AUGAUUAGGUGAAAGUUAUU | 9348 |
| 54790_6_5947 | − | chr4: 105255600-105255620 | CGUUUUUACCGUCUUAAUU | 9349 |
| 54790_6_5950 | − | chr4: 105255612-105255632 | UUUUAUGUACUUCGUUUUUU | 9350 |
| 54790_6_5966 | − | chr4: 105255773-105255793 | UAUAUUUAACUUUUUAAUUU | 9351 |
| 54790_6_5971 | − | chr4: 105255834-105255854 | UUCUGUUCUAUGUCUGUUUU | 9352 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_5978 | − | chr4: 105255899-105255919 | UUUUUAAAUCAUUUUCUGUU | 9353 |
| 54790_6_5980 | − | chr4: 105255900-105255920 | UUUUUUAAAUCAUUUUCUGU | 9354 |
| 54790_6_5990 | − | chr4: 105255940-105255960 | AUUCAAUCAACAUUAGGGGU | 9355 |
| 54790_6_5991 | − | chr4: 105255941-105255961 | UAUUCAAUCAACAUUAGGGG | 9356 |
| 54790_6_6001 | − | chr4: 105255985-105256005 | AGGAAUAUAACAUUACUUUA | 9357 |
| 54790_6_6003 | − | chr4: 105256017-105256037 | UUCUCCCUUACAUCGAUAUA | 9358 |
| 54790_6_6005 | − | chr4: 105256018-105256038 | UUUCUCCCUUACAUCGAUAU | 9359 |
| 54790_6_6009 | − | chr4: 105256033-105256053 | UUAUCGUGUCUCAUUUUUCU | 9360 |
| 54790_6_6012 | − | chr4: 105256034-105256054 | AUUAUCGUGUCUCAUUUUUC | 9361 |
| 54790_6_6018 | − | chr4: 105256080-105256100 | UUUUGUAUUAGACACAAUUA | 9362 |
| 54790_6_6019 | − | chr4: 105256081-105256101 | UUUUUGUAUUAGACACAAUU | 9363 |
| 54790_6_6040 | − | chr4: 105256188-105256208 | UGGUCAUUUCUAUUAAUGUA | 9364 |
| 54790_6_6046 | − | chr4: 105256253-105256273 | UAUGAAGUCCGACUUUCCUU | 9365 |
| 54790_6_6049 | − | chr4: 105256258-105256278 | UUACAUAUGAAGUCCGACUU | 9366 |
| 54790_6_6052 | − | chr4: 105256266-105256286 | UUUAUGAUUUACAUAUGAAG | 9367 |
| 54790_6_6059 | − | chr4: 105256302-105256322 | UUAUUCUCAAAUAACAAAAG | 9368 |
| 54790_6_6064 | − | chr4: 105256338-105256358 | UUACAUAAUAUAUUAUUUAA | 9369 |
| 54790_6_6078 | − | chr4: 105256436-105256456 | GUCUUUGUUACUUCUGGUCU | 9370 |
| 54790_6_6086 | − | chr4: 105256491-105256511 | ACAUACUAAUAGUACAUACG | 9371 |
| 54790_6_6100 | − | chr4: 105256661-105256681 | CUUCUUAUAAACUUUUUAUU | 9372 |
| 54790_6_6104 | − | chr4: 105256683-105256703 | CUCCUACUUCUUAUUUCUUA | 9373 |
| 54790_6_6109 | − | chr4: 105256702-105256722 | UUACGUCCAGGGGUUUCAUC | 9374 |
| 54790_6_6112 | − | chr4: 105256717-105256737 | AUGGUUGUAUCUGUAUUACG | 9375 |
| 54790_6_6113 | − | chr4: 105256754-105256774 | UUGUCUUGGAGUCUCUAGAC | 9376 |
| 54790_6_6128 | − | chr4: 105256827-105256847 | CAACUUUCCUCCCCUUUUU | 9377 |
| 54790_6_6129 | − | chr4: 105256828-105256848 | UCAACUUUCCUCCCCUUUU | 9378 |
| 54790_6_6134 | − | chr4: 105256835-105256855 | UAUCGUCUCAACUUUUCCUC | 9379 |
| 54790_6_6136 | − | chr4: 105256836-105256856 | UUAUCGUCUCAACUUUUCCU | 9380 |
| 54790_6_6138 | − | chr4: 105256837-105256857 | GUUAUCGUCUCAACUUUUCC | 9381 |
| 54790_6_6141 | − | chr4: 105256840-105256860 | CAAGUUAUCGUCUCAACUUU | 9382 |
| 54790_6_6146 | − | chr4: 105256862-105256882 | UUGACGUCAUUUUUAAUCUC | 9383 |
| 54790_6_6147 | − | chr4: 105256863-105256883 | AUUGACGUCAUUUUUAAUCU | 9384 |
| 54790_6_6149 | − | chr4: 105256864-105256884 | UAUUGACGUCAUUUUUAAUC | 9385 |
| 54790_6_6172 | − | chr4: 105257041-105257061 | UUCAGGUCUACAAUCCGGUG | 9386 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_6175 | − | chr4: 105257048-105257068 | GGACUUUUUCAGGUCUACAA | 9387 |
| 54790_6_6177 | − | chr4: 105257076-105257096 | GGGAUAUUUCAUCAGUUAUC | 9388 |
| 54790_6_6180 | − | chr4: 105257100-105257120 | UCUCUUUGUCUUUGUUUCAU | 9389 |
| 54790_6_6190 | − | chr4: 105257175-105257195 | AGAGUUGCACGACCCUAAUG | 9390 |
| 54790_6_6193 | − | chr4: 105257183-105257203 | GAAACCGGAGAGUUGCACGA | 9391 |
| 54790_6_6194 | − | chr4: 105257184-105257204 | CGAAACCGGAGAGUUGCACG | 9392 |
| 54790_6_6198 | − | chr4: 105257200-105257220 | GAAUUCACUACGAGGACGAA | 9393 |
| 54790_6_6200 | − | chr4: 105257223-105257243 | GUCCGAUCAGAACUUGAGGA | 9394 |
| 54790_6_6201 | − | chr4: 105257224-105257244 | GGUCCGAUCAGAACUUGAGG | 9395 |
| 54790_6_6204 | − | chr4: 105257242-105257262 | UCCCAGAGUGAUACGACGGG | 9396 |
| 54790_6_6215 | − | chr4: 105257261-105257281 | AAAAUAAAAACAUCUCUGU | 9397 |
| 54790_6_6217 | − | chr4: 105257262-105257282 | UAAAAUAAAAACAUCUCUG | 9398 |
| 54790_6_6231 | − | chr4: 105257328-105257348 | UCAUUGUAUAAGACCCGUCC | 9399 |
| 54790_6_6232 | − | chr4: 105257329-105257349 | GUCAUUGUAUAAGACCCGUC | 9400 |
| 54790_6_6233 | − | chr4: 105257330-105257350 | UGUCAUUGUAUAAGACCCGU | 9401 |
| 54790_6_6236 | − | chr4: 105257331-105257351 | UUGUCAUUGUAUAAGACCCG | 9402 |
| 54790_6_6238 | − | chr4: 105257335-105257355 | GUCUUUGUCAUUGUAUAAGA | 9403 |
| 54790_6_6239 | − | chr4: 105257336-105257356 | GGUCUUUGUCAUUGUAUAAG | 9404 |
| 54790_6_6246 | − | chr4: 105257388-105257408 | UCUUUGUUAUGUUUGAAAUA | 9405 |
| 54790_6_6253 | − | chr4: 105257420-105257440 | AUUGGUUCGUUUCUGAAGCU | 9406 |
| 54790_6_6259 | − | chr4: 105257475-105257495 | AAUAACUAGAGUCCGUGGAU | 9407 |
| 54790_6_6262 | − | chr4: 105257484-105257504 | UUCUGACUGAAUAACUAGAG | 9408 |
| 54790_6_6267 | − | chr4: 105257554-105257574 | UAGGUCUCGACGUUUAUCGG | 9409 |
| 54790_6_6269 | − | chr4: 105257580-105257600 | AGACGUGUUCGUCCCUUAUU | 9410 |
| 54790_6_6272 | − | chr4: 105257588-105257608 | GAACUCUGAGACGUGUUCGU | 9411 |
| 54790_6_6273 | − | chr4: 105257589-105257609 | GGAACUCUGAGACGUGUUCG | 9412 |
| 54790_6_6280 | − | chr4: 105257657-105257677 | CUUUCGGUGUACGUUGACAU | 9413 |
| 54790_6_6281 | − | chr4: 105257658-105257678 | UCUUUCGGUGUACGUUGACA | 9414 |
| 54790_6_6287 | − | chr4: 105257686-105257706 | CCGAAACUUUUAUAUAAGGA | 9415 |
| 54790_6_6289 | − | chr4: 105257687-105257707 | UCCGAAACUUUUAUAUAAGG | 9416 |
| 54790_6_6293 | − | chr4: 105257707-105257727 | CUUUACUCUACUAGGUGUCC | 9417 |
| 54790_6_6296 | − | chr4: 105257710-105257730 | ACCCUUUACUCUACUAGGUG | 9418 |
| 54790_6_6300 | − | chr4: 105257729-105257749 | UCGAAUUUUCAUUUAAUGGA | 9419 |
| 54790_6_6303 | − | chr4: 105257730-105257750 | UUCGAAUUUUCAUUUAAUGG | 9420 |
| 54790_6_6306 | − | chr4: 105257776-105257796 | UGAGUCCACAUCGAUUAUUG | 9421 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_6310 | - | chr4: 105257792-105257812 | AACUUAUAACAGUGACUGAG | 9422 |
| 54790_6_6314 | - | chr4: 105257821-105257841 | CCGUAAACAGUUUAUUAGUA | 9423 |
| 54790_6_6318 | - | chr4: 105257842-105257862 | CACUUGGUGGAAAAGGUGUC | 9424 |
| 54790_6_6328 | - | chr4: 105257877-105257897 | AUAGAAAUGAAAUAGAUUGA | 9425 |
| 54790_6_6333 | - | chr4: 105257901-105257921 | GGACCUUCUAGGGUGAUCAU | 9426 |
| 54790_6_6339 | - | chr4: 105257919-105257939 | ACUGGACAAACCAUCAAAGG | 9427 |
| 54790_6_6343 | - | chr4: 105257930-105257950 | GAAUGUAAUAAACUGGACAA | 9428 |
| 54790_6_6349 | - | chr4: 105257982-105258002 | ACCUAUAUGAGAUCUGACCA | 9429 |
| 54790_6_6351 | - | chr4: 105257986-105258006 | ACCAACCUAUAUGAGAUCUG | 9430 |
| 54790_6_6352 | - | chr4: 105258002-105258022 | GAUCUCCUCCGGUCUAACCA | 9431 |
| 54790_6_6354 | - | chr4: 105258006-105258026 | CGGUGAUCUCCUCCGGUCUA | 9432 |
| 54790_6_6355 | - | chr4: 105258015-105258035 | UCGGUCCGACGGUGAUCUCC | 9433 |
| 54790_6_6357 | - | chr4: 105258018-105258038 | UCGUCGGUCCGACGGUGAUC | 9434 |
| 54790_6_6363 | - | chr4: 105258031-105258051 | AUAAUACUUUUCGUCGUCGG | 9435 |
| 54790_6_6371 | - | chr4: 105258082-105258102 | AUUGAAAGGGGUGUCGAGAU | 9436 |
| 54790_6_6374 | - | chr4: 105258110-105258130 | UCACUCUUCUCACUCGAGAC | 9437 |
| 54790_6_6383 | - | chr4: 105258138-105258158 | ACAAGUUCCCUUUUUUUCUG | 9438 |
| 54790_6_6386 | - | chr4: 105258151-105258171 | AUAUCCCUCUUAAACAAGUU | 9439 |
| 54790_6_6387 | - | chr4: 105258152-105258172 | UAUAUCCCUCUUAAACAAGU | 9440 |
| 54790_6_6394 | - | chr4: 105258167-105258187 | UUUUUCGAACGUCGUUAUAU | 9441 |
| 54790_6_6395 | - | chr4: 105258168-105258188 | GUUUUUCGAACGUCGUUAUA | 9442 |
| 54790_6_6404 | - | chr4: 105258198-105258218 | UCUUAGUCGAAAAGUCUAG | 9443 |
| 54790_6_6411 | - | chr4: 105258276-105258296 | AGUCGUUUUUACCGUCUUAU | 9444 |
| 54790_6_6416 | - | chr4: 105258286-105258306 | AAAUGUCUACAGUCGUUUUU | 9445 |
| 54790_6_6424 | - | chr4: 105258333-105258353 | AAGGUCGAUUAUUUACGUUU | 9446 |
| 54790_6_6428 | - | chr4: 105258373-105258393 | UACCAUUGAUUGCCAACUAC | 9447 |
| 54790_6_6432 | - | chr4: 105258382-105258402 | GAUAUAAUUUACCAUUGAUU | 9448 |
| 54790_6_6435 | - | chr4: 105258392-105258412 | AAGAAUGUUUGAUAUAAUUU | 9449 |
| 54790_6_6451 | - | chr4: 105258514-105258534 | CAUUACUGUGGAGGUAUCGU | 9450 |
| 54790_6_6452 | - | chr4: 105258515-105258535 | UCAUUACUGUGGAGGUAUCG | 9451 |
| 54790_6_6472 | - | chr4: 105258631-105258651 | UAUGAGACAGUUGAUACUUA | 9452 |
| 54790_6_6494 | - | chr4: 105258769-105258789 | UGAAUGUUCUUUUUUAUAAG | 9453 |
| 54790_6_6508 | - | chr4: 105258883-105258903 | CUCACGAUCCAGGAUCAAAG | 9454 |
| 54790_6_6510 | - | chr4: 105258896-105258916 | AACUACCCGUAAACUCACGA | 9455 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_6_6514 | − | chr4: 105258911-105258931 | ACUUAAUAAGAUGGUAACUA | 9456 |
| 54790_6_6515 | − | chr4: 105258912-105258932 | UACUUAAUAAGAUGGUAACU | 9457 |
| 54790_6_6536 | − | chr4: 105259013-105259033 | CACGAAAAAGGUAAUACAAA | 9458 |
| 54790_6_6540 | − | chr4: 105259014-105259034 | ACACGAAAAAGGUAAUACAA | 9459 |
| 54790_6_6545 | − | chr4: 105259063-105259083 | UUGAUAUAUACAUAGGUAUU | 9460 |
| 54790_6_6551 | − | chr4: 105259070-105259090 | AAAAUACUUGAUAUAUACAU | 9461 |
| 54790_6_6556 | − | chr4: 105259127-105259147 | AGGGUUUAUCGACCUUGAUA | 9462 |
| 54790_6_6558 | − | chr4: 105259136-105259156 | CGGAGUCGGAGGGUUUAUCG | 9463 |
| 54790_6_6564 | − | chr4: 105259175-105259195 | GUCCAACUUGGACUUGAAGA | 9464 |
| 54790_6_6565 | − | chr4: 105259176-105259196 | AGUCCAACUUGGACUUGAAG | 9465 |
| 54790_6_6570 | − | chr4: 105259194-105259214 | CCCCAGAACGAUACAACGAG | 9466 |
| 54790_6_6578 | − | chr4: 105259213-105259233 | UGCAAAGAAAAAUGUCUAC | 9467 |
| 54790_6_6580 | − | chr4: 105259214-105259234 | AUGCAAAGAAAAAUGUCUA | 9468 |
| 54790_6_6581 | − | chr4: 105259215-105259235 | AAUGCAAAGAAAAAUGUCU | 9469 |
| 54790_6_6601 | − | chr4: 105259334-105259354 | UGUUUUAUAAAUGAUAGGGG | 9470 |
| 54790_6_6612 | − | chr4: 105259391-105259411 | UAUUAAAAUGUCAAAUGUUU | 9471 |
| 54790_6_6629 | − | chr4: 105259492-105259512 | AGAUUGAGACAUAAUUCGAC | 9472 |
| 54790_6_6637 | − | chr4: 105259551-105259571 | GGCUGUGCAGCUGAUAUUAU | 9473 |
| 54790_6_6641 | − | chr4: 105259572-105259592 | UGCUAUGGAUAGCAUUAUAU | 9474 |
| 54790_7_20 | + | chr4: 105259833-105259853 | GUGAACAAUAUGACAUAUCU | 9475 |
| 54790_7_28 | + | chr4: 105259893-105259913 | AUACACACUAUUUUUUAAGU | 9476 |
| 54790_7_39 | + | chr4: 105259956-105259976 | AGCAACAAAAACUUCCUCUU | 9477 |
| 54790_7_46 | + | chr4: 105259986-105260006 | UGUUAAUUCCAAAGUUUUAA | 9478 |
| 54790_7_49 | + | chr4: 105259987-105260007 | GUUAAUUCCAAAGUUUUAAA | 9479 |
| 54790_7_50 | + | chr4: 105259988-105260008 | UUAAUUCCAAAGUUUUAAAG | 9480 |
| 54790_7_60 | + | chr4: 105260022-105260042 | UGUUAAAACUAAAUGAGAAU | 9481 |
| 54790_7_69 | + | chr4: 105260055-105260075 | CAUAUUUUGACUCUGAAUUA | 9482 |
| 54790_7_100 | + | chr4: 105260221-105260241 | AUUUUAAUAUAACUCUGUAA | 9483 |
| 54790_7_105 | + | chr4: 105260231-105260251 | AACUCUGUAAUGGAAAUAAA | 9484 |
| 54790_7_107 | + | chr4: 105260258-105260278 | UAAUUUCUCACUGAAGUCAU | 9485 |
| 54790_7_124 | + | chr4: 105260325-105260345 | UUGAUAAAUUUAACAACUUU | 9486 |
| 54790_7_125 | + | chr4: 105260326-105260346 | UGAUAAAUUUAACAACUUUU | 9487 |
| 54790_7_127 | + | chr4: 105260329-105260349 | UAAAUUUAACAACUUUUGGG | 9488 |
| 54790_7_137 | + | chr4: 105260368-105260388 | UAGAUACUUCUUGACUUAUG | 9489 |
| 54790_7_147 | + | chr4: 105260464-105260484 | AAAAAAAACGAAGCCAUUAU | 9490 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_7_150 | + | chr4: 105260469-105260489 | AAACGAAGCCAUUAUAGGUC | 9491 |
| 54790_7_151 | + | chr4: 105260470-105260490 | AACGAAGCCAUUAUAGGUCA | 9492 |
| 54790_7_198 | + | chr4: 105260739-105260759 | UCACAGUAUAAGUUUUUUAA | 9493 |
| 54790_7_242 | + | chr4: 105260921-105260941 | AAAUGUUUAUCACUUUCACG | 9494 |
| 54790_7_249 | + | chr4: 105260945-105260965 | UUCAUGUAAACCAAAUCCAG | 9495 |
| 54790_7_253 | + | chr4: 105260973-105260993 | AAGUAACUUAUUGCCUCUGU | 9496 |
| 54790_7_254 | + | chr4: 105260974-105260994 | AGUAACUUAUUGCCUCUGUU | 9497 |
| 54790_7_256 | + | chr4: 105260978-105260998 | ACUUAUUGCCUCUGUUGGGU | 9498 |
| 54790_7_265 | + | chr4: 105261030-105261050 | CUAAAAUUUACAUCUCUGCC | 9499 |
| 54790_7_267 | + | chr4: 105261033-105261053 | AAAUUUACAUCUCUGCCAGG | 9500 |
| 54790_7_287 | + | chr4: 105261101-105261121 | UGAAGACUUCUAAGUAUAAA | 9501 |
| 54790_7_291 | + | chr4: 105261149-105261169 | UUUUUUAACAGUAUAUUACU | 9502 |
| 54790_7_302 | + | chr4: 105261172-105261192 | AAAAUCUGUUCUUCAUGAGC | 9503 |
| 54790_7_303 | + | chr4: 105261173-105261193 | AAAUCUGUUCUUCAUGAGCA | 9504 |
| 54790_7_304 | + | chr4: 105261177-105261197 | CUGUUCUUCAUGAGCAGGGC | 9505 |
| 54790_7_307 | + | chr4: 105261180-105261200 | UUCUUCAUGAGCAGGGCAGG | 9506 |
| 54790_7_309 | + | chr4: 105261181-105261201 | UCUUCAUGAGCAGGGCAGGU | 9507 |
| 54790_7_310 | + | chr4: 105261182-105261202 | CUUCAUGAGCAGGGCAGGUG | 9508 |
| 54790_7_311 | + | chr4: 105261183-105261203 | UUCAUGAGCAGGGCAGGUGG | 9509 |
| 54790_7_317 | + | chr4: 105261224-105261244 | CUUUCAAGUAAAUUCUGCAA | 9510 |
| 54790_7_334 | + | chr4: 105261303-105261323 | AGUAAAUUUUAGUUGCUCUA | 9511 |
| 54790_7_353 | + | chr4: 105261412-105261432 | UUUUAAUAGUUCAUCUUCCU | 9512 |
| 54790_7_360 | + | chr4: 105261447-105261467 | GUGACCUCUUUAAGACCAUA | 9513 |
| 54790_7_363 | + | chr4: 105261473-105261493 | AAUUCCCUAACCCUACUCC | 9514 |
| 54790_7_366 | + | chr4: 105261479-105261499 | CCUAACCCUACUCCUGGCAC | 9515 |
| 54790_7_380 | + | chr4: 105261619-105261639 | GAUGCUUUAUUUAGUAAUAA | 9516 |
| 54790_7_386 | + | chr4: 105261638-105261658 | AAGGCACCAUAUAUUGUGUU | 9517 |
| 54790_7_388 | + | chr4: 105261639-105261659 | AGGCACCAUAUAUUGUGUUU | 9518 |
| 54790_7_391 | + | chr4: 105261654-105261674 | UGUUUGGGAUUCAAAAUGUA | 9519 |
| 54790_7_394 | + | chr4: 105261655-105261675 | GUUUGGGAUUCAAAAUGUAA | 9520 |
| 54790_7_395 | + | chr4: 105261656-105261676 | UUUGGGAUUCAAAAUGUAAG | 9521 |
| 54790_7_404 | + | chr4: 105261696-105261716 | UCUCUUUUACAUAGAGAAAA | 9522 |
| 54790_7_412 | − | chr4: 105259762-105259782 | GAAGUAAACAAACCUCUUUU | 9523 |
| 54790_7_413 | − | chr4: 105259763-105259783 | GGAAGUAAACAAACCUCUUU | 9524 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_7_416 | − | chr4: 105259784-105259804 | AAAUAAAGCGAUUAUACAUC | 9525 |
| 54790_7_433 | − | chr4: 105259884-105259904 | AUAGUGUGUAUCUACAGUUU | 9526 |
| 54790_7_435 | − | chr4: 105259885-105259905 | AAUAGUGUGUAUCUACAGUU | 9527 |
| 54790_7_448 | − | chr4: 105259937-105259957 | UCAAAUUUUAUCUAUUAUUU | 9528 |
| 54790_7_456 | − | chr4: 105259973-105259993 | AUUAACAUAAAAGACCAAAG | 9529 |
| 54790_7_462 | − | chr4: 105259997-105260017 | GUGACACCCCUUUAAAACUU | 9530 |
| 54790_7_482 | − | chr4: 105260111-105260131 | CACAUAAAUGUGACUAAAAA | 9531 |
| 54790_7_532 | − | chr4: 105260404-105260424 | UCAUUUUACAACGGAUUUAU | 9532 |
| 54790_7_536 | − | chr4: 105260413-105260433 | AAUGGAUUUUCAUUUUACAA | 9533 |
| 54790_7_541 | − | chr4: 105260431-105260451 | CCAAAUAACCCGGUAUUAAA | 9534 |
| 54790_7_548 | − | chr4: 105260441-105260461 | GAAAUCCUACCCAAAUAACC | 9535 |
| 54790_7_551 | − | chr4: 105260442-105260462 | UGAAAUCCUACCCAAAUAAC | 9536 |
| 54790_7_554 | − | chr4: 105260443-105260463 | AUGAAAUCCUACCCAAAUAA | 9537 |
| 54790_7_555 | − | chr4: 105260444-105260464 | AAUGAAAUCCUACCCAAAUA | 9538 |
| 54790_7_562 | − | chr4: 105260452-105260472 | AAAAAAAAAUGAAAUCCUA | 9539 |
| 54790_7_563 | − | chr4: 105260453-105260473 | CAAAAAAAAAUGAAAUCCU | 9540 |
| 54790_7_565 | − | chr4: 105260457-105260477 | GAAGCAAAAAAAAAUGAAA | 9541 |
| 54790_7_567 | − | chr4: 105260480-105260500 | UCUGUCAGGGACUGGAUAUU | 9542 |
| 54790_7_573 | − | chr4: 105260503-105260523 | UUCUCAUCAUUCAAUUAGUA | 9543 |
| 54790_7_576 | − | chr4: 105260528-105260548 | GCUAAAUGCUAAAUAUACUG | 9544 |
| 54790_7_578 | − | chr4: 105260556-105260576 | CAUUAGAAUGACUGAAAAUG | 9545 |
| 54790_7_590 | − | chr4: 105260622-105260642 | AUGUUAUAAUAUCUAUAGUA | 9546 |
| 54790_7_598 | − | chr4: 105260653-105260673 | UAACAAAUUCUUCAUUUAAA | 9547 |
| 54790_7_600 | − | chr4: 105260654-105260674 | UUAACAAAUUCUUCAUUUAA | 9548 |
| 54790_7_603 | − | chr4: 105260677-105260697 | UAGUAAGUGAAAGCUUAAUA | 9549 |
| 54790_7_619 | − | chr4: 105260735-105260755 | AAAACUUAUACUGUGAUUUC | 9550 |
| 54790_7_646 | − | chr4: 105260904-105260924 | UUUAUCACUUGAUAAAACAG | 9551 |
| 54790_7_655 | − | chr4: 105260958-105260978 | UACUUGGUAUCCUCUGGAUU | 9552 |
| 54790_7_656 | − | chr4: 105260964-105260984 | AUAAGUUACUUGGUAUCCUC | 9553 |
| 54790_7_658 | − | chr4: 105260974-105260994 | AACAGAGGCAUAAGUUACU | 9554 |
| 54790_7_659 | − | chr4: 105260989-105261009 | AGAGCUCUCCUACCCAACAG | 9555 |
| 54790_7_668 | − | chr4: 105261021-105261041 | GUAAAUUUUAGAAGGUGAGG | 9556 |
| 54790_7_669 | − | chr4: 105261024-105261044 | GAUGUAAAUUUUAGAAGGUG | 9557 |
| 54790_7_673 | − | chr4: 105261029-105261049 | GCAGAGAUGUAAAUUUUAGA | 9558 |
| 54790_7_678 | − | chr4: 105261051-105261071 | AGUUGUGAGACAUAACCACC | 9559 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_7_694 | − | chr4: 105261145-105261165 | AUAUACUGUUAAAAAUGGU | 9560 |
| 54790_7_697 | − | chr4: 105261149-105261169 | AGUAAUAUACUGUUAAAAA | 9561 |
| 54790_7_709 | − | chr4: 105261224-105261244 | UUGCAGAAUUUACUUGAAAG | 9562 |
| 54790_7_710 | − | chr4: 105261225-105261245 | UUUGCAGAAUUUACUUGAAA | 9563 |
| 54790_7_712 | − | chr4: 105261226-105261246 | CUUUGCAGAAUUUACUUGAA | 9564 |
| 54790_7_719 | − | chr4: 105261261-105261281 | AUGCUUCAGAACUAGAAUGC | 9565 |
| 54790_7_727 | − | chr4: 105261289-105261309 | UUUACUGGACACUUCAAAUA | 9566 |
| 54790_7_729 | − | chr4: 105261304-105261324 | AUAGAGCAACUAAAAUUUAC | 9567 |
| 54790_7_737 | − | chr4: 105261339-105261359 | AAGAUAGUAUUUAAAUAAUU | 9568 |
| 54790_7_763 | − | chr4: 105261432-105261452 | GUCACAUUUUUUAGCUACCA | 9569 |
| 54790_7_768 | − | chr4: 105261454-105261474 | UAAGCCGUAUGGUCUUAAAG | 9570 |
| 54790_7_771 | − | chr4: 105261465-105261485 | GUUAGGGGAAUUAAGCCGUA | 9571 |
| 54790_7_772 | − | chr4: 105261480-105261500 | UGUGCCAGGAGUAGGGUUAG | 9572 |
| 54790_7_774 | − | chr4: 105261481-105261501 | CUGUGCCAGGAGUAGGGUUA | 9573 |
| 54790_7_776 | − | chr4: 105261482-105261502 | CCUGUGCCAGGAGUAGGGUU | 9574 |
| 54790_7_779 | − | chr4: 105261487-105261507 | ACAAGCCUGUGCCAGGAGUA | 9575 |
| 54790_7_780 | − | chr4: 105261488-105261508 | CACAAGCCUGUGCCAGGAGU | 9576 |
| 54790_7_786 | − | chr4: 105261494-105261514 | UAUACACACAAGCCUGUGCC | 9577 |
| 54790_7_815 | − | chr4: 105261647-105261667 | UGAAUCCCAAACACAAUAUA | 9578 |
| 54790_8_1 | + | chr4: 105261846-105261866 | AGGUAAGUUUAAAUAAUCAU | 9579 |
| 54790_8_42 | + | chr4: 105262053-105262073 | CAUGCGCUUCUAAAAGUCAC | 9580 |
| 54790_8_50 | + | chr4: 105262114-105262134 | UUGUUUCUGUAAACAGACUA | 9581 |
| 54790_8_56 | + | chr4: 105262136-105262156 | GAGAUUACAUCAAAAUUAUG | 9582 |
| 54790_8_58 | + | chr4: 105262149-105262169 | AAUUAUGUGGCCCAAGCUAU | 9583 |
| 54790_8_73 | + | chr4: 105262272-105262292 | CAUUGUAAGUAUAUAUAUUU | 9584 |
| 54790_8_103 | + | chr4: 105262395-105262415 | AAACUAUAGCUAGUUAAGAC | 9585 |
| 54790_8_104 | + | chr4: 105262407-105262427 | GUUAAGACAGGUAGAUGAUU | 9586 |
| 54790_8_111 | + | chr4: 105262430-105262450 | UCAGAAAUCUCUCAUCAUGA | 9587 |
| 54790_8_120 | + | chr4: 105262524-105262544 | UAAACACUGUGUUUAGUCAC | 9588 |
| 54790_8_121 | + | chr4: 105262525-105262545 | AAACACUGUGUUUAGUCACU | 9589 |
| 54790_8_123 | + | chr4: 105262535-105262555 | UUUAGUCACUGGGAACAUAA | 9590 |
| 54790_8_130 | + | chr4: 105262582-105262602 | UUUAAGAAUUCCGUCUUUGC | 9591 |
| 54790_8_131 | + | chr4: 105262583-105262603 | UUAAGAAUUCCGUCUUUGCU | 9592 |
| 54790_8_134 | + | chr4: 105262588-105262608 | AAUUCCGUCUUUGCUGGGUA | 9593 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_135 | + | chr4: 105262591-105262611 | UCCGUCUUUGCUGGGUACGG | 9594 |
| 54790_8_140 | + | chr4: 105262618-105262638 | CACCUUUAAUCCCAACACUU | 9595 |
| 54790_8_142 | + | chr4: 105262619-105262639 | ACCUUUAAUCCCAACACUUU | 9596 |
| 54790_8_144 | + | chr4: 105262622-105262642 | UUUAAUCCCAACACUUUGGG | 9597 |
| 54790_8_147 | + | chr4: 105262628-105262648 | CCCAACACUUUGGGAGGCCA | 9598 |
| 54790_8_148 | + | chr4: 105262632-105262652 | ACACUUUGGGAGGCCAAGGC | 9599 |
| 54790_8_150 | + | chr4: 105262635-105262655 | CUUUGGGAGGCCAAGGCAGG | 9600 |
| 54790_8_154 | + | chr4: 105262646-105262666 | CAAGGCAGGUGGAUCACCUG | 9601 |
| 54790_8_156 | + | chr4: 105262651-105262671 | CAGGUGGAUCACCUGAGGUC | 9602 |
| 54790_8_160 | + | chr4: 105262678-105262698 | CUAGACCAGCCUGAUCAACA | 9603 |
| 54790_8_165 | + | chr4: 105262716-105262736 | ACUAAAAAUACAAAAUUAGC | 9604 |
| 54790_8_166 | + | chr4: 105262717-105262737 | CUAAAAAUACAAAAUUAGCU | 9605 |
| 54790_8_167 | + | chr4: 105262722-105262742 | AAUACAAAAUUAGCUGGGUG | 9606 |
| 54790_8_168 | + | chr4: 105262725-105262745 | ACAAAAUUAGCUGGGUGUGG | 9607 |
| 54790_8_169 | + | chr4: 105262729-105262749 | AAUUAGCUGGGUGUGGUGGC | 9608 |
| 54790_8_172 | + | chr4: 105262752-105262772 | CACCUGUAAUCCCAGCUACU | 9609 |
| 54790_8_174 | + | chr4: 105262756-105262776 | UGUAAUCCCAGCUACUCGGA | 9610 |
| 54790_8_175 | + | chr4: 105262762-105262782 | CCCAGCUACUCGGAAGGCUA | 9611 |
| 54790_8_178 | + | chr4: 105262766-105262786 | GCUACUCGGAAGGCUAAGGC | 9612 |
| 54790_8_183 | + | chr4: 105262784-105262804 | GCAGGAGAAUAGCUUGAACC | 9613 |
| 54790_8_185 | + | chr4: 105262785-105262805 | CAGGAGAAUAGCUUGAACCU | 9614 |
| 54790_8_187 | + | chr4: 105262788-105262808 | GAGAAUAGCUUGAACCUGGG | 9615 |
| 54790_8_190 | + | chr4: 105262791-105262811 | AAUAGCUUGAACCUGGGAGG | 9616 |
| 54790_8_191 | + | chr4: 105262794-105262814 | AGCUUGAACCUGGGAGGUGG | 9617 |
| 54790_8_196 | + | chr4: 105262835-105262855 | AAACCAUUGCACUCCAGCCU | 9618 |
| 54790_8_201 | + | chr4: 105262888-105262908 | AAAAAAAUUCAUCUUUAAC | 9619 |
| 54790_8_202 | + | chr4: 105262889-105262909 | AAAAAAUUCAUCUUUAACU | 9620 |
| 54790_8_203 | + | chr4: 105262894-105262914 | AAUUCAUCUUUAACUGGGUG | 9621 |
| 54790_8_211 | + | chr4: 105262925-105262945 | GCCUGUAAUCCCAGCUACCC | 9622 |
| 54790_8_213 | + | chr4: 105262933-105262953 | UCCCAGCUACCCAGGAGACC | 9623 |
| 54790_8_216 | + | chr4: 105262942-105262962 | CCCAGGAGACCAGGAGUCUG | 9624 |
| 54790_8_217 | + | chr4: 105262948-105262968 | AGACCAGGAGUCUGAGGCUG | 9625 |
| 54790_8_220 | + | chr4: 105262982-105263002 | UGCAUCACUGUGCUCCAUCC | 9626 |
| 54790_8_221 | + | chr4: 105262983-105263003 | GCAUCACUGUGCUCCAUCCU | 9627 |
| 54790_8_227 | + | chr4: 105263045-105263065 | CAAAGAAUUCCUUCUUUAG | 9628 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_237 | + | chr4: 105263099-105263119 | UAGAAUUACACAGUUCCAGC | 9629 |
| 54790_8_253 | + | chr4: 105263213-105263233 | AUCUUUGAACUUUAUUCUGU | 9630 |
| 54790_8_257 | + | chr4: 105263223-105263243 | UUUAUUCUGUAGGUAACCAU | 9631 |
| 54790_8_258 | + | chr4: 105263224-105263244 | UUAUUCUGUAGGUAACCAUU | 9632 |
| 54790_8_263 | + | chr4: 105263244-105263264 | GGGCUGUUUCAAGUGUGUGU | 9633 |
| 54790_8_266 | + | chr4: 105263245-105263265 | GGCUGUUUCAAGUGUGUGUU | 9634 |
| 54790_8_268 | + | chr4: 105263246-105263266 | GCUGUUUCAAGUGUGUGUUG | 9635 |
| 54790_8_270 | + | chr4: 105263250-105263270 | UUUCAAGUGUGUGUUGGGGA | 9636 |
| 54790_8_274 | + | chr4: 105263254-105263274 | AAGUGUGUGUUGGGGAUGGA | 9637 |
| 54790_8_276 | + | chr4: 105263255-105263275 | AGUGUGUGUUGGGGAUGGAA | 9638 |
| 54790_8_285 | + | chr4: 105263306-105263326 | AUUUACUUAAAAGCCAAGUA | 9639 |
| 54790_8_286 | + | chr4: 105263307-105263327 | UUUACUUAAAAGCCAAGUAA | 9640 |
| 54790_8_300 | + | chr4: 105263365-105263385 | AAGAAAGCUAUUGCAAUCAU | 9641 |
| 54790_8_301 | + | chr4: 105263366-105263386 | AGAAAGCUAUUGCAAUCAUU | 9642 |
| 54790_8_305 | + | chr4: 105263381-105263401 | UCAUUGGGCAAGAGAUUUUA | 9643 |
| 54790_8_309 | + | chr4: 105263395-105263415 | AUUUUAAGGACCUAAAGAAA | 9644 |
| 54790_8_311 | + | chr4: 105263399-105263419 | UAAGGACCUAAAGAAAUGGC | 9645 |
| 54790_8_316 | + | chr4: 105263424-105263444 | UUAAGUAUGUACACUAACUA | 9646 |
| 54790_8_318 | + | chr4: 105263427-105263447 | AGUAUGUACACUAACUAAGG | 9647 |
| 54790_8_323 | + | chr4: 105263443-105263463 | AAGGUGGAGCUUAGAGAACU | 9648 |
| 54790_8_326 | + | chr4: 105263458-105263478 | GAACUUGGUGACUAGAUGUA | 9649 |
| 54790_8_335 | + | chr4: 105263475-105263495 | GUAUGGAUGAGAAAAGAAUU | 9650 |
| 54790_8_339 | + | chr4: 105263499-105263519 | GAUACAACAAAUUUCCAGUU | 9651 |
| 54790_8_340 | + | chr4: 105263504-105263524 | AACAAAUUUCCAGUUUGGAC | 9652 |
| 54790_8_348 | + | chr4: 105263533-105263553 | UAUUAACUAGUAUCAGAAAU | 9653 |
| 54790_8_353 | + | chr4: 105263553-105263573 | UGGUAAGAAAUAGUAAGUUU | 9654 |
| 54790_8_355 | + | chr4: 105263554-105263574 | GGUAAGAAAUAGUAAGUUUU | 9655 |
| 54790_8_359 | + | chr4: 105263558-105263578 | AGAAAUAGUAAGUUUUGGGA | 9656 |
| 54790_8_361 | + | chr4: 105263559-105263579 | GAAAUAGUAAGUUUUGGGAU | 9657 |
| 54790_8_363 | + | chr4: 105263560-105263580 | AAAUAGUAAGUUUUGGGAUG | 9658 |
| 54790_8_369 | + | chr4: 105263580-105263600 | GGGAGAAGAUAUCAAAAUUU | 9659 |
| 54790_8_370 | + | chr4: 105263590-105263610 | AUCAAAAUUUUGGACAUGCU | 9660 |
| 54790_8_371 | + | chr4: 105263598-105263618 | UUUGGACAUGCUAGGCUUCU | 9661 |
| 54790_8_376 | + | chr4: 105263610-105263630 | AGGCUUCUAGGUUAAUUAGA | 9662 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_383 | + | chr4: 105263619-105263639 | GGUUAAUUAGAUGGAGAAUC | 9663 |
| 54790_8_388 | + | chr4: 105263632-105263652 | GAGAAUCAGGAGAAAAAUUC | 9664 |
| 54790_8_394 | + | chr4: 105263665-105263685 | AGAUUUGAGAGUCAGAAUGC | 9665 |
| 54790_8_396 | + | chr4: 105263669-105263689 | UUGAGAGUCAGAAUGCUGGC | 9666 |
| 54790_8_401 | + | chr4: 105263690-105263710 | GGACUUAAAGUUGAAUACAU | 9667 |
| 54790_8_407 | + | chr4: 105263699-105263719 | GUUGAAUACAUAGGAAUGAA | 9668 |
| 54790_8_408 | + | chr4: 105263702-105263722 | GAAUACAUAGGAAUGAAAGG | 9669 |
| 54790_8_414 | + | chr4: 105263728-105263748 | UCAAGUAGAGAUUAUAAAG | 9670 |
| 54790_8_418 | + | chr4: 105263735-105263755 | AGAGAUUAUAAAGAGGACAA | 9671 |
| 54790_8_419 | + | chr4: 105263736-105263756 | GAGAUUAUAAAGAGGACAAA | 9672 |
| 54790_8_422 | + | chr4: 105263746-105263766 | AGAGGACAAAGGGCUGAUGA | 9673 |
| 54790_8_424 | + | chr4: 105263747-105263767 | GAGGACAAAGGGCUGAUGAU | 9674 |
| 54790_8_426 | + | chr4: 105263754-105263774 | AAGGGCUGAUGAUGGGAUUC | 9675 |
| 54790_8_428 | + | chr4: 105263773-105263793 | CUGGAGCCAUCAAUCAUUUU | 9676 |
| 54790_8_433 | + | chr4: 105263782-105263802 | UCAAUCAUUUUAGGCAUGAG | 9677 |
| 54790_8_435 | + | chr4: 105263785-105263805 | AUCAUUUUAGGCAUGAGUGG | 9678 |
| 54790_8_445 | + | chr4: 105263812-105263832 | GAAGCCAAUGAAGUAAGAAC | 9679 |
| 54790_8_447 | + | chr4: 105263813-105263833 | AAGCCAAUGAAGUAAGAACU | 9680 |
| 54790_8_449 | + | chr4: 105263814-105263834 | AGCCAAUGAAGUAAGAACUG | 9681 |
| 54790_8_451 | + | chr4: 105263815-105263835 | GCCAAUGAAGUAAGAACUGG | 9682 |
| 54790_8_455 | + | chr4: 105263818-105263838 | AAUGAAGUAAGAACUGGGGG | 9683 |
| 54790_8_457 | + | chr4: 105263819-105263839 | AUGAAGUAAGAACUGGGGGA | 9684 |
| 54790_8_463 | + | chr4: 105263839-105263859 | GGGAGUAGAAGAAAUGUAGU | 9685 |
| 54790_8_468 | + | chr4: 105263853-105263873 | UGUAGUAGGAAAAGUGAAAG | 9686 |
| 54790_8_469 | + | chr4: 105263854-105263874 | GUAGUAGGAAAAGUGAAAGA | 9687 |
| 54790_8_472 | + | chr4: 105263860-105263880 | GGAAAAGUGAAAGAGGGAGA | 9688 |
| 54790_8_474 | + | chr4: 105263864-105263884 | AAGUGAAAGAGGGAGAUGGA | 9689 |
| 54790_8_476 | + | chr4: 105263868-105263888 | GAAAGAGGGAGAUGGAUGGA | 9690 |
| 54790_8_480 | + | chr4: 105263871-105263891 | AGAGGGAGAUGGAUGGAUGG | 9691 |
| 54790_8_483 | + | chr4: 105263879-105263899 | AUGGAUGGAUGGAGGAAAGC | 9692 |
| 54790_8_490 | + | chr4: 105263914-105263934 | ACACCCAGAGCAGAGUAUAC | 9693 |
| 54790_8_491 | + | chr4: 105263923-105263943 | GCAGAGUAUACAGGAGCAAU | 9694 |
| 54790_8_493 | + | chr4: 105263928-105263948 | GUAUACAGGAGCAAUAGGUA | 9695 |
| 54790_8_495 | + | chr4: 105263929-105263949 | UAUACAGGAGCAAUAGGUAU | 9696 |
| 54790_8_496 | + | chr4: 105263930-105263950 | AUACAGGAGCAAUAGGUAUG | 9697 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_498 | + | chr4: 105263936-105263956 | GAGCAAUAGGUAUGGGGCUC | 9698 |
| 54790_8_500 | + | chr4: 105263937-105263957 | AGCAAUAGGUAUGGGGCUCU | 9699 |
| 54790_8_502 | + | chr4: 105263941-105263961 | AUAGGUAUGGGGCUCUGGGA | 9700 |
| 54790_8_503 | + | chr4: 105263942-105263962 | UAGGUAUGGGGCUCUGGGAU | 9701 |
| 54790_8_507 | + | chr4: 105263982-105264002 | GAUAAUAUUAAAGACUCUCG | 9702 |
| 54790_8_509 | + | chr4: 105263983-105264003 | AUAAUAUUAAAGACUCUCGU | 9703 |
| 54790_8_514 | + | chr4: 105264011-105264031 | AUUAGUUUACACAGCAGACA | 9704 |
| 54790_8_517 | + | chr4: 105264017-105264037 | UUACACAGCAGACAUGGACA | 9705 |
| 54790_8_519 | + | chr4: 105264018-105264038 | UACACAGCAGACAUGGACAA | 9706 |
| 54790_8_524 | + | chr4: 105264061-105264081 | GCUACUCUUCUUUUCCACUG | 9707 |
| 54790_8_532 | + | chr4: 105264096-105264116 | CAAACAUUUUUUUUUUUUUU | 9708 |
| 54790_8_541 | + | chr4: 105264111-105264131 | UUUUUUGGUUCGAACAAUAG | 9709 |
| 54790_8_551 | + | chr4: 105264126-105264146 | AAUAGAGGCAAAUUAAACGA | 9710 |
| 54790_8_569 | + | chr4: 105264215-105264235 | UUUUAAACACUAUUAAUAGU | 9711 |
| 54790_8_582 | + | chr4: 105264259-105264279 | AGCUAGUAUCACAAAGUAUA | 9712 |
| 54790_8_597 | + | chr4: 105264369-105264389 | UAUGUUGCUAGAUUUAAAGU | 9713 |
| 54790_8_598 | + | chr4: 105264370-105264390 | AUGUUGCUAGAUUUAAAGUU | 9714 |
| 54790_8_605 | + | chr4: 105264400-105264420 | CUAUUAAAUGAAUUUUUAAU | 9715 |
| 54790_8_611 | + | chr4: 105264417-105264437 | AAUAGGUGCUGUUAAUCAAA | 9716 |
| 54790_8_615 | + | chr4: 105264429-105264449 | UAAUCAAAUGGCUUUACUUG | 9717 |
| 54790_8_626 | + | chr4: 105264480-105264500 | UGCUCCCUUGAUUCUUAUUA | 9718 |
| 54790_8_653 | + | chr4: 105264633-105264653 | AGUCAAUUAAUAGUUGUAAA | 9719 |
| 54790_8_659 | + | chr4: 105264652-105264672 | AUGGAUGAGAUGCUUCUGAA | 9720 |
| 54790_8_661 | + | chr4: 105264676-105264696 | UAAAAUAUUUUUAUAUUGCA | 9721 |
| 54790_8_662 | + | chr4: 105264680-105264700 | AUAUUUUAUAUUGCAUGGU | 9722 |
| 54790_8_666 | + | chr4: 105264689-105264709 | UAUUGCAUGGUAGGUACUAU | 9723 |
| 54790_8_676 | + | chr4: 105264765-105264785 | UGAUGUUUCCACACAGUACA | 9724 |
| 54790_8_679 | + | chr4: 105264766-105264786 | GAUGUUUCCACACAGUACAC | 9725 |
| 54790_8_705 | + | chr4: 105264923-105264943 | UCUUAUUGCUAAAGUUUAGU | 9726 |
| 54790_8_713 | + | chr4: 105264956-105264976 | CAUCUCUUCUGUCAGUCCCA | 9727 |
| 54790_8_725 | + | chr4: 105265024-105265044 | CUAUCCAGUAGACAUAUAUU | 9728 |
| 54790_8_734 | + | chr4: 105265078-105265098 | AACAGUAGACCUGAAAUAGC | 9729 |
| 54790_8_747 | + | chr4: 105265165-105265185 | AAGAGAGCUUUCUAUGAAGA | 9730 |
| 54790_8_752 | + | chr4: 105265200-105265220 | UUUAUGCUGUUCAGUGUAAU | 9731 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_8_756 | + | chr4: 105265216-105265236 | UAAUAGGCACUAGCCACAUG | 9732 |
| 54790_8_757 | + | chr4: 105265241-105265261 | AUUAUUUAACAGUUGAUACG | 9733 |
| 54790_8_769 | + | chr4: 105265296-105265316 | UUAACACAAACAGCCACAUG | 9734 |
| 54790_8_771 | + | chr4: 105265303-105265323 | AAACAGCCACAUGUGGAUAA | 9735 |
| 54790_8_784 | + | chr4: 105265379-105265399 | UUGUCUUCCAGACAUUUAGA | 9736 |
| 54790_8_791 | + | chr4: 105265413-105265433 | UUCAUUCACAAAAUCCUGCA | 9737 |
| 54790_8_795 | + | chr4: 105265424-105265444 | AAUCCUGCAUGGUAUUUUUU | 9738 |
| 54790_8_797 | + | chr4: 105265430-105265450 | GCAUGGUAUUUUUUAGGAGA | 9739 |
| 54790_8_817 | + | chr4: 105265517-105265537 | AGACCACAGCAUGAACUGAA | 9740 |
| 54790_8_819 | + | chr4: 105265552-105265572 | CAUCUAUGUUAAAGAGUAGU | 9741 |
| 54790_8_821 | + | chr4: 105265571-105265591 | UUGGUACCUUCAUUUUCCUU | 9742 |
| 54790_8_827 | + | chr4: 105265587-105265607 | CCUUUGGCCAAAGUUUUAUG | 9743 |
| 54790_8_841 | + | chr4: 105265683-105265703 | AGUUCAUCUUCUAGCCAUGA | 9744 |
| 54790_8_852 | + | chr4: 105265750-105265770 | UGACAAAAUAUAUGAAACAA | 9745 |
| 54790_8_862 | + | chr4: 105265787-105265807 | AUAAGAAAUUCAAGAGACAG | 9746 |
| 54790_8_870 | + | chr4: 105265802-105265822 | GACAGUGGCACCAGAGAGAA | 9747 |
| 54790_8_871 | + | chr4: 105265813-105265833 | CAGAGAGAAAGGAAGUAAAA | 9748 |
| 54790_8_876 | + | chr4: 105265858-105265878 | UACUUCCUGAAGAGAGUAUU | 9749 |
| 54790_8_882 | + | chr4: 105265877-105265897 | UAGGCUCCAGUGUAGCCAGU | 9750 |
| 54790_8_885 | + | chr4: 105265913-105265933 | CCAGCCUUAUCUCUGUAUUA | 9751 |
| 54790_8_889 | + | chr4: 105265933-105265953 | AGGAGACAAAGUUCAAAAUU | 9752 |
| 54790_8_893 | + | chr4: 105265938-105265958 | ACAAAGUUCAAAAUUUGGAG | 9753 |
| 54790_8_894 | + | chr4: 105265944-105265964 | UUCAAAAUUUGGAGAGGCCA | 9754 |
| 54790_8_905 | + | chr4: 105265978-105265998 | CACUAUUCAGAAUAUCAGAG | 9755 |
| 54790_8_919 | + | chr4: 105266018-105266038 | AAAGCUCCAGAGACCUGCAG | 9756 |
| 54790_8_920 | + | chr4: 105266019-105266039 | AAGCUCCAGAGACCUGCAGA | 9757 |
| 54790_8_926 | + | chr4: 105266079-105266099 | UGCAUGUGAAAAAACUGCCA | 9758 |
| 54790_8_927 | + | chr4: 105266084-105266104 | GUGAAAAAACUGCCAAGGCU | 9759 |
| 54790_8_929 | + | chr4: 105266088-105266108 | AAAACUGCCAAGGCUAGGU | 9760 |
| 54790_8_932 | + | chr4: 105266089-105266109 | AAACUGCCAAGGCUAGGUA | 9761 |
| 54790_8_936 | + | chr4: 105266112-105266132 | AAAGAACCAUCAGAAGAAGC | 9762 |
| 54790_8_940 | + | chr4: 105266139-105266159 | AUAAUCCCUUGAUCUCACAC | 9763 |
| 54790_8_943 | + | chr4: 105266145-105266165 | CCUUGAUCUCACACAGGACC | 9764 |
| 54790_8_947 | + | chr4: 105266174-105266194 | UCUUGAUCAUACCAGCCAGA | 9765 |
| 54790_8_952 | + | chr4: 105266214-105266234 | UAUUCAUAAUUGUAUUGCCU | 9766 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_957 | + | chr4: 105266232-105266252 | CUUGGUAGUAGAAGUAAAUU | 9767 |
| 54790_8_965 | + | chr4: 105266278-105266298 | GCUUAAAAUGAAAACAUAGA | 9768 |
| 54790_8_966 | + | chr4: 105266279-105266299 | CUUAAAAUGAAAACAUAGAA | 9769 |
| 54790_8_971 | + | chr4: 105266347-105266367 | AAAAAAAAAUCUACCAACA | 9770 |
| 54790_8_977 | + | chr4: 105266386-105266406 | GCAUUCCAUCAGAAAAUACA | 9771 |
| 54790_8_985 | + | chr4: 105266421-105266441 | AAAGAAAAUAUAACCUUUAC | 9772 |
| 54790_8_987 | + | chr4: 105266422-105266442 | AAGAAAAUAUAACCUUUACU | 9773 |
| 54790_8_988 | + | chr4: 105266423-105266443 | AGAAAAUAUAACCUUUACUG | 9774 |
| 54790_8_990 | + | chr4: 105266429-105266449 | UAUAACCUUUACUGGGGAAC | 9775 |
| 54790_8_996 | + | chr4: 105266503-105266523 | UGUAAAUAAGUUCAUUAAAA | 9776 |
| 54790_8_1001 | + | chr4: 105266535-105266555 | UUCAUAUGUUAAAAUGCCAG | 9777 |
| 54790_8_1010 | + | chr4: 105266555-105266575 | AGGAAAGCAUGAGAGUGAUA | 9778 |
| 54790_8_1016 | + | chr4: 105266635-105266655 | AUCUAGAUUAAAAAUACACU | 9779 |
| 54790_8_1018 | + | chr4: 105266638-105266658 | UAGAUUAAAAAUACACUAGG | 9780 |
| 54790_8_1023 | + | chr4: 105266654-105266674 | UAGGCGGAAUUAACAGAUUA | 9781 |
| 54790_8_1041 | + | chr4: 105266765-105266785 | UACACUAAUAUAUGUGUAAU | 9782 |
| 54790_8_1046 | + | chr4: 105266777-105266797 | UGUGUAAUUGGAGUACCAGA | 9783 |
| 54790_8_1048 | + | chr4: 105266780-105266800 | GUAAUUGGAGUACCAGAAGG | 9784 |
| 54790_8_1050 | + | chr4: 105266783-105266803 | AUUGGAGUACCAGAAGGAGG | 9785 |
| 54790_8_1053 | + | chr4: 105266784-105266804 | UUGGAGUACCAGAAGGAGGU | 9786 |
| 54790_8_1059 | + | chr4: 105266813-105266833 | AAAAAUAUUUAAAGAAACAA | 9787 |
| 54790_8_1082 | + | chr4: 105266965-105266985 | UGAUAAAGAGAAACUCAGAA | 9788 |
| 54790_8_1084 | + | chr4: 105266972-105266992 | GAGAAACUCAGAAAGGCAAA | 9789 |
| 54790_8_1089 | + | chr4: 105266982-105267002 | GAAAGGCAAAUGGAGAAAAA | 9790 |
| 54790_8_1090 | + | chr4: 105266997-105267017 | AAAAAAGGACAUAUUACACU | 9791 |
| 54790_8_1092 | + | chr4: 105267000-105267020 | AAAGGACAUAUUACACUAGG | 9792 |
| 54790_8_1095 | + | chr4: 105267001-105267021 | AAGGACAUAUUACACUAGGU | 9793 |
| 54790_8_1099 | + | chr4: 105267016-105267036 | UAGGUGGGAAAAAAUAAGAC | 9794 |
| 54790_8_1102 | + | chr4: 105267036-105267056 | AGGAGACUUCAUUCAGAAAA | 9795 |
| 54790_8_1134 | + | chr4: 105267236-105267256 | AAUGUUAAACGAAAUCCUUC | 9796 |
| 54790_8_1144 | + | chr4: 105267311-105267331 | AGUAUCAAAAAUAGUAAACA | 9797 |
| 54790_8_1152 | + | chr4: 105267376-105267396 | UAUAUUAACAAUGUAUUAUG | 9798 |
| 54790_8_1159 | + | chr4: 105267404-105267424 | AACACGUAGAAGUAGCACAG | 9799 |
| 54790_8_1163 | + | chr4: 105267410-105267430 | UAGAAGUAGCACAGAGGCUG | 9800 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_8_1168 | + | chr4: 105267452-105267472 | UAAAGUACUUAUACGAUAUG | 9801 |
| 54790_8_1171 | + | chr4: 105267457-105267477 | UACUUAUACGAUAUGUGGAC | 9802 |
| 54790_8_1172 | + | chr4: 105267458-105267478 | ACUUAUACGAUAUGUGGACU | 9803 |
| 54790_8_1174 | + | chr4: 105267470-105267490 | UGGGACUGGGUAUAUUACU | 9804 |
| 54790_8_1185 | + | chr4: 105267603-105267623 | AAAUGUUUUAAAAAUAUAU | 9805 |
| 54790_8_1190 | + | chr4: 105267647-105267667 | AAAUAAAACAAAUAGCAAGA | 9806 |
| 54790_8_1195 | + | chr4: 105267693-105267713 | ACAACCACAUUAAAUGUAAA | 9807 |
| 54790_8_1197 | + | chr4: 105267716-105267736 | UUUUAACACCCCUAAUUAUA | 9808 |
| 54790_8_1217 | + | chr4: 105267835-105267855 | UGAUGUUGAAAAGACAUAAC | 9809 |
| 54790_8_1220 | + | chr4: 105267859-105267879 | AAAAAUAUGAUUAUUGCAGU | 9810 |
| 54790_8_1228 | + | chr4: 105267900-105267920 | UAAUAUUCAACAUUCAUAAA | 9811 |
| 54790_8_1236 | + | chr4: 105267932-105267952 | CAACCUAUUAAAUACAUAAA | 9812 |
| 54790_8_1238 | + | chr4: 105267962-105267982 | AAAGCUAAUGCUAUACUUAG | 9813 |
| 54790_8_1243 | + | chr4: 105267994-105268014 | AAUACUUGACCCCUAAGAUA | 9814 |
| 54790_8_1253 | + | chr4: 105268072-105268092 | AAAUUUUAGAAAGUGCAGUA | 9815 |
| 54790_8_1258 | + | chr4: 105268097-105268117 | AUAAAUAAAGCAGUCAAGAU | 9816 |
| 54790_8_1259 | + | chr4: 105268098-105268118 | UAAAUAAAGCAGUCAAGAUU | 9817 |
| 54790_8_1262 | + | chr4: 105268102-105268122 | UAAAGCAGUCAAGAUUGGGU | 9818 |
| 54790_8_1290 | + | chr4: 105268335-105268355 | AAAUGUAUAAGAUUAUAUAC | 9819 |
| 54790_8_1298 | + | chr4: 105268382-105268402 | UUAUAGAAAACUUCAGUAAC | 9820 |
| 54790_8_1304 | + | chr4: 105268403-105268423 | GGAGAGAUACACUAUGUUAA | 9821 |
| 54790_8_1310 | + | chr4: 105268489-105268509 | UGAUGUUUCAAAACCCCAGC | 9822 |
| 54790_8_1317 | + | chr4: 105268506-105268526 | AGCAGGUUUUUUGAAAGAAU | 9823 |
| 54790_8_1318 | + | chr4: 105268515-105268535 | UUUGAAAGAAUUGGACAAGA | 9824 |
| 54790_8_1327 | + | chr4: 105268536-105268556 | GGCUGUAAAAUAUAUAUACU | 9825 |
| 54790_8_1329 | + | chr4: 105268547-105268567 | AUAUAUACUUGGAAAUGCAA | 9826 |
| 54790_8_1331 | + | chr4: 105268553-105268573 | ACUUGGAAAUGCAAAGGACU | 9827 |
| 54790_8_1336 | + | chr4: 105268581-105268601 | UCAAAUAAUAUUUUAAAAUA | 9828 |
| 54790_8_1337 | + | chr4: 105268582-105268602 | CAAAUAAUAUUUUAAAAUAA | 9829 |
| 54790_8_1344 | + | chr4: 105268609-105268629 | AUUUGAGACUAUAUAUUGCA | 9830 |
| 54790_8_1355 | + | chr4: 105268672-105268692 | AAGACAGUUUGAUAUUGCCC | 9831 |
| 54790_8_1356 | + | chr4: 105268680-105268700 | UUGAUAUUGCCCAGGCGCAG | 9832 |
| 54790_8_1362 | + | chr4: 105268708-105268728 | GCCUGUAAUUCCAGCACUUU | 9833 |
| 54790_8_1363 | + | chr4: 105268711-105268731 | UGUAAUUCCAGCACUUUCGG | 9834 |
| 54790_8_1365 | + | chr4: 105268717-105268737 | UCCAGCACUUUCGGAGGCCG | 9835 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_1368 | + | chr4: 105268720-105268740 | AGCACUUUCGGAGGCCGAGG | 9836 |
| 54790_8_1369 | + | chr4: 105268721-105268741 | GCACUUUCGGAGGCCGAGGU | 9837 |
| 54790_8_1371 | + | chr4: 105268724-105268744 | CUUUCGGAGGCCGAGGUGGG | 9838 |
| 54790_8_1375 | + | chr4: 105268735-105268755 | CGAGGUGGGUGGAUCACUUG | 9839 |
| 54790_8_1377 | + | chr4: 105268740-105268760 | UGGGUGGAUCACUUGAGGCC | 9840 |
| 54790_8_1381 | + | chr4: 105268759-105268779 | CAGGAGUUUUGAGACCAGCC | 9841 |
| 54790_8_1382 | + | chr4: 105268768-105268788 | UGAGACCAGCCUGGCCAACA | 9842 |
| 54790_8_1388 | + | chr4: 105268807-105268827 | AUAAAAAUACAAAAAAUUAC | 9843 |
| 54790_8_1389 | + | chr4: 105268808-105268828 | UAAAAAUACAAAAAAUUACU | 9844 |
| 54790_8_1390 | + | chr4: 105268809-105268829 | AAAAAUACAAAAAAUUACUG | 9845 |
| 54790_8_1391 | + | chr4: 105268814-105268834 | UACAAAAAAUUACUGGGGCA | 9846 |
| 54790_8_1392 | + | chr4: 105268817-105268837 | AAAAAAUUACUGGGGCAUGG | 9847 |
| 54790_8_1395 | + | chr4: 105268844-105268864 | UGCUUAUAGUCCCAGCUGCU | 9848 |
| 54790_8_1397 | + | chr4: 105268845-105268865 | GCUUAUAGUCCCAGCUGCUU | 9849 |
| 54790_8_1399 | + | chr4: 105268848-105268868 | UAUAGUCCCAGCUGCUUGGG | 9850 |
| 54790_8_1402 | + | chr4: 105268854-105268874 | CCCAGCUGCUUGGGAGGUUG | 9851 |
| 54790_8_1411 | + | chr4: 105268877-105268897 | CCUGAGAAUCGCUUGAAUCC | 9852 |
| 54790_8_1412 | + | chr4: 105268880-105268900 | GAGAAUCGCUUGAAUCCAGG | 9853 |
| 54790_8_1414 | + | chr4: 105268886-105268906 | CGCUUGAAUCCAGGAGGCAG | 9854 |
| 54790_8_1419 | + | chr4: 105268926-105268946 | CGUGCCACUGCACUCCAGCC | 9855 |
| 54790_8_1420 | + | chr4: 105268927-105268947 | GUGCCACUGCACUCCAGCCU | 9856 |
| 54790_8_1424 | + | chr4: 105268938-105268958 | CUCCAGCCUGGGUGACAGAG | 9857 |
| 54790_8_1425 | + | chr4: 105268939-105268959 | UCCAGCCUGGGUGACAGAGU | 9858 |
| 54790_8_1434 | + | chr4: 105269019-105269039 | UACACACCAUUAUACACAAG | 9859 |
| 54790_8_1442 | + | chr4: 105269064-105269084 | UAGACCCAACAUAUAUAAUA | 9860 |
| 54790_8_1446 | + | chr4: 105269097-105269117 | UUUAACAAAGAUGAUUCAAU | 9861 |
| 54790_8_1448 | + | chr4: 105269098-105269118 | UUAACAAAGAUGAUUCAAUU | 9862 |
| 54790_8_1454 | + | chr4: 105269102-105269122 | CAAAGAUGAUUCAAUUGGGA | 9863 |
| 54790_8_1456 | + | chr4: 105269103-105269123 | AAAGAUGAUUCAAUUGGGAA | 9864 |
| 54790_8_1463 | + | chr4: 105269138-105269158 | UCCAGUAGUAUCUGAACAGU | 9865 |
| 54790_8_1467 | + | chr4: 105269150-105269170 | UGAACAGUUGGAAAGCCAUA | 9866 |
| 54790_8_1470 | + | chr4: 105269151-105269171 | GAACAGUUGGAAAGCCAUAA | 9867 |
| 54790_8_1471 | + | chr4: 105269159-105269179 | GGAAAGCCAUAAGGGAAAAA | 9868 |
| 54790_8_1491 | + | chr4: 105269282-105269302 | UAGUUGUCUGAGAACAAAGC | 9869 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_1497 | + | chr4: 105269300-105269320 | GCAGGAAGCAUGAAUUAUAC | 9870 |
| 54790_8_1498 | + | chr4: 105269301-105269321 | CAGGAAGCAUGAAUUAUACA | 9871 |
| 54790_8_1499 | + | chr4: 105269302-105269322 | AGGAAGCAUGAAUUAUACAG | 9872 |
| 54790_8_1502 | + | chr4: 105269309-105269329 | AUGAAUUAUACAGGGGCAUG | 9873 |
| 54790_8_1511 | + | chr4: 105269346-105269366 | AAUGAAUAUGUACUUUAUUU | 9874 |
| 54790_8_1518 | + | chr4: 105269389-105269409 | AACUCAAAUAGCAUACUUUA | 9875 |
| 54790_8_1529 | + | chr4: 105269468-105269488 | GUGUCAUUCCAUUUUGUUUC | 9876 |
| 54790_8_1540 | + | chr4: 105269511-105269531 | CAUUUUUUUAAAGUUCUAAA | 9877 |
| 54790_8_1549 | + | chr4: 105269534-105269554 | UCUAAAUACUAGUGAGUUUU | 9878 |
| 54790_8_1567 | - | chr4: 105261905-105261925 | UCAAAAAUAUUUUUGGACAU | 9879 |
| 54790_8_1568 | - | chr4: 105261912-105261932 | CAUUGUUUCAAAAAUAUUUU | 9880 |
| 54790_8_1577 | - | chr4: 105261960-105261980 | CAGUGGUUUCAACAAUUAAG | 9881 |
| 54790_8_1581 | - | chr4: 105261977-105261997 | CUCGAAACUGAACACUGCAG | 9882 |
| 54790_8_1591 | - | chr4: 105262015-105262035 | AAAAAAAAUGUACUUUUGUA | 9883 |
| 54790_8_1615 | - | chr4: 105262162-105262182 | GUAGUUAGAACCUAUAGCUU | 9884 |
| 54790_8_1616 | - | chr4: 105262163-105262183 | GGUAGUUAGAACCUAUAGCU | 9885 |
| 54790_8_1622 | - | chr4: 105262184-105262204 | UAUAGACUUGCAGUAAAAAU | 9886 |
| 54790_8_1636 | - | chr4: 105262299-105262319 | UCAGCAAAAUCUGACACAUC | 9887 |
| 54790_8_1639 | - | chr4: 105262326-105262346 | AAGUCAAGGUCAAACAAAAA | 9888 |
| 54790_8_1646 | - | chr4: 105262340-105262360 | UUGCUUGGUGUAUGAAGUCA | 9889 |
| 54790_8_1648 | - | chr4: 105262355-105262375 | AAAAAAAAAUGUUUUUGCU | 9890 |
| 54790_8_1687 | - | chr4: 105262570-105262590 | UUCUUAAAGACAGACAGAGA | 9891 |
| 54790_8_1689 | - | chr4: 105262595-105262615 | CGGUGGCAUGGGUCGAAAGA | 9892 |
| 54790_8_1695 | - | chr4: 105262623-105262643 | AGGGUUUCACAACCCUAAUU | 9893 |
| 54790_8_1697 | - | chr4: 105262631-105262651 | GGAACCGGAGGGUUUCACAA | 9894 |
| 54790_8_1699 | - | chr4: 105262632-105262652 | CGGAACCGGAGGGUUUCACA | 9895 |
| 54790_8_1701 | - | chr4: 105262648-105262668 | GAGUCCACUAGGUGGACGGA | 9896 |
| 54790_8_1702 | - | chr4: 105262665-105262685 | CCAGAUCUUGAGGACUGGAG | 9897 |
| 54790_8_1708 | - | chr4: 105262686-105262706 | AAAGAGGUACAACUAGUCCG | 9898 |
| 54790_8_1709 | - | chr4: 105262690-105262710 | UCCCAAAGAGGUACAACUAG | 9899 |
| 54790_8_1717 | - | chr4: 105262709-105262729 | AACAUAAAAAUCAUCUCUGU | 9900 |
| 54790_8_1718 | - | chr4: 105262710-105262730 | AAACAUAAAAAUCAUCUCUG | 9901 |
| 54790_8_1723 | - | chr4: 105262757-105262777 | AAGGCUCAUCGACCCUAAUG | 9902 |
| 54790_8_1725 | - | chr4: 105262765-105262785 | GGAAUCGGAAGGCUCAUCGA | 9903 |
| 54790_8_1727 | - | chr4: 105262766-105262786 | CGGAAUCGGAAGGCUCAUCG | 9904 |

TABLE 1-continued gRNA Targeting Domains for TET2 introns and intron-exon junctions. In the "Id" field, the first number relates to the target gene, here, indicating human TET; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
|---|---|---|---|---|
| 54790_8_1732 | - | chr4: 105262805-105262825 | GUGACGUUGGAGGUGGAGGG | 9905 |
| 54790_8_1736 | - | chr4: 105262830-105262850 | CCUCACGUUACCAAACUGAA | 9906 |
| 54790_8_1739 | - | chr4: 105262841-105262861 | AACGGAUCCGACCUCACGUU | 9907 |
| 54790_8_1742 | - | chr4: 105262851-105262871 | AAGCGAGAACAACGGAUCCG | 9908 |
| 54790_8_1745 | - | chr4: 105262855-105262875 | CUCAAAGCGAGAACAACGGA | 9909 |
| 54790_8_1760 | - | chr4: 105262877-105262897 | AAAAAAAAAAAAAAACUCU | 9910 |
| 54790_8_1767 | - | chr4: 105262929-105262949 | AGGACCCAUCGACCCUAAUG | 9911 |
| 54790_8_1768 | - | chr4: 105262937-105262957 | AGGACCAGAGGACCCAUCGA | 9912 |
| 54790_8_1769 | - | chr4: 105262938-105262958 | GAGGACCAGAGGACCCAUCG | 9913 |
| 54790_8_1772 | - | chr4: 105262945-105262965 | GGAGUCUGAGGACCAGAGGA | 9914 |
| 54790_8_1773 | - | chr4: 105262946-105262966 | CGGAGUCUGAGGACCAGAGG | 9915 |
| 54790_8_1775 | - | chr4: 105262954-105262974 | AGUGGCGUCGGAGUCUGAGG | 9916 |
| 54790_8_1776 | - | chr4: 105262978-105262998 | CCUCGUGUCACUACGUUAGU | 9917 |
| 54790_8_1780 | - | chr4: 105262999-105263019 | CAGUAGAAACAGUGGGUCCU | 9918 |
| 54790_8_1782 | - | chr4: 105263003-105263023 | GACCCAGUAGAAACAGUGGG | 9919 |
| 54790_8_1797 | - | chr4: 105263021-105263041 | AACGAAAAAAAAAUCUUAGA | 9920 |
| 54790_8_1798 | - | chr4: 105263022-105263042 | AAACGAAAAAAAAAUCUUAG | 9921 |
| 54790_8_1805 | - | chr4: 105263058-105263078 | GUCUCUGUCUCCACUAAAGA | 9922 |
| 54790_8_1820 | - | chr4: 105263117-105263137 | GCACAUUCUUCUAUUCCAGC | 9923 |
| 54790_8_1841 | - | chr4: 105263168-105263188 | GUGACAUCUAGUCUACUUUU | 9924 |
| 54790_8_1842 | - | chr4: 105263169-105263189 | UGUGACAUCUAGUCUACUUU | 9925 |
| 54790_8_1849 | - | chr4: 105263197-105263217 | AGAUCUUUAUUUAGCGUCUA | 9926 |
| 54790_8_1853 | - | chr4: 105263242-105263262 | ACACACUUGAAACAGCCCAA | 9927 |
| 54790_8_1874 | - | chr4: 105263322-105263342 | UAAGUUAUAUUUCCCUUACU | 9928 |
| 54790_8_1888 | - | chr4: 105263408-105263428 | UUAAUUCCUGCCAUUUCUUU | 9929 |
| 54790_8_1901 | - | chr4: 105263516-105263536 | AUAGAACUACCUGUCCAAAC | 9930 |
| 54790_8_1940 | - | chr4: 105263782-105263802 | CUCAUGCCUAAAAUGAUUGA | 9931 |
| 54790_8_1947 | - | chr4: 105263819-105263839 | UCCCCCAGUUCUUACUUCAU | 9932 |
| 54790_8_1961 | - | chr4: 105263920-105263940 | GCUCCUGUAUACUCUGCUCU | 9933 |
| 54790_8_1962 | - | chr4: 105263921-105263941 | UGCUCCUGUAUACUCUGCUC | 9934 |
| 54790_8_1976 | - | chr4: 105264050-105264070 | AAGAGUAGCUAAAUCAUUUU | 9935 |
| 54790_8_1984 | - | chr4: 105264078-105264098 | UGGGACGUUAAAGUCCACAG | 9936 |
| 54790_8_1987 | - | chr4: 105264097-105264117 | AAAAAAAAAAAAAAUGUUU | 9937 |
| 54790_8_1988 | - | chr4: 105264098-105264118 | CAAAAAAAAAAAAAAUGUU | 9938 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_2055 | − | chr4: 105264487-105264507 | CGGUCCAUAAUAAGAAUCAA | 9939 |
| 54790_8_2057 | − | chr4: 105264488-105264508 | ACGGUCCAUAAUAAGAAUCA | 9940 |
| 54790_8_2062 | − | chr4: 105264507-105264527 | AAAUAGUUUCAAGUAUGAGA | 9941 |
| 54790_8_2073 | − | chr4: 105264539-105264559 | AUUUUGGGUACUUAAGUUUU | 9942 |
| 54790_8_2077 | − | chr4: 105264554-105264574 | AUUUGAUGGCUUCAUAUUUU | 9943 |
| 54790_8_2078 | − | chr4: 105264555-105264575 | UAUUUGAUGGCUUCAUAUUU | 9944 |
| 54790_8_2082 | − | chr4: 105264568-105264588 | UAAAACUUGAACAUAUUUGA | 9945 |
| 54790_8_2104 | − | chr4: 105264725-105264745 | GAUUUCGUAUAAUUGUAUGU | 9946 |
| 54790_8_2110 | − | chr4: 105264763-105264783 | AUGACACCUUUGUAGUGU | 9947 |
| 54790_8_2112 | − | chr4: 105264776-105264796 | ACCAGAAGGGCACAUGACAC | 9948 |
| 54790_8_2116 | − | chr4: 105264796-105264816 | UGUCGUAGAUAUUGUAGUUU | 9949 |
| 54790_8_2119 | − | chr4: 105264826-105264846 | CCUCCAUUUCUAGUUUAUCA | 9950 |
| 54790_8_2121 | − | chr4: 105264844-105264864 | GACACUCAGUUGGGGAAUCC | 9951 |
| 54790_8_2122 | − | chr4: 105264847-105264867 | UACGACACUCAGUUGGGGAA | 9952 |
| 54790_8_2125 | − | chr4: 105264852-105264872 | AGAGAUACGACACUCAGUUG | 9953 |
| 54790_8_2128 | − | chr4: 105264853-105264873 | UAGAGAUACGACACUCAGUU | 9954 |
| 54790_8_2130 | − | chr4: 105264854-105264874 | AUAGAGAUACGACACUCAGU | 9955 |
| 54790_8_2138 | − | chr4: 105264898-105264918 | UGAAAUCAAGGAAUAAAGCA | 9956 |
| 54790_8_2143 | − | chr4: 105264910-105264930 | AAUAAGACUUCAUGAAAUCA | 9957 |
| 54790_8_2148 | − | chr4: 105264953-105264973 | GACUGACAGAAGAGAUGCUG | 9958 |
| 54790_8_2155 | − | chr4: 105264975-105264995 | AACUGAAGCUCUAAUUCCAU | 9959 |
| 54790_8_2158 | − | chr4: 105264976-105264996 | AAACUGAAGCUCUAAUUCCA | 9960 |
| 54790_8_2165 | − | chr4: 105265014-105265034 | UACUGGAUAGACACGAAGAA | 9961 |
| 54790_8_2169 | − | chr4: 105265031-105265051 | AGAGCCAAAUAUAUGUCUAC | 9962 |
| 54790_8_2175 | − | chr4: 105265066-105265086 | CUACUGUUAAAUUGUAAGGC | 9963 |
| 54790_8_2178 | − | chr4: 105265070-105265090 | AGGUCUACUGUUAAAUUGUA | 9964 |
| 54790_8_2183 | − | chr4: 105265090-105265110 | AGAUUGACACCUGCUAUUUC | 9965 |
| 54790_8_2200 | − | chr4: 105265232-105265252 | ACAAUUUAUUAUUGGUGUAC | 9966 |
| 54790_8_2213 | − | chr4: 105265312-105265332 | ACCAUUGGUAAUAGGUGUAC | 9967 |
| 54790_8_2216 | − | chr4: 105265332-105265352 | AUUCCAACACGACAAGUGAU | 9968 |
| 54790_8_2219 | − | chr4: 105265350-105265370 | GUAUUGAAAGACUACCAGAU | 9969 |
| 54790_8_2221 | − | chr4: 105265357-105265377 | GAUUUACGUAUUGAAAGACU | 9970 |
| 54790_8_2224 | − | chr4: 105265389-105265409 | ACCUUUAGGUAGAUUUACAG | 9971 |
| 54790_8_2229 | − | chr4: 105265409-105265429 | CCUAAAACACUUACUUAAUG | 9972 |
| 54790_8_2234 | − | chr4: 105265430-105265450 | AGAGGAUUUUUUAUGGUACG | 9973 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_2251 | − | chr4: 105265523-105265543 | UGGCCCAAGUCAAGUACGAC | 9974 |
| 54790_8_2254 | − | chr4: 105265543-105265563 | UAACAUAGAUGUGUGCUUUG | 9975 |
| 54790_8_2257 | − | chr4: 105265580-105265600 | CUUUGGCCAAAGGAAAAUGA | 9976 |
| 54790_8_2260 | − | chr4: 105265590-105265610 | CCUCAUAAAACUUUGGCCAA | 9977 |
| 54790_8_2263 | − | chr4: 105265597-105265617 | UAUCUAACCUCAUAAAACUU | 9978 |
| 54790_8_2271 | − | chr4: 105265639-105265659 | GGCUUCAUAUUAUUUACUGU | 9979 |
| 54790_8_2277 | − | chr4: 105265660-105265680 | AUUAGGAUAAAAGUUUGUGG | 9980 |
| 54790_8_2278 | − | chr4: 105265663-105265683 | UGCAUUAGGAUAAAAGUUUG | 9981 |
| 54790_8_2279 | − | chr4: 105265677-105265697 | GAUCUUCAUGAACUUGCAUU | 9982 |
| 54790_8_2286 | − | chr4: 105265700-105265720 | UCAGAGACAAAUGAGGUAGU | 9983 |
| 54790_8_2293 | − | chr4: 105265730-105265750 | CAAAAAGAAUUUACACAUU | 9984 |
| 54790_8_2314 | − | chr4: 105265815-105265835 | GAAAAAUGAAGGAAAGAGAG | 9985 |
| 54790_8_2317 | − | chr4: 105265843-105265863 | UUCAUUUGACCCCAUAAAUA | 9986 |
| 54790_8_2319 | − | chr4: 105265853-105265873 | AGAGAAGUCCUUCAUUUGAC | 9987 |
| 54790_8_2320 | − | chr4: 105265854-105265874 | GAGAGAAGUCCUUCAUUUGA | 9988 |
| 54790_8_2322 | − | chr4: 105265855-105265875 | UGAGAGAAGUCCUUCAUUUG | 9989 |
| 54790_8_2324 | − | chr4: 105265866-105265886 | ACCUCGGAUUAUGAGAGAAG | 9990 |
| 54790_8_2330 | − | chr4: 105265886-105265906 | ACCCAAGGAUGACCGAUGUG | 9991 |
| 54790_8_2333 | − | chr4: 105265895-105265915 | CCCACACAAACCCAAGGAUG | 9992 |
| 54790_8_2334 | − | chr4: 105265905-105265925 | UCUAUUCCGACCCACACAAA | 9993 |
| 54790_8_2335 | − | chr4: 105265906-105265926 | CUCUAUUCCGACCCACACAA | 9994 |
| 54790_8_2338 | − | chr4: 105265915-105265935 | GAAUUAUGUCUCUAUUCCGA | 9995 |
| 54790_8_2339 | − | chr4: 105265916-105265936 | GGAAUUAUGUCUCUAUUCCG | 9996 |
| 54790_8_2343 | − | chr4: 105265920-105265940 | CAGAGGAAUUAUGUCUCUAU | 9997 |
| 54790_8_2351 | − | chr4: 105265964-105265984 | UAUCACUUGAGAGCAGUGGA | 9998 |
| 54790_8_2358 | − | chr4: 105266027-105266047 | GUCUUGGGAGACGUCCAGAG | 9999 |
| 54790_8_2360 | − | chr4: 105266034-105266054 | UGACCAGUCUUGGGAGACG | 10000 |
| 54790_8_2365 | − | chr4: 105266052-105266072 | AAAUUAUGAGUCGACUUCUG | 10001 |
| 54790_8_2377 | − | chr4: 105266099-105266119 | CAAGAAAGGGAUGGAUCGGA | 10002 |
| 54790_8_2382 | − | chr4: 105266121-105266141 | UAAGACGGACGAAGAAGACU | 10003 |
| 54790_8_2384 | − | chr4: 105266147-105266167 | GUCCAGGACACACUCUAGUU | 10004 |
| 54790_8_2385 | − | chr4: 105266148-105266168 | GGUCCAGGACACACUCUAGU | 10005 |
| 54790_8_2389 | − | chr4: 105266166-105266186 | CAUACUAGUUCUUGAUAAGG | 10006 |
| 54790_8_2394 | − | chr4: 105266188-105266208 | ACUUCAGAAGAGGCAGACCG | 10007 |

TABLE 1-continued gRNA Targeting Domains for TET2 introns and intron-exon junctions. In the "Id" field, the first number relates to the target gene, here, indicating human TET2; the second number indicates the intron number (for example, a "1" indicates the gRNA targets a target sequence in the intron between exon 1 and exon 2); the final number is a unique identifier for the gRNA.

| Id | strand | genomic location (hg38) of target sequence | gRNA targeting domain sequence | SEQ ID NO: |
| --- | --- | --- | --- | --- |
| 54790_8_2395 | - | chr4: 105266192-105266212 | UAAUACUUCAGAAGAGGCAG | 10008 |
| 54790_8_2402 | - | chr4: 105266234-105266254 | GUUUAAAUGAAGAUGAUGGU | 10009 |
| 54790_8_2415 | - | chr4: 105266267-105266287 | UAAAAUUCGUAAAAAUCUAC | 10010 |
| 54790_8_2423 | - | chr4: 105266305-105266325 | AUUUAAUGAAUCUUAGUCAA | 10011 |
| 54790_8_2443 | - | chr4: 105266364-105266384 | CUGAUAUUUAAAAUGGAACA | 10012 |
| 54790_8_2450 | - | chr4: 105266394-105266414 | CAUACGGAACAUAAAAGACU | 10013 |
| 54790_8_2466 | - | chr4: 105266437-105266457 | AAGACGGACAAGGGGUCAUU | 10014 |
| 54790_8_2474 | - | chr4: 105266479-105266499 | CAUAGUGUAUACAGUCAAGA | 10015 |
| 54790_8_2475 | - | chr4: 105266480-105266500 | ACAUAGUGUAUACAGUCAAG | 10016 |
| 54790_8_2492 | - | chr4: 105266554-105266574 | UAGUGAGAGUACGAAAGGAG | 10017 |
| 54790_8_2504 | - | chr4: 105266604-105266624 | UGAAGAUCUUCCAGUAACAU | 10018 |
| 54790_8_2506 | - | chr4: 105266605-105266625 | GUGAAGAUCUUCCAGUAACA | 10019 |
| 54790_8_2508 | - | chr4: 105266615-105266635 | UAUAUAAAAGUGAAGAUCU | 10020 |
| 54790_8_2543 | - | chr4: 105266750-105266770 | CACAUUGUUAUAACCGAUUA | 10021 |
| 54790_8_2544 | - | chr4: 105266758-105266778 | UAUAUAAUCACAUUGUUAUA | 10022 |
| 54790_8_2551 | - | chr4: 105266795-105266815 | AAGACAGAGGGUGGAGGAAG | 10023 |
| 54790_8_2562 | - | chr4: 105266839-105266859 | CUUGUUUAGACUUUUUUUAA | 10024 |
| 54790_8_2568 | - | chr4: 105266873-105266893 | CGACUCGACGACUCUAGACA | 10025 |
| 54790_8_2569 | - | chr4: 105266874-105266894 | ACGACUCGACGACUCUAGAC | 10026 |
| 54790_8_2583 | - | chr4: 105266899-105266919 | ACAGAAACAAAAAUUAGAC | 10027 |
| 54790_8_2586 | - | chr4: 105266900-105266920 | UACAGAAACAAAAAUUAGA | 10028 |
| 54790_8_2588 | - | chr4: 105266901-105266921 | AUACAGAAACAAAAAUUAG | 10029 |
| 54790_8_2647 | - | chr4: 105267117-105267137 | UAACCAUAUAUAAAGACCC | 10030 |
| 54790_8_2650 | - | chr4: 105267120-105267140 | AAGUAACCAUAUAUAAAGA | 10031 |
| 54790_8_2651 | - | chr4: 105267121-105267141 | AAAGUAACCAUAUAUAAAG | 10032 |
| 54790_8_2658 | - | chr4: 105267135-105267155 | AAAACUCUCAACAAAAGUA | 10033 |
| 54790_8_2682 | - | chr4: 105267215-105267235 | AAUUUCACGAUCAAACAACC | 10034 |
| 54790_8_2684 | - | chr4: 105267218-105267238 | AAAAUUUCACGAUCAAACA | 10035 |
| 54790_8_2692 | - | chr4: 105267254-105267274 | UAGUACAAGAAAGAAGGACU | 10036 |
| 54790_8_2699 | - | chr4: 105267278-105267298 | ACAACUAGACCUAAAGACAG | 10037 |
| 54790_8_2703 | - | chr4: 105267290-105267310 | AAGUAAAGUAAUACAACUAG | 10038 |
| 54790_8_2753 | - | chr4: 105267530-105267550 | AAAAAAAAAAUCACCAAAU | 10039 |
| 54790_8_2754 | - | chr4: 105267537-105267557 | UGAAAAAAAAAAAAAAAUC | 10040 |
| 54790_8_2765 | - | chr4: 105267574-105267594 | AAAGUAAAAGACAGAAAUG | 10041 |
| 54790_8_2774 | - | chr4: 105267602-105267622 | AUAUAAAAAUUUUUGUAAAA | 10042 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_2791 | - | chr4: 105267630-105267650 | AAAAAUAUAAAUAGAAAAAA | 10043 |
| 54790_8_2802 | - | chr4: 105267683-105267703 | UACACCAACAACUAUGUCAA | 10044 |
| 54790_8_2803 | - | chr4: 105267684-105267704 | UUACACCAACAACUAUGUCA | 10045 |
| 54790_8_2808 | - | chr4: 105267700-105267720 | UUUUGGUAAAUGUAAAUUAC | 10046 |
| 54790_8_2811 | - | chr4: 105267727-105267747 | UUCGAGACGGAAUAUUAAUC | 10047 |
| 54790_8_2812 | - | chr4: 105267728-105267748 | GUUCGAGACGGAAUAUUAAU | 10048 |
| 54790_8_2813 | - | chr4: 105267729-105267749 | UGUUCGAGACGGAAUAUUAA | 10049 |
| 54790_8_2835 | - | chr4: 105267774-105267794 | AUAUAAAUUUCACCAAAAGA | 10050 |
| 54790_8_2840 | - | chr4: 105267783-105267803 | AACAUAGAAAUAUAAAUUUC | 10051 |
| 54790_8_2869 | - | chr4: 105267895-105267915 | CUUACAACUUAUAAUAGUUU | 10052 |
| 54790_8_2884 | - | chr4: 105267938-105267958 | AAAGGUAAAUACAUAAAUUA | 10053 |
| 54790_8_2888 | - | chr4: 105267962-105267982 | GAUUCAUAUCGUAAUCGAAA | 10054 |
| 54790_8_2898 | - | chr4: 105268006-105268026 | ACAGAACAAGGAAUAGAAUC | 10055 |
| 54790_8_2899 | - | chr4: 105268007-105268027 | AACAGAACAAGGAAUAGAAU | 10056 |
| 54790_8_2901 | - | chr4: 105268008-105268028 | CAACAGAACAAGGAAUAGAA | 10057 |
| 54790_8_2906 | - | chr4: 105268036-105268056 | AUCUUCGUCAACCAAUUUUU | 10058 |
| 54790_8_2910 | - | chr4: 105268046-105268066 | ACUACAACUUAUCUUCGUCA | 10059 |
| 54790_8_2948 | - | chr4: 105268194-105268214 | GUAUAUAAUUAAAGUAAAAG | 10060 |
| 54790_8_2977 | - | chr4: 105268289-105268309 | UAUAAACUACGAUAAAAUU | 10061 |
| 54790_8_3010 | - | chr4: 105268464-105268484 | ACUUGUAUAACUAAUCAAAC | 10062 |
| 54790_8_3012 | - | chr4: 105268465-105268485 | AACUUGUAUAACUAAUCAAA | 10063 |
| 54790_8_3015 | - | chr4: 105268466-105268486 | UAACUUGUAUAACUAAUCAA | 10064 |
| 54790_8_3025 | - | chr4: 105268505-105268525 | AAGAAAGUUUUUGGACGAC | 10065 |
| 54790_8_3026 | - | chr4: 105268506-105268526 | UAAGAAAGUUUUUGGACGA | 10066 |
| 54790_8_3027 | - | chr4: 105268507-105268527 | UUAAGAAAGUUUUUGGACG | 10067 |
| 54790_8_3053 | - | chr4: 105268692-105268712 | UCCGCACUCGGUGACGCGGA | 10068 |
| 54790_8_3054 | - | chr4: 105268693-105268713 | GUCCGCACUCGGUGACGCGG | 10069 |
| 54790_8_3057 | - | chr4: 105268712-105268732 | AGGCUUUCACGACCUUAAUG | 10070 |
| 54790_8_3059 | - | chr4: 105268721-105268741 | UGGAGCCGGAGGCUUUCACG | 10071 |
| 54790_8_3062 | - | chr4: 105268737-105268757 | GAGUUCACUAGGUGGGUGGA | 10072 |
| 54790_8_3064 | - | chr4: 105268761-105268781 | GUCCGACCAGAGUUUUGAGG | 10073 |
| 54790_8_3068 | - | chr4: 105268776-105268796 | AAAACGGUACAACCGGUCCG | 10074 |
| 54790_8_3069 | - | chr4: 105268780-105268800 | UCUCAAAACGGUACAACCGG | 10075 |
| 54790_8_3072 | - | chr4: 105268785-105268805 | CUCUAUCUCAAAACGGUACA | 10076 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_8_3083 | − | chr4: 105268857-105268877 | GGAGUUGGAGGGUUCGUCGA | 10077 |
| 54790_8_3084 | − | chr4: 105268858-105268878 | CGGAGUUGGAGGGUUCGUCG | 10078 |
| 54790_8_3089 | − | chr4: 105268880-105268900 | GGACCUAAGUUCGCUAAGAG | 10079 |
| 54790_8_3090 | − | chr4: 105268898-105268918 | AGUGACGUUGGAGACGGAGG | 10080 |
| 54790_8_3092 | − | chr4: 105268922-105268942 | CCUCACGUCACCGUGCUAGA | 10081 |
| 54790_8_3093 | − | chr4: 105268923-105268943 | ACCUCACGUCACCGUGCUAG | 10082 |
| 54790_8_3095 | − | chr4: 105268933-105268953 | AGUGGGUCCGACCUCACGUC | 10083 |
| 54790_8_3097 | − | chr4: 105268943-105268963 | AGGGUGAGACAGUGGGUCCG | 10084 |
| 54790_8_3099 | − | chr4: 105268947-105268967 | UCUCAGGGUGAGACAGUGGG | 10085 |
| 54790_8_3115 | − | chr4: 105269016-105269036 | CACAUAUUACCACACAUACA | 10086 |
| 54790_8_3117 | − | chr4: 105269028-105269048 | AGACUAGGUGAACACAUAUU | 10087 |
| 54790_8_3122 | − | chr4: 105269060-105269080 | UAUAUACAACCCAGAUGAAU | 10088 |
| 54790_8_3125 | − | chr4: 105269071-105269091 | AACUGGUAUAAUAUAUACAA | 10089 |
| 54790_8_3126 | − | chr4: 105269072-105269092 | UAACUGGUAUAAUAUAUACA | 10090 |
| 54790_8_3136 | − | chr4: 105269133-105269153 | AGUCUAUGAUGACCUAUUUU | 10091 |
| 54790_8_3139 | − | chr4: 105269142-105269162 | AGGUUGACAAGUCUAUGAUG | 10092 |
| 54790_8_3148 | − | chr4: 105269168-105269188 | UCUAAUGGAAAAAGGGAAU | 10093 |
| 54790_8_3154 | − | chr4: 105269194-105269214 | AUAUUUACCACACUUUAAUU | 10094 |
| 54790_8_3155 | − | chr4: 105269195-105269215 | AAUAUUUACCACACUUUAAU | 10095 |
| 54790_8_3163 | − | chr4: 105269208-105269228 | AACCUCAAUUAAAAAUAUUU | 10096 |
| 54790_8_3166 | − | chr4: 105269227-105269247 | AAGUAUAUUUACCUAAAUAA | 10097 |
| 54790_8_3173 | − | chr4: 105269237-105269257 | AAAGAUCUUAAAGUAUAUUU | 10098 |
| 54790_8_3205 | − | chr4: 105269415-105269435 | UUUAUUUUAUAGUGUUAUUG | 10099 |
| 54790_8_3208 | − | chr4: 105269445-105269465 | AUAGAGCAAAUAUCUUGACA | 10100 |
| 54790_8_3211 | − | chr4: 105269479-105269499 | AUAUAUCCAGAAACAAAA | 10101 |
| 54790_9_2 | + | chr4: 105269733-105269753 | AUGGCAGCACAUUGGUAAGU | 10102 |
| 54790_9_3 | + | chr4: 105269734-105269754 | UGGCAGCACAUUGGUAAGUU | 10103 |
| 54790_9_6 | + | chr4: 105269740-105269760 | CACAUUGGUAAGUUGGGCUG | 10104 |
| 54790_9_14 | + | chr4: 105269800-105269820 | AAUAAAGACAUAUGCAAGAC | 10105 |
| 54790_9_15 | + | chr4: 105269801-105269821 | AUAAAGACAUAUGCAAGACU | 10106 |
| 54790_9_17 | + | chr4: 105269814-105269834 | CAAGACUGGGUAAUUUAUAA | 10107 |
| 54790_9_23 | + | chr4: 105269847-105269867 | AAUUGACUCACAGUUCCACA | 10108 |
| 54790_9_28 | + | chr4: 105269853-105269873 | CUCACAGUUCCACAUGGCUG | 10109 |
| 54790_9_29 | + | chr4: 105269856-105269876 | ACAGUUCCACAUGGCUGUGG | 10110 |
| 54790_9_32 | + | chr4: 105269877-105269897 | GGCCUCACAAUCAUAGCUGA | 10111 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_9_35 | + | chr4: 105269886-105269906 | AUCAUAGCUGAAGGCAAAUG | 10112 |
| 54790_9_37 | + | chr4: 105269908-105269928 | GAGCAAAGUCACAUCUUACA | 10113 |
| 54790_9_38 | + | chr4: 105269911-105269931 | CAAAGUCACAUCUUACAUGG | 10114 |
| 54790_9_39 | + | chr4: 105269915-105269935 | GUCACAUCUUACAUGGCGGC | 10115 |
| 54790_9_44 | + | chr4: 105269933-105269953 | GCAGGCAAGAGAACAUGUGC | 10116 |
| 54790_9_47 | + | chr4: 105269934-105269954 | CAGGCAAGAGAACAUGUGCA | 10117 |
| 54790_9_49 | + | chr4: 105269935-105269955 | AGGCAAGAGAACAUGUGCAG | 10118 |
| 54790_9_56 | + | chr4: 105269994-105270014 | UUACUCUCCUGAGAACAGCA | 10119 |
| 54790_9_59 | + | chr4: 105269995-105270015 | UACUCUCCUGAGAACAGCAU | 10120 |
| 54790_9_62 | + | chr4: 105270032-105270052 | AUGAUUCAAUUACCUCCCAC | 10121 |
| 54790_9_63 | + | chr4: 105270033-105270053 | UGAUUCAAUUACCUCCCACU | 10122 |
| 54790_9_67 | + | chr4: 105270052-105270072 | UGGGUCCUUCCCAAAACACA | 10123 |
| 54790_9_69 | + | chr4: 105270053-105270073 | GGGUCCUUCCCAAAACACAU | 10124 |
| 54790_9_72 | + | chr4: 105270061-105270081 | CCCAAAACACAUGGGAAUUU | 10125 |
| 54790_9_74 | + | chr4: 105270062-105270082 | CCAAAACACAUGGGAAUUUU | 10126 |
| 54790_9_81 | + | chr4: 105270088-105270108 | UACAAUUCAAGAUGAGAUUU | 10127 |
| 54790_9_83 | + | chr4: 105270092-105270112 | AUUCAAGAUGAGAUUUAGGU | 10128 |
| 54790_9_85 | + | chr4: 105270093-105270113 | UUCAAGAUGAGAUUUAGGUA | 10129 |
| 54790_9_92 | + | chr4: 105270131-105270151 | AUCAGCAGCAUCUCAUGUUG | 10130 |
| 54790_9_96 | + | chr4: 105270144-105270164 | CAUGUUGAGGAGCAGAACAC | 10131 |
| 54790_9_98 | + | chr4: 105270161-105270181 | CACUGGAAUUUAGUAGCAUU | 10132 |
| 54790_9_103 | + | chr4: 105270185-105270205 | UAGAGUAAUAUGUUGUCUGC | 10133 |
| 54790_9_106 | + | chr4: 105270194-105270214 | AUGUUGUCUGCAGGUUUCAC | 10134 |
| 54790_9_116 | + | chr4: 105270244-105270264 | UGUUGCAAAGUGACCUGCUU | 10135 |
| 54790_9_120 | + | chr4: 105270268-105270288 | AUAACUAGCACUCUCAUGAU | 10136 |
| 54790_9_121 | + | chr4: 105270272-105270292 | CUAGCACUCUCAUGAUAGGU | 10137 |
| 54790_9_131 | + | chr4: 105270320-105270340 | UGACAAGCACAUGAGAAUCA | 10138 |
| 54790_9_134 | + | chr4: 105270330-105270350 | AUGAGAAUCAUGGAAAUCCU | 10139 |
| 54790_9_138 | + | chr4: 105270381-105270401 | GCCAGUUACAGUUAACUUCC | 10140 |
| 54790_9_144 | + | chr4: 105270412-105270432 | AAAAUUCAGUGCCAGUUACC | 10141 |
| 54790_9_164 | + | chr4: 105270539-105270559 | CAUCAUUGUCACAGUAACUG | 10142 |
| 54790_9_170 | + | chr4: 105270594-105270614 | AGCCUGACUACAUAUUACAG | 10143 |
| 54790_9_171 | + | chr4: 105270595-105270615 | GCCUGACUACAUAUUACAGU | 10144 |
| 54790_9_173 | + | chr4: 105270603-105270623 | ACAUAUUACAGUGGGUAAAA | 10145 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_9_174 | + | chr4: 105270608-105270628 | UUACAGUGGGUAAAAUGGAU | 10146 |
| 54790_9_177 | + | chr4: 105270620-105270640 | AAAUGGAUCGGUCUUGUAAU | 10147 |
| 54790_9_179 | + | chr4: 105270624-105270643 | UGGAUCGGUCUUGUAAUUGG | 10148 |
| 54790_9_180 | + | chr4: 105270630-105270649 | GGUCUUGUAAUUGGAGGCAG | 10149 |
| 54790_9_183 | + | chr4: 105270634-105270654 | UGUAAUUGGAGGCAGUGGUG | 10150 |
| 54790_9_185 | + | chr4: 105270635-105270655 | GUAAUUGGAGGCAGUGGUGA | 10151 |
| 54790_9_188 | + | chr4: 105270636-105270656 | UAAUUGGAGGCAGUGGUGAG | 10152 |
| 54790_9_193 | + | chr4: 105270694-105270714 | UAUAUGUUCUAUACCAACAA | 10153 |
| 54790_9_194 | + | chr4: 105270695-105270715 | AUAUGUUCUAUACCAACAAA | 10154 |
| 54790_9_196 | + | chr4: 105270701-105270721 | UCUAUACCAACAAAGGGUUC | 10155 |
| 54790_9_197 | + | chr4: 105270702-105270722 | CUAUACCAACAAAGGGUUCA | 10156 |
| 54790_9_201 | + | chr4: 105270722-105270742 | GGGUAUAAUUUUGCAUGUAA | 10157 |
| 54790_9_203 | + | chr4: 105270723-105270743 | GGUAUAAUUUUGCAUGUAAA | 10158 |
| 54790_9_204 | + | chr4: 105270724-105270744 | GUAUAAUUUUGCAUGUAAAG | 10159 |
| 54790_9_217 | + | chr4: 105270804-105270824 | AACCUAAUGAAUUAUCAACA | 10160 |
| 54790_9_218 | + | chr4: 105270811-105270831 | UGAAUUAUCAACAUGGAUGU | 10161 |
| 54790_9_222 | + | chr4: 105270829-105270849 | GUAGGUGUAGUUGAAGAAGA | 10162 |
| 54790_9_229 | + | chr4: 105270844-105270864 | GAAGAUGGUCAGUGAGAAUA | 10163 |
| 54790_9_231 | + | chr4: 105270858-105270878 | AGAAUAUGGAAACAGAUAUC | 10164 |
| 54790_9_234 | + | chr4: 105270878-105270898 | AGGAAUUAAAGUCAUAUUCU | 10165 |
| 54790_9_235 | + | chr4: 105270879-105270899 | GGAAUUAAAGUCAUAUUCUA | 10166 |
| 54790_9_241 | + | chr4: 105270896-105270916 | CUAGGGCAGAAAAGCAUUCA | 10167 |
| 54790_9_243 | + | chr4: 105270899-105270919 | GGGCAGAAAAGCAUUCAUGG | 10168 |
| 54790_9_249 | + | chr4: 105270935-105270955 | CUGAAGUAAUUUGAAGAAGC | 10169 |
| 54790_9_266 | + | chr4: 105270996-105271016 | UAAUGUUCUAGAUCAGAGAU | 10170 |
| 54790_9_271 | + | chr4: 105271016-105271036 | UGGAAAACUCUUCUCUAUAA | 10171 |
| 54790_9_272 | + | chr4: 105271017-105271037 | GGAAAACUCUUCUCUAUAAA | 10172 |
| 54790_9_274 | + | chr4: 105271025-105271045 | CUUCUCUAUAAAGGGCAAGA | 10173 |
| 54790_9_277 | + | chr4: 105271038-105271058 | GGCAAGAUGGUAAAUAUUUU | 10174 |
| 54790_9_279 | + | chr4: 105271039-105271059 | GCAAGAUGGUAAAUAUUUUA | 10175 |
| 54790_9_280 | + | chr4: 105271047-105271067 | GUAAAUAUUUUAGGGACUGC | 10176 |
| 54790_9_282 | + | chr4: 105271056-105271076 | UUAGGGACUGCAGGCCACAU | 10177 |
| 54790_9_286 | + | chr4: 105271076-105271096 | AGGAUUUCUGUCACAUUGUU | 10178 |
| 54790_9_289 | + | chr4: 105271079-105271099 | AUUUCUGUCACAUUGUUGG | 10179 |
| 54790_9_290 | + | chr4: 105271080-105271100 | UUUCUGUCACAUUGUUUGGU | 10180 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
| --- | --- | --- | --- | --- |
| 54790_9_291 | + | chr4: 105271081-105271101 | UUCUGUCACAUUGUUUGGUG | 10181 |
| 54790_9_315 | + | chr4: 105271146-105271166 | AAAAACCAUUCUUAGUUUAC | 10182 |
| 54790_9_321 | + | chr4: 105271169-105271189 | CCAUACAAACACAAGCUGUG | 10183 |
| 54790_9_322 | + | chr4: 105271184-105271204 | CUGUGAGGCACAUUAGCCGU | 10184 |
| 54790_9_323 | + | chr4: 105271190-105271210 | GGCACAUUAGCCGUAGGUUC | 10185 |
| 54790_9_331 | + | chr4: 105271226-105271246 | GAUCCAGAAGAACAAACACA | 10186 |
| 54790_9_333 | + | chr4: 105271292-105271312 | CUCAGCACCUGCUCAUUAUU | 10187 |
| 54790_9_335 | + | chr4: 105271295-105271315 | AGCACCUGCUCAUUAUUAGG | 10188 |
| 54790_9_343 | + | chr4: 105271338-105271358 | CAGAAGUAGUAAAUGAUAAC | 10189 |
| 54790_9_345 | + | chr4: 105271339-105271359 | AGAAGUAGUAAAUGAUAACU | 10190 |
| 54790_9_346 | + | chr4: 105271340-105271360 | GAAGUAGUAAAUGAUAACUG | 10191 |
| 54790_9_349 | + | chr4: 105271378-105271398 | AUAUAACCAUGUUUCAUUCC | 10192 |
| 54790_9_350 | + | chr4: 105271382-105271402 | AACCAUGUUUCAUUCCAGGA | 10193 |
| 54790_9_359 | + | chr4: 105271408-105271428 | CAGAGAGUAAGAUGAUGAGA | 10194 |
| 54790_9_369 | + | chr4: 105271449-105271469 | AAUUUGCCUCUGAUAGAGCA | 10195 |
| 54790_9_370 | + | chr4: 105271450-105271470 | AUUUGCCUCUGAUAGAGCAU | 10196 |
| 54790_9_375 | + | chr4: 105271468-105271488 | AUGGGUUCUGUGAAGUAAAA | 10197 |
| 54790_9_378 | + | chr4: 105271473-105271493 | UUCUGUGAAGUAAAAUGGAA | 10198 |
| 54790_9_384 | + | chr4: 105271497-105271517 | GCACUAGAUAAGAACUGAAU | 10199 |
| 54790_9_385 | + | chr4: 105271498-105271518 | CACUAGAUAAGAACUGAAUA | 10200 |
| 54790_9_387 | + | chr4: 105271512-105271532 | UGAAUAGGGUUAAAUAUGUA | 10201 |
| 54790_9_390 | + | chr4: 105271513-105271533 | GAAUAGGGUUAAAUAUGUAU | 10202 |
| 54790_9_392 | + | chr4: 105271526-105271546 | UAUGUAUGGGAAAAGUAACA | 10203 |
| 54790_9_400 | + | chr4: 105271572-105271592 | ACUUCUGUGCAGAAAGUGAC | 10204 |
| 54790_9_431 | + | chr4: 105271812-105271832 | UUUAAUUAUCAAAGCAACAG | 10205 |
| 54790_9_439 | + | chr4: 105271863-105271883 | UUUCAGAGUACCCACUUAUA | 10206 |
| 54790_9_456 | + | chr4: 105271903-105271923 | AAUGAAGAAAAGAGAAAGUU | 10207 |
| 54790_9_459 | + | chr4: 105271921-105271941 | UUAGGUUUGACAGAGUACAA | 10208 |
| 54790_9_464 | + | chr4: 105271924-105271944 | GGUUUGACAGAGUACAAAGG | 10209 |
| 54790_9_486 | + | chr4: 105272024-105272044 | UUUUUACUUCAGUUAUCUUA | 10210 |
| 54790_9_497 | + | chr4: 105272050-105272070 | UUUCUUAAACAGAGAGAGUU | 10211 |
| 54790_9_500 | + | chr4: 105272057-105272077 | AACAGAGAGAGUUAGGUGUC | 10212 |
| 54790_9_508 | + | chr4: 105272102-105272122 | GUGUUCAGAAGUAUGAGAUG | 10213 |
| 54790_9_515 | + | chr4: 105272129-105272149 | UGUGAUACUACCAAAAACAG | 10214 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_9_522 | + | chr4: 105272172-105272192 | CUUUUAGCCUGUUUUUGAAG | 10215 |
| 54790_9_541 | + | chr4: 105272231-105272251 | AGCAAGAGAGUGCUUCAUUU | 10216 |
| 54790_9_543 | + | chr4: 105272232-105272252 | GCAAGAGAGUGCUUCAUUUU | 10217 |
| 54790_9_544 | + | chr4: 105272233-105272253 | CAAGAGAGUGCUUCAUUUUG | 10218 |
| 54790_9_546 | + | chr4: 105272234-105272254 | AAGAGAGUGCUUCAUUUUGG | 10219 |
| 54790_9_560 | + | chr4: 105272279-105272299 | AGAAACAUAUGUGAAGAACA | 10220 |
| 54790_9_561 | + | chr4: 105272280-105272300 | GAAACAUAUGUGAAGAACAA | 10221 |
| 54790_9_566 | + | chr4: 105272319-105272339 | UUCCUGAUAGACUCAGAGAA | 10222 |
| 54790_9_567 | + | chr4: 105272320-105272340 | UCCUGAUAGACUCAGAGAAA | 10223 |
| 54790_9_570 | + | chr4: 105272323-105272343 | UGAUAGACUCAGAGAAAGGG | 10224 |
| 54790_9_571 | + | chr4: 105272324-105272344 | GAUAGACUCAGAGAAAGGGU | 10225 |
| 54790_9_573 | + | chr4: 105272327-105272347 | AGACUCAGAGAAAGGGUGGG | 10226 |
| 54790_9_574 | + | chr4: 105272328-105272348 | GACUCAGAGAAAGGGUGGGU | 10227 |
| 54790_9_580 | + | chr4: 105272387-105272407 | UUGCUAUUUUCAUUAAUAAC | 10228 |
| 54790_9_584 | + | chr4: 105272391-105272411 | UAUUUUCAUUAAUAACAGGU | 10229 |
| 54790_9_585 | + | chr4: 105272395-105272415 | UUCAUUAAUAACAGGUAGGA | 10230 |
| 54790_9_590 | + | chr4: 105272403-105272423 | UAACAGGUAGGAUGGUUUUA | 10231 |
| 54790_9_595 | + | chr4: 105272426-105272446 | UAAUAUAUAUGUCACUGAUC | 10232 |
| 54790_9_596 | + | chr4: 105272436-105272456 | GUCACUGAUCUGGAUCAACU | 10233 |
| 54790_9_601 | + | chr4: 105272465-105272485 | ACACAAAUCUGAAUACUGAG | 10234 |
| 54790_9_606 | + | chr4: 105272500-105272520 | ACACACACACGUUUUCUU | 10235 |
| 54790_9_608 | + | chr4: 105272501-105272521 | CACACACACGUUUUCUUU | 10236 |
| 54790_9_610 | + | chr4: 105272515-105272535 | UUCUUUGGGACCUGUAGUUG | 10237 |
| 54790_9_631 | − | chr4: 105269865-105269885 | CACUCCGGAGGUGUCGGUAC | 10238 |
| 54790_9_637 | − | chr4: 105269882-105269902 | ACGGAAGUCGAUACUAACAC | 10239 |
| 54790_9_647 | − | chr4: 105269965-105269985 | CUAGACUACUAAAAUAUUUC | 10240 |
| 54790_9_650 | − | chr4: 105269966-105269986 | UCUAGACUACUAAAAUAUUU | 10241 |
| 54790_9_651 | − | chr4: 105269967-105269987 | CUCUAGACUACUAAAAUAUU | 10242 |
| 54790_9_660 | − | chr4: 105270004-105270024 | UAGAAAGGGUACGACAAGAG | 10243 |
| 54790_9_663 | − | chr4: 105270030-105270050 | CCCUCCAUUAACUUAGUACC | 10244 |
| 54790_9_664 | − | chr4: 105270031-105270051 | ACCCUCCAUUAACUUAGUAC | 10245 |
| 54790_9_665 | − | chr4: 105270032-105270052 | CACCCUCCAUUAACUUAGUA | 10246 |
| 54790_9_668 | − | chr4: 105270033-105270053 | UCACCCUCCAUUAACUUAGU | 10247 |
| 54790_9_674 | − | chr4: 105270047-105270067 | AAACCCUUCCUGGGUCACCC | 10248 |
| 54790_9_676 | − | chr4: 105270050-105270070 | ACAAAACCCUUCCUGGGUCA | 10249 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_9_677 | − | chr4: 105270051-105270071 | CACAAAACCCUUCCUGGGUC | 10250 |
| 54790_9_681 | − | chr4: 105270060-105270080 | UUAAGGGUACACAAAACCCU | 10251 |
| 54790_9_683 | − | chr4: 105270064-105270084 | GGUUUUAAGGGUACACAAAA | 10252 |
| 54790_9_685 | − | chr4: 105270065-105270085 | GGGUUUUAAGGGUACACAAA | 10253 |
| 54790_9_691 | − | chr4: 105270125-105270145 | GAGAUGCUGCACUAUACCAG | 10254 |
| 54790_9_692 | − | chr4: 105270130-105270150 | AACAUGAGAUGCUGCACUAU | 10255 |
| 54790_9_706 | − | chr4: 105270245-105270265 | AAAGCAGGUCACUUUGCAAC | 10256 |
| 54790_9_709 | − | chr4: 105270260-105270280 | AGUGCUAGUUAUGCCAAAGC | 10257 |
| 54790_9_714 | − | chr4: 105270309-105270329 | UGCUUGUCAACACAAUUGAC | 10258 |
| 54790_9_723 | − | chr4: 105270350-105270370 | ACUGGUUUAGAUUAACACCA | 10259 |
| 54790_9_725 | − | chr4: 105270368-105270388 | AACUGGCAAUGCAUAGUCAC | 10260 |
| 54790_9_730 | − | chr4: 105270385-105270405 | UCCUGGAAGUUAACUGUAAC | 10261 |
| 54790_9_735 | − | chr4: 105270402-105270422 | ACUGAAUUUGAGAUUUUCC | 10262 |
| 54790_9_740 | − | chr4: 105270426-105270446 | AUUACAAUCUACCAGGUAAC | 10263 |
| 54790_9_744 | − | chr4: 105270433-105270453 | UUAACUGAUUACAAUCUACC | 10264 |
| 54790_9_750 | − | chr4: 105270464-105270484 | UAAGGUGAAUGGCUUGUAUU | 10265 |
| 54790_9_752 | − | chr4: 105270475-105270495 | UUCUCUCUCUGUAAGGUGAA | 10266 |
| 54790_9_754 | − | chr4: 105270482-105270502 | AAUAUGCUUCUCUCUCUGUA | 10267 |
| 54790_9_759 | − | chr4: 105270507-105270527 | UUUAUGCUUCUCUCUCUGUA | 10268 |
| 54790_9_770 | − | chr4: 105270568-105270588 | CACUGUGAAUCUUUUACAAU | 10269 |
| 54790_9_775 | − | chr4: 105270599-105270619 | ACCCACUGUAAUAUGUAGUC | 10270 |
| 54790_9_786 | − | chr4: 105270710-105270730 | UUAUACCCUGAACCCUUUGU | 10271 |
| 54790_9_796 | − | chr4: 105270753-105270773 | UUGUUCUUUAUCUCUACUCU | 10272 |
| 54790_9_797 | − | chr4: 105270754-105270774 | UUUGUUCUUUAUCUCUACUC | 10273 |
| 54790_9_811 | − | chr4: 105270809-105270829 | AUCCAUGUUGAUAAUUCAUU | 10274 |
| 54790_9_848 | − | chr4: 105271073-105271093 | UUACACUGUCUUUAGGAUAC | 10275 |
| 54790_9_861 | − | chr4: 105271137-105271157 | CUUACCAAAAAUGUAAAAGU | 10276 |
| 54790_9_866 | − | chr4: 105271154-105271174 | AUACCGGUCAUUUGAUUCUU | 10277 |
| 54790_9_869 | − | chr4: 105271172-105271192 | GGAGUGUCGAACACAAACAU | 10278 |
| 54790_9_871 | − | chr4: 105271203-105271223 | UCAAUCCUUUGGUCUUGGAU | 10279 |
| 54790_9_879 | − | chr4: 105271219-105271239 | GUUCUUCUGGAUGUCUUCAA | 10280 |
| 54790_9_885 | − | chr4: 105271232-105271252 | AGGCCUUGUGUUUGUUCUUC | 10281 |
| 54790_9_891 | − | chr4: 105271252-105271272 | UAGAUGUUGGGGUGGUUGGU | 10282 |
| 54790_9_892 | − | chr4: 105271256-105271276 | AUUUUAGAUGUUGGGGUGGU | 10283 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_9_894 | − | chr4: 105271260-105271280 | GAUGAUUUUAGAUGUUGGGG | 10284 |
| 54790_9_895 | − | chr4: 105271263-105271283 | AGUGAUGAUUUUAGAUGUUG | 10285 |
| 54790_9_896 | − | chr4: 105271264-105271284 | UAGUGAUGAUUUUAGAUGUU | 10286 |
| 54790_9_898 | − | chr4: 105271265-105271285 | UUAGUGAUGAUUUUAGAUGU | 10287 |
| 54790_9_901 | − | chr4: 105271302-105271322 | AUAGCCUCCUAAUAAUGAGC | 10288 |
| 54790_9_913 | − | chr4: 105271377-105271397 | GAAUGAAACAUGGUUAUAUU | 10289 |
| 54790_9_916 | − | chr4: 105271387-105271407 | CACCUUCCUGGAAUGAAACA | 10290 |
| 54790_9_919 | − | chr4: 105271399-105271419 | CUUACUCUCUGUCACCUUCC | 10291 |
| 54790_9_928 | − | chr4: 105271458-105271478 | CAGAACCCAUGCUCUAUCAG | 10292 |
| 54790_9_959 | − | chr4: 105271608-105271628 | GAAAUAACUUCAACAUGAGA | 10293 |
| 54790_9_964 | − | chr4: 105271641-105271661 | UGAGAGAAAUGUGAUCACAA | 10294 |
| 54790_9_981 | − | chr4: 105271711-105271731 | UAUUUAGUGUUUUUGAUCAA | 10295 |
| 54790_9_994 | − | chr4: 105271756-105271776 | CUUUGGUAAAAGAUUAUUUG | 10296 |
| 54790_9_998 | − | chr4: 105271773-105271793 | UACUACAAUUACACUAGCUU | 10297 |
| 54790_9_1008 | − | chr4: 105271812-105271832 | CUGUUGCUUUGAUAAUUAAA | 10298 |
| 54790_9_1009 (TI-7) (6900) | − | chr4: 105271845-105271865 | AAAGGGUAAGGGUGGAGGG | 10299 |
| 54790_9_1012 | − | chr4: 105271848-105271868 | UGAAAGGGUAAGGGGUGGA | 10300 |
| 54790_9_1015 (TI-8) (7600) | − | chr4: 105271849-105271869 | CUGAAAGGGUAAGGGGUGG | 10301 |
| 54790_9_1017 | − | chr4: 105271852-105271872 | ACUCUGAAAGGGUAAGGGG | 10302 |
| 54790_9_1020 | − | chr4: 105271855-105271875 | GGUACUCUGAAAGGGUAAG | 10303 |
| 54790_9_1021 | − | chr4: 105271856-105271876 | GGGUACUCUGAAAGGGUAA | 10304 |
| 54790_9_1023 | − | chr4: 105271857-105271877 | UGGGUACUCUGAAAGGGUA | 10305 |
| 54790_9_1025 | − | chr4: 105271862-105271882 | AUAAGUGGGUACUCUGAAAA | 10306 |
| 54790_9_1026 | − | chr4: 105271863-105271883 | UAUAAGUGGGUACUCUGAAA | 10307 |
| 54790_9_1032 | − | chr4: 105271876-105271896 | UGAAAUAUGACCAUAUAAGU | 10308 |
| 54790_9_1033 | − | chr4: 105271877-105271897 | CUGAAAUAUGACCAUAUAAG | 10309 |
| 54790_9_1053 | − | chr4: 105271989-105272009 | GGUAAAGAUUUGGCUGAUAC | 10310 |
| 54790_9_1054 | − | chr4: 105271999-105272019 | AAAUGAAAGGUAAAGAUU | 10311 |
| 54790_9_1055 | − | chr4: 105272010-105272030 | UAAAAAUAUAAAAAAUGAAA | 10312 |
| 54790_9_1078 | − | chr4: 105272142-105272162 | GAAAUGACUUCCUCUGUUUU | 10313 |
| 54790_9_1085 | − | chr4: 105272182-105272202 | UGUGAAGCCUCUUCAAAAAC | 10314 |
| 54790_9_1100 | − | chr4: 105272273-105272293 | UCACAUAUGUUUCUGUCUAU | 10315 |
| 54790_9_1102 | − | chr4: 105272274-105272294 | UUCACAUAUGUUUCUGUCUA | 10316 |
| 54790_9_1106 | − | chr4: 105272309-105272329 | CUAUCAGGAACAGUUAGCUG | 10317 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_9_1109 | − | chr4: 105272324-105272344 | ACCCUUUCUCUGAGUCUAUC | 10318 |
| 54790_9_1116 | − | chr4: 105272375-105272395 | AAUAGCAACAAAAUGGUACA | 10319 |
| 54790_9_1117 | − | chr4: 105272376-105272396 | AAAUAGCAACAAAAUGGUAC | 10320 |
| 54790_9_1122 | − | chr4: 105272382-105272402 | UAAUGAAAAUAGCAACAAAA | 10321 |
| 54790_9_1130 | − | chr4: 105272462-105272482 | AGUAUUCAGAUUUGUGUUGG | 10322 |
| 54790_9_1131 | − | chr4: 105272465-105272485 | CUCAGUAUUCAGAUUUGUGU | 10323 |
| 54790_9_1136 | − | chr4: 105272528-105272548 | GACAUUACAGCCUCAACUAC | 10324 |
| 54790_10_4 | + | chr4: 105272938-105272958 | UUGUAGAUAAAUGUGUUGUG | 10325 |
| 54790_10_9 | + | chr4: 105272964-105272984 | AUUAAAAUGAAAAUUAUUU | 10326 |
| 54790_10_20 | + | chr4: 105272993-105273013 | CCCCAUCAACUUGUAAGUUC | 10327 |
| 54790_10_21 | + | chr4: 105272994-105273014 | CCCAUCAACUUGUAAGUUCU | 10328 |
| 54790_10_22 | + | chr4: 105272995-105273015 | CCAUCAACUUGUAAGUUCUG | 10329 |
| 54790_10_25 | + | chr4: 105273007-105273027 | AAGUUCUGGGGUACACAUGC | 10330 |
| 54790_10_27 | + | chr4: 105273016-105273036 | GGUACACAUGCAGGAUGUGC | 10331 |
| 54790_10_28 | + | chr4: 105273029-105273049 | GAUGUGCAGGUUUGUUAUAC | 10332 |
| 54790_10_31 | + | chr4: 105273045-105273065 | AUACAGGUAAACAUGUGCCA | 10333 |
| 54790_10_35 | + | chr4: 105273078-105273098 | CACAGAUCAACCCAUUACCU | 10334 |
| 54790_10_38 | + | chr4: 105273119-105273139 | CCUGAUGCACCCCUACCAAU | 10335 |
| 54790_10_46 | + | chr4: 105273196-105273216 | AAAAUGAACAUUGUUAAUUU | 10336 |
| 54790_10_49 | + | chr4: 105273215-105273235 | UUGGAAAGUUAUAUCAAUCA | 10337 |
| 54790_10_58 | + | chr4: 105273254-105273274 | GAGUCUUCUCUAAAGUAGCA | 10338 |
| 54790_10_59 | + | chr4: 105273255-105273275 | AGUCUUCUCUAAAGUAGCAA | 10339 |
| 54790_10_60 | + | chr4: 105273260-105273280 | UCUCUAAAGUAGCAAGGGCC | 10340 |
| 54790_10_63 | + | chr4: 105273278-105273298 | CCAGGCUUUGUUCUCAGAGA | 10341 |
| 54790_10_70 | + | chr4: 105273305-105273325 | GAGAUAUUGCACCAUCAACA | 10342 |
| 54790_10_73 | + | chr4: 105273314-105273334 | CACCAUCAACAUGGAAAACA | 10343 |
| 54790_10_76 | + | chr4: 105273324-105273344 | AUGGAAAACAUGGAAAGUC | 10344 |
| 54790_10_81 | + | chr4: 105273362-105273382 | AAACAGCAACUUUUUUUAAC | 10345 |
| 54790_10_89 | + | chr4: 105273394-105273414 | CGAUGAAAUUCAUUGUAAUU | 10346 |
| 54790_10_90 | + | chr4: 105273401-105273421 | AUUCAUUGUAAUUUGGCAGU | 10347 |
| 54790_10_96 | + | chr4: 105273416-105273436 | GCAGUAGGCCAAAUUAGUAG | 10348 |
| 54790_10_101 | + | chr4: 105273430-105273450 | UAGUAGAGGAGCUAAUAGUU | 10349 |
| 54790_10_107 | + | chr4: 105273458-105273478 | AACACAGUAAACCAGAACUG | 10350 |
| 54790_10_109 | + | chr4: 105273482-105273502 | AACAAGACCUUGAAUUUUGU | 10351 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_10_118 | + | chr4: 105273532-105273552 | GCAAAUGAGCUCUUCCAAAA | 10352 |
| 54790_10_120 | + | chr4: 105273533-105273553 | CAAAUGAGCUCUUCCAAAAU | 10353 |
| 54790_10_125 | + | chr4: 105273551-105273571 | AUGGGAAAAGAAAAAUACAU | 10354 |
| 54790_10_128 | + | chr4: 105273565-105273585 | AUACAUUGGUGACAAAACAC | 10355 |
| 54790_10_140 | + | chr4: 105273634-105273654 | UAAACUUAACCUACUGUUUU | 10356 |
| 54790_10_162 | + | chr4: 105273698-105273718 | AAUAUGAUUGAGAGAGAGAG | 10357 |
| 54790_10_163 | + | chr4: 105273699-105273719 | AUAUGAUUGAGAGAGAGA | 10358 |
| 54790_10_165 | + | chr4: 105273700-105273720 | UAUGAUUGAGAGAGAGAG | 10359 |
| 54790_10_175 | + | chr4: 105273739-105273759 | CCUUAGACAUGUUGAGUCUG | 10360 |
| 54790_10_179 | + | chr4: 105273745-105273765 | ACAUGUUGAGUCUGUGGUUU | 10361 |
| 54790_10_182 | + | chr4: 105273748-105273768 | UGUUGAGUCUGUGGUUUAGG | 10362 |
| 54790_10_184 | + | chr4: 105273749-105273769 | GUUGAGUCUGUGGUUUAGGA | 10363 |
| 54790_10_185 | + | chr4: 105273750-105273770 | UUGAGUCUGUGGUUUAGGAG | 10364 |
| 54790_10_210 | + | chr4: 105273911-105273931 | AAGAAAAAAAUCCAAAAUU | 10365 |
| 54790_10_212 | + | chr4: 105273912-105273932 | AGAAAAAAAUCCAAAAUUU | 10366 |
| 54790_10_213 | + | chr4: 105273916-105273936 | AAAAAUCCAAAAUUUGGGA | 10367 |
| 54790_10_214 | + | chr4: 105273922-105273942 | UCCAAAAUUUGGGAUGGUAU | 10368 |
| 54790_10_215 | + | chr4: 105273927-105273947 | AAUUUGGGAUGGUAUUGGCC | 10369 |
| 54790_10_231 | + | chr4: 105274022-105274042 | UGAUUCAUUUCCAAGCUCAG | 10370 |
| 54790_10_241 | + | chr4: 105274080-105274100 | CUUGAUAAGUGUUUAUUGAC | 10371 |
| 54790_10_248 | + | chr4: 105274115-105274135 | UAAGUAAAUACUGUUCACUU | 10372 |
| 54790_10_255 | + | chr4: 105274168-105274188 | UGUCUCUGCUCCCUUUUAAC | 10373 |
| 54790_10_257 | + | chr4: 105274178-105274198 | CCCUUUUAACUGGCUUCUGC | 10374 |
| 54790_10_273 | + | chr4: 105274258-105274278 | UCAUAUGACUUUUUAAAGUG | 10375 |
| 54790_10_293 | + | chr4: 105274350-105274370 | AACUGUGUUAACUUCCUUUC | 10376 |
| 54790_10_325 | + | chr4: 105274496-105274516 | AGCAAAUUCCAUUGCAUGCC | 10377 |
| 54790_10_334 | + | chr4: 105274541-105274561 | AAACAUUUUCCUUCCCAUUU | 10378 |
| 54790_10_340 | + | chr4: 105274558-105274578 | UUUAGGAAUUUACUUACCAG | 10379 |
| 54790_10_342 | + | chr4: 105274559-105274579 | UUAGGAAUUUACUUACCAGU | 10380 |
| 54790_10_344 | + | chr4: 105274560-105274580 | UAGGAAUUUACUUACCAGUG | 10381 |
| 54790_10_346 | + | chr4: 105274561-105274581 | AGGAAUUUACUUACCAGUGG | 10382 |
| 54790_10_354 | + | chr4: 105274571-105274591 | UUACCAGUGGGGUGAAGAG | 10383 |
| 54790_10_355 | + | chr4: 105274572-105274592 | UACCAGUGGGGGUGAAGAGA | 10384 |
| 54790_10_368 | + | chr4: 105274660-105274680 | UACAAAGCACUAGAAGAUG | 10385 |
| 54790_10_370 | + | chr4: 105274669-105274689 | ACUAGAAGAUGAGGUCAAAG | 10386 |

TABLE 1-continued gRNA Targeting Domains for TET2 introns and intron-exon junctions.
In the "Id" field, the first number relates to the target gene,
here, indicating human TET; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_10_374 | + | chr4: 105274679-105274699 | GAGGUCAAAGCGGUCCCUUG | 10387 |
| 54790_10_376 | + | chr4: 105274683-105274703 | UCAAAGCGGUCCCUUGAGGA | 10388 |
| 54790_10_378 | + | chr4: 105274684-105274704 | CAAAGCGGUCCCUUGAGGAA | 10389 |
| 54790_10_382 | + | chr4: 105274699-105274719 | AGGAAGGGAUGACUACACCA | 10390 |
| 54790_10_384 | + | chr4: 105274703-105274723 | AGGGAUGACUACACCAAGGA | 10391 |
| 54790_10_386 | + | chr4: 105274708-105274728 | UGACUACACCAAGGAAGGAU | 10392 |
| 54790_10_388 | + | chr4: 105274709-105274729 | GACUACACCAAGGAAGGAUA | 10393 |
| 54790_10_393 | + | chr4: 105274716-105274736 | CCAAGGAAGGAUAGGGAGAG | 10394 |
| 54790_10_396 | + | chr4: 105274717-105274737 | CAAGGAAGGAUAGGGAGAGA | 10395 |
| 54790_10_398 | + | chr4: 105274720-105274740 | GGAAGGAUAGGGAGAGAGGG | 10396 |
| 54790_10_401 | + | chr4: 105274726-105274746 | AUAGGGAGAGAGGGAGGAAA | 10397 |
| 54790_10_404 | + | chr4: 105274727-105274747 | UAGGGAGAGAGGGAGGAAAA | 10398 |
| 54790_10_405 | + | chr4: 105274730-105274750 | GGAGAGAGGGAGGAAAAGGG | 10399 |
| 54790_10_407 | + | chr4: 105274745-105274765 | AAGGGAGGCACUUCAAGCAG | 10400 |
| 54790_10_415 | + | chr4: 105274784-105274804 | AAAGAACAUUUUGCUCUCAA | 10401 |
| 54790_10_416 | + | chr4: 105274789-105274809 | ACAUUUUGCUCUCAAUGGAA | 10402 |
| 54790_10_418 | + | chr4: 105274795-105274815 | UGCUCUCAAUGGAAUGGCUU | 10403 |
| 54790_10_442 | + | chr4: 105274863-105274883 | CCUUAGACAAAAAAUUGUGC | 10404 |
| 54790_10_447 | + | chr4: 105274907-105274927 | UUGCUCUUAUCUUUGCUUAA | 10405 |
| 54790_10_448 | + | chr4: 105274908-105274928 | UGCUCUUAUCUUUGCUUAAU | 10406 |
| 54790_10_457 | + | chr4: 105274927-105274947 | UGGGUGUCGUAUAUCACUAG | 10407 |
| 54790_10_477 | − | chr4: 105272995-105273015 | GUCUUGAAUGUUGUUGAUGG | 10408 |
| 54790_10_478 | − | chr4: 105272996-105273016 | GGUCUUGAAUGUUGUUGAUG | 10409 |
| 54790_10_479 | − | chr4: 105272997-105273017 | GGGUCUUGAAUGUUGUUGAU | 10410 |
| 54790_10_482 | − | chr4: 105272998-105273018 | GGGGUCUUGAAUGUUGUUGA | 10411 |
| 54790_10_489 | − | chr4: 105273065-105273085 | UAGACACGUCGUUUAGUGGU | 10412 |
| 54790_10_491 | − | chr4: 105273091-105273111 | CCCGAAUUAUGGAUCCAUUA | 10413 |
| 54790_10_492 | − | chr4: 105273092-105273112 | ACCCGAAUUAUGGAUCCAUU | 10414 |
| 54790_10_494 | − | chr4: 105273098-105273118 | UCUACGACCCGAAUUAUGGA | 10415 |
| 54790_10_495 | − | chr4: 105273111-105273131 | CCCACGUAGUCCUUCUACGA | 10416 |
| 54790_10_496 | − | chr4: 105273112-105273132 | CCCCACGUAGUCCUUCUACG | 10417 |
| 54790_10_499 | − | chr4: 105273122-105273142 | GGAUAACCAUCCCCACGUAG | 10418 |
| 54790_10_502 | − | chr4: 105273131-105273151 | UGUGACCGCGGAUAACCAUC | 10419 |
| 54790_10_503 | − | chr4: 105273132-105273152 | GUGUGACCGCGGAUAACCAU | 10420 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_10_505 | − | chr4: 105273133-105273153 | UGUGUGACCGCGGAUAACCA | 10421 |
| 54790_10_507 | − | chr4: 105273137-105273157 | GUUGUGUGUGACCGCGGAUA | 10422 |
| 54790_10_508 | − | chr4: 105273147-105273167 | CCUCACCCCUGUUGUGUGUG | 10423 |
| 54790_10_509 | − | chr4: 105273161-105273181 | CCUGUGUACCACCCCCUCAC | 10424 |
| 54790_10_511 | − | chr4: 105273162-105273182 | ACCUGUGUACCACCCCCUCA | 10425 |
| 54790_10_513 | − | chr4: 105273163-105273183 | UACCUGUGUACCACCCCCUC | 10426 |
| 54790_10_515 | − | chr4: 105273168-105273188 | UCGUGUACCUGUGUACCACC | 10427 |
| 54790_10_518 | − | chr4: 105273169-105273189 | CUCGUGUACCUGUGUACCAC | 10428 |
| 54790_10_520 | − | chr4: 105273170-105273190 | UCUCGUGUACCUGUGUACCA | 10429 |
| 54790_10_521 | − | chr4: 105273171-105273191 | UUCUCGUGUACCUGUGUACC | 10430 |
| 54790_10_526 | − | chr4: 105273174-105273194 | AUAUUCUCGUGUACCUGUGU | 10431 |
| 54790_10_529 | − | chr4: 105273182-105273202 | CAUUUACAUAUUCUCGUGU | 10432 |
| 54790_10_541 | − | chr4: 105273254-105273274 | UGCUACUUUAGAGAAGACUC | 10433 |
| 54790_10_546 | − | chr4: 105273281-105273301 | CCAUCUCUGAGAACAAAGCC | 10434 |
| 54790_10_557 | − | chr4: 105273319-105273339 | UUCCAUGUUUUCCAUGUUGA | 10435 |
| 54790_10_572 | − | chr4: 105273427-105273447 | UAUUAGCUCCUCUACUAAUU | 10436 |
| 54790_10_581 | − | chr4: 105273472-105273492 | AGGUCUUGUUACCUCAGUUC | 10437 |
| 54790_10_584 | − | chr4: 105273492-105273512 | CUACUAACCAACAAAAUUCA | 10438 |
| 54790_10_601 | − | chr4: 105273549-105273569 | GUAUUUUCUUUUUCCCAUUU | 10439 |
| 54790_10_623 | − | chr4: 105273620-105273640 | ACAAAUCCAAAUUUUGAAAC | 10440 |
| 54790_10_624 | − | chr4: 105273621-105273641 | AACAAAUCCAAAUUUUGAAA | 10441 |
| 54790_10_625 | − | chr4: 105273622-105273642 | UAACAAAUCCAAAUUUUGAA | 10442 |
| 54790_10_628 | − | chr4: 105273635-105273655 | UAAAACAGUAGGUUAACAAA | 10443 |
| 54790_10_632 | − | chr4: 105273646-105273666 | UUUUAGAAACCUAAAACAGU | 10444 |
| 54790_10_644 | − | chr4: 105273742-105273762 | CCACAGACUCAACAUGUCUA | 10445 |
| 54790_10_655 | − | chr4: 105273808-105273828 | CAGCUGUAAUCUAUUUUGAU | 10446 |
| 54790_10_657 | − | chr4: 105273809-105273829 | ACAGCUGUAAUCUAUUUUGA | 10447 |
| 54790_10_665 | − | chr4: 105273879-105273899 | AGACAUAAAGCAGGAGGCUA | 10448 |
| 54790_10_670 | − | chr4: 105273885-105273905 | AACUGCAGACAUAAAGCAGG | 10449 |
| 54790_10_674 | − | chr4: 105273888-105273908 | ACAAACUGCAGACAUAAAGC | 10450 |
| 54790_10_686 | − | chr4: 105273926-105273946 | GCCAAUACCAUCCCAAAUUU | 10451 |
| 54790_10_694 | − | chr4: 105273948-105273968 | GUUUGCUUUUGUUAAUGGCC | 10452 |
| 54790_10_695 | − | chr4: 105273953-105273973 | AACUGGUUUGCUUUUGUUAA | 10453 |
| 54790_10_699 | − | chr4: 105273970-105273990 | AUGGCUAGUUUUAAGCAAAC | 10454 |
| 54790_10_703 | − | chr4: 105273989-105274009 | ACUUCAUGAAGCAGCAAAGA | 10455 |

TABLE 1-continued gRNA Targeting Domains for TET2 introns and intron-exon junctions.
In the "Id" field, the first number relates to the target gene,
here, indicating human TET2; the second number indicates the
intron number (for example, a "1" indicates the gRNA targets a
target sequence in the intron between exon 1 and exon 2);
the final number is a unique identifier for the gRNA.

| Id | strand | genomic location (hg38) of target sequence | gRNA targeting domain sequence | SEQ ID NO: |
|---|---|---|---|---|
| 54790_10_715 | − | chr4: 105274035-105274055 | UAACUUAGUUCCUCUGAGCU | 10456 |
| 54790_10_732 | − | chr4: 105274168-105274188 | GUUAAAAGGGAGCAGAGACA | 10457 |
| 54790_10_737 | − | chr4: 105274181-105274201 | CCUGCAGAAGCCAGUUAAAA | 10458 |
| 54790_10_738 | − | chr4: 105274182-105274202 | ACCUGCAGAAGCCAGUUAAA | 10459 |
| 54790_10_744 | − | chr4: 105274211-105274231 | UGGCAGUUCUGAGAACAGAA | 10460 |
| 54790_10_746 | − | chr4: 105274212-105274232 | AUGGCAGUUCUGAGAACAGA | 10461 |
| 54790_10_753 | − | chr4: 105274231-105274251 | ACAAAUAGAUGAAACUGCAA | 10462 |
| 54790_10_783 | − | chr4: 105274367-105274387 | UAUAAGCAGGCUUUCCAGAA | 10463 |
| 54790_10_786 | − | chr4: 105274380-105274400 | ACAAGUGCUACUUUAUAAGC | 10464 |
| 54790_10_798 | − | chr4: 105274462-105274482 | AGAUUUAUUAUGUAAGAUUC | 10465 |
| 54790_10_800 | − | chr4: 105274463-105274483 | AAGAUUUAUUAUGUAAGAUU | 10466 |
| 54790_10_808 | − | chr4: 105274507-105274527 | GAAGUAACGGACCGUACGUU | 10467 |
| 54790_10_816 | − | chr4: 105274517-105274537 | AAUGAAUGAAGAAGUAACGG | 10468 |
| 54790_10_820 | − | chr4: 105274553-105274573 | UUCAUUUAAGGAUUUACCCU | 10469 |
| 54790_10_824 | − | chr4: 105274557-105274577 | ACCAUUCAUUUAAGGAUUUA | 10470 |
| 54790_10_825 | − | chr4: 105274558-105274578 | GACCAUUCAUUUAAGGAUUU | 10471 |
| 54790_10_833 | − | chr4: 105274577-105274597 | UCGGGAGAGAAGUGGGGGUG | 10472 |
| 54790_10_844 | − | chr4: 105274696-105274716 | ACAUCAGUAGGGAAGGAGUU | 10473 |
| 54790_10_846 | − | chr4: 105274697-105274717 | CACAUCAGUAGGGAAGGAGU | 10474 |
| 54790_10_849 | − | chr4: 105274719-105274739 | GGAGAGAGGGAUAGGAAGGA | 10475 |
| 54790_10_863 | − | chr4: 105274785-105274805 | AUUGAGAGCAAAAUGUUGAA | 10476 |
| 54790_10_877 | − | chr4: 105274866-105274886 | CCAGCACAAUUUUUUGUCUA | 10477 |
| 54790_10_880 | − | chr4: 105274902-105274922 | CAAAGAUAAGAGCAAAGUCA | 10478 |
| 54790_10_881 | − | chr4: 105274903-105274923 | GCAAAGAUAAGAGCAAAGUC | 10479 |
| 54790_10_886 | − | chr4: 105274962-105274982 | UAGUGAGGAUACUUAAAUGU | 10480 |
| 54790_10_891 | − | chr4: 105274977-105274997 | UUAUUUUAUGAAGGCUAGUG | 10481 |
| 54790_10_897 | − | chr4: 105274986-105275006 | UGUUGAUGAUUAUUUUAUGA | 10482 |
| CR007677 | | chr4: 105271204-105271223 | AGUUAGGAAACCAGAACCUA | 10515 |

In preferred embodiments, the gRNA molecule targets a sequence in the intron between exon 9 and exon 10, or targets an intron-exon junction which introduces a break in the DNA in said intron. Examples of such gRNA molecules are gRNA molecules comprising, e.g., consisting of, a targeting domain of any one of SEQ ID NO: 10102 to SEQ ID NO: 10324. Particularly preferred gRNA molecules are gRNA molecules comprising, e.g., consisting of, a targeting domain shown in Table 2.

TABLE 2

Exemplary gRNA Targeting Domains for the TET2 intron between exon 9 and exon 10 (mm0, mm1, mm2 and mm3 refer to the predicted number of target sequences within the genome with 0, 1 2, or 3 mismatch bases, respectively). Throughout this application, gRNAs comprising the targeting domains listed in this Table 2 may be referred to as "gX" where "X" indicates the second number of the "ID" shown in this table (thus, for example, a gRNA comprising the targeting domain of HTET2_1 may be referred to herein as "g1."

| ID | Strand | gRNA Targeting Domain Sequence (20 nt) | SEQ ID NO: | mm0 | mm1 | mm2 | mm3 |
|---|---|---|---|---|---|---|---|
| HTET2_1 (g1) | + | UGGAUCGGUCUUGUAAUUGG | 10148 | 1 | 0 | 0 | 1 |
| HTET2_2 | + | CUGUGAGGCACAUUAGCCGU | 10184 | 1 | 0 | 0 | 1 |
| HTET2_3 | - | CUUUGUCGGCAAGUCUUGAC | 10483 | 1 | 0 | 0 | 1 |
| HTET2_4 (g4) | + | GGCACAUUAGCCGUAGGUUC | 10185 | 1 | 0 | 0 | 2 |
| HTET2_5 | + | GUCUCUGACGUGGAUGAGUU | 10484 | 1 | 0 | 0 | 2 |
| HTET2_6 | + | CUAGCACUCUCAUGAUAGGU | 10137 | 1 | 0 | 0 | 3 |
| HTET2_7 | + | GCCAGUUACAGUUAACUUCC | 10140 | 1 | 0 | 0 | 3 |
| HTET2_8 | + | AGAGCACCAGAGUGCCGUCU | 10485 | 1 | 0 | 0 | 4 |
| HTET2_9 | + | CACAUUGGUAAGUUGGGCUG | 10104 | 1 | 0 | 0 | 4 |
| HTET2_10 (g10) | + | GUCACUGAUCUGGAUCAACU | 10233 | 1 | 0 | 0 | 4 |
| HTET2_11 | + | UCUCUGACGUGGAUGAGUUU | 10486 | 1 | 0 | 0 | 4 |
| HTET2_12 | + | CAGUCAAGACUUGCCGACAA | 10487 | 1 | 0 | 0 | 4 |
| HTET2_13 | - | GUGAGAGUGCAUACCUGGUA | 10488 | 1 | 0 | 0 | 4 |
| HTET2_14 | - | CUCUAGUGAGAGUGCAUACC | 10489 | 1 | 0 | 0 | 4 |
| HTET2_15 | - | AUUUGAGCUGUUCUCCAGGG | 10490 | 1 | 0 | 0 | 4 |
| HTET2_16 | + | CAGAGCACCAGAGUGCCGUC | 10491 | 1 | 0 | 0 | 5 |
| HTET2_17 (g17) | + | AGCACCUGCUCAUUAUUAGG | 10188 | 1 | 0 | 0 | 5 |
| HTET2_18 | + | CGCAAGCCAGGCUAAACAGU | 10492 | 1 | 0 | 0 | 5 |
| HTET2_19 | + | CAUGUUGAGGAGCAGAACAC | 10131 | 1 | 0 | 0 | 6 |
| HTET2_20 (g20) | + | GGUUUGACAGAGUACAAAGG | 10209 | 1 | 0 | 0 | 6 |
| HTET2_21 (g21) | + | AACAGAGAGAGUUAGGUGUC | 10212 | 1 | 0 | 0 | 6 |
| HTET2_22 (g22) | - | CUAUCAGGAACAGUUAGCUG | 10317 | 1 | 0 | 0 | 6 |
| HTET2_23 (g23) | - | ACCCUUUCUCUGAGUCUAUC | 10318 | 1 | 0 | 0 | 6 |
| HTET2_24 | + | AUGUUGUCUGCAGGUUUCAC | 10134 | 1 | 0 | 0 | 7 |
| HTET2_25 (g25) | + | CUCAGCACCUGCUCAUUAUU | 10187 | 1 | 0 | 0 | 7 |
| HTET2_26 | - | AGUGCUAGUUAUGCCAAAGC | 10257 | 1 | 0 | 1 | 2 |

TABLE 2-continued

Exemplary gRNA Targeting Domains for the TET2 intron between exon 9 and exon 10 (mm0, mm1, mm2 and mm3 refer to the predicted number of target sequences within the genome with 0, 1 2, or 3 mismatch bases, respectively). Throughout this application, gRNAs comprising the targeting domains listed in this Table 2 may be referred to as "gX" where "X" indicates the second number of the "ID" shown in this table (thus, for example, a gRNA comprising the targeting domain of HTET2_1 may be referred to herein as "g1."

| ID | Strand | gRNA Targeting Domain Sequence (20 nt) | SEQ ID NO: | mm0 | mm1 | mm2 | mm3 |
|---|---|---|---|---|---|---|---|
| HTET2_27 | + | AGAGUGCCGUCUGGGUCUGA | 10516 | 1 | 0 | 0 | 8 |
| HTET2_28 | + | AAGGAAGGCCGUCCAUUCUC | 10493 | 1 | 0 | 1 | 3 |
| HTET2_29 | + | AUCAGCAGCAUCUCAUGUUG | 10130 | 1 | 0 | 1 | 4 |
| HTET2_30 | + | UUCUUUGGGACCUGUAGUUG | 10237 | 1 | 0 | 0 | 9 |
| HTET2_31 | − | AACUGGCAAUGCAUAGUCAC | 10260 | 1 | 0 | 0 | 9 |
| HTET2_32 | − | AGUGAGAGUGCAUACCUGGU | 10494 | 1 | 0 | 0 | 10 |
| HTET2_33 | + | AGGAAGGCCGUCCAUUCUCA | 10495 | 1 | 0 | 0 | 11 |
| HTET2_34 (g34) | + | UGAUAGACUCAGAGAAAGGG | 10224 | 1 | 0 | 0 | 11 |
| HTET2_35 | − | UUCAGACCCAGACGGCACUC | 10496 | 1 | 0 | 0 | 11 |
| HTET2_36 | − | ACGUGAAGCUGCUCAUCCUC | 10497 | 1 | 0 | 1 | 6 |
| HTET2_37 | + | GGAAGGCCGUCCAUUCUCAG | 10498 | 1 | 0 | 1 | 7 |
| HTET2_38 | + | AUGGCAGCACAUUGGUAAGU | 10102 | 1 | 0 | 1 | 7 |
| HTET2_39 | − | GCAUGUUGUGCAAGUCUCUG | 10499 | 1 | 0 | 1 | 7 |
| HTET2_40 | + | GACUUGCACAACAUGCAGAA | 10500 | 1 | 0 | 1 | 8 |
| HTET2_41 | + | GUUUGGGAGUGUGGAAGCUC | 10501 | 1 | 0 | 1 | 8 |
| HTET2_42 (g42) | − | CAGAACCCAUGCUCUAUCAG | 10292 | 1 | 0 | 0 | 13 |
| HTET2_43 | − | GACAUUACAGCCUCAACUAC | 10324 | 1 | 0 | 1 | 8 |
| HTET2_44 | + | CAUGCAGAAUGGCAGCACAU | 10502 | 1 | 0 | 1 | 9 |
| HTET2_45 (g45) | + | GGUCUUGUAAUUGGAGGCAG | 10149 | 1 | 0 | 1 | 12 |
| HTET2_46 | + | CGUGGAUGAGUUUGGGAGUG | 10503 | 1 | 1 | 0 | 7 |
| HTET2_47 | + | UGUUGCAAAGUGACCUGCUU | 10135 | 1 | 0 | 1 | 13 |
| HTET2_48 (g48) | + | UUAGGGACUGCAGGCCACAU | 10177 | 1 | 0 | 2 | 8 |
| HTET2_49 | − | CAUGUUGUGCAAGUCUCUGU | 10504 | 1 | 0 | 1 | 14 |
| HTET2_50 | + | UGGCAGCACAUUGGUAAGUU | 10103 | 1 | 0 | 3 | 5 |
| HTET2_51 | + | UGGGAGUGUGGAAGCUCAGG | 10505 | 1 | 0 | 2 | 11 |
| HTET2_52 | + | UGCCGUCUGGGUCUGAAGGA | 10506 | 1 | 1 | 0 | 13 |
| HTET2_53 | − | AAAGCAGGUCACUUUGCAAC | 10256 | 1 | 0 | 0 | 24 |
| HTET2_54 (g54) | + | GUAAUUGGAGGCAGUGGUGA | 10151 | 1 | 0 | 1 | 20 |
| HTET2_55 (g55) | + | GAUAGACUCAGAGAAAGGGU | 10225 | 1 | 1 | 0 | 15 |
| HTET2_56 | − | GGCCUUCCUUCAGACCCAGA | 10507 | 1 | 0 | 3 | 10 |

TABLE 2-continued

Exemplary gRNA Targeting Domains for the TET2 intron between exon 9 and exon 10 (mm0, mm1, mm2 and mm3 refer to the predicted number of target sequences within the genome with 0, 1 2, or 3 mismatch bases, respectively). Throughout this application, gRNAs comprising the targeting domains listed in this Table 2 may be referred to as "gX" where "X" indicates the second number of the "ID" shown in this table (thus, for example, a gRNA comprising the targeting domain of HTET2_1 may be referred to herein as "g1."

| ID | Strand | gRNA Targeting Domain Sequence (20 nt) | SEQ ID NO: | mm0 | mm1 | mm2 | mm3 |
|---|---|---|---|---|---|---|---|
| HTET2_57 | - | GAGAUGCUGCUGAUAUGGUC | 10508 | 1 | 0 | 1 | 20 |
| HTET2_58 (g58) | - | CCUCACAGCUUGUGUUUGUA | 10509 | 1 | 0 | 2 | 15 |
| HTET2_59 (g59) | - | CACCUUCCUGGAAUGAAACA | 10290 | 1 | 0 | 2 | 16 |
| HTET2_60 (g60) | - | AGGCCUUGUGUUUGUUCUUC | 10281 | 1 | 0 | 0 | 29 |
| HTET2_61 | - | CUUACUCUCUGUCACCUUCC | 10291 | 1 | 0 | 2 | 20 |
| HTET2_62 | + | GACUCAGAGAAAGGGUGGGU | 10227 | 1 | 0 | 2 | 23 |
| HTET2_63 | + | CCAUACAAACACAAGCUGUG | 10183 | 1 | 1 | 4 | 27 |
| HTET2_64 | + | UAAUUGGAGGCAGUGGUGAG | 10152 | 1 | 0 | 3 | 43 |
| HTET2_65 | + | ACUUCUGUGCAGAAAGUGAC | 10204 | 1 | 0 | 6 | 29 |
| HTET2_66 | + | UGUAAUUGGAGGCAGUGGUG | 10150 | 1 | 0 | 13 | 54 |
| HTET2_67 | - | AUCUUUCCCAUGCUGUUCUC | 10510 | 2 | 11 | 17 | 60 |
| HTET2_68 | + | AGACUCAGAGAAAGGGUGGG | 10226 | 2 | 11 | 19 | 146 |
| HTET2_69 | + | UUACUCUCCUGAGAACAGCA | 10119 | 2 | 13 | 228 | 616 |
| HTET2_70 | - | UUUGGGAAGGACCCAGUGGG | 10511 | 2 | 11 | 153 | 1725 |
| HTET2_71 | + | UACUCUCCUGAGAACAGCAU | 10120 | 2 | 9 | 258 | 2845 |
| HTET2_72 | + | AGGCAAGAGAACAUGUGCAG | 10118 | 29 | 421 | 980 | 1176 |
| HTET2_73 | + | GUCACAUCUUACAUGGCGGC | 10115 | 55 | 443 | 718 | 1851 |
| HTET2_74 | + | GCAGGCAAGAGAACAUGUGC | 10116 | 34 | 455 | 1021 | 1158 |
| HTET2_75 | + | CAGGCAAGAGAACAUGUGCA | 10117 | 34 | 464 | 1106 | 1320 |
| HTET2_76 | - | UGCCUUCAGCUAUGAUUGUG | 10512 | 6 | 139 | 2157 | 3694 |
| HTET2_77 | + | GGCCUCACAAUCAUAGCUGA | 10111 | 8 | 214 | 2983 | 5040 |
| HTET2_78 | - | GUGAGGCCUCCACAGCCAUG | 10513 | 61 | 3080 | 6406 | 5844 |
| HTET2_79 | + | ACAGUUCCACAUGGCUGUGG | 10110 | 105 | 4569 | 5714 | 6456 |
| HTET2_80 | - | GGGAGGUAAUUGAAUCAUGG | 10514 | 2987 | 5462 | 8029 | 8107 |
| HTET2_81 | + | CUCACAGUUCCACAUGGCUG | 10109 | 3142 | 6162 | 7491 | 5859 |

Particularly preferred gRNA molecules are gRNA molecules comprising, e.g., consisting of a targeting domain sequence of any one of SEQ ID NO: 10148, SEQ ID NO: 10184, SEQ ID NO: 10185, SEQ ID NO: 10188, SEQ ID NO: 10209, SEQ ID NO: 10212, SEQ ID NO: 10317, SEQ ID NO: 10318, SEQ ID NO: 10187, SEQ ID NO: 10224, SEQ ID NO: 10292, SEQ ID NO: 10149, SEQ ID NO: 10177, SEQ ID NO: 10151, SEQ ID NO: 10225 or SEQ ID NO: 10509.

In some embodiments, preferred gRNA molecules are gRNA molecules comprising or consisting of a targeting domain sequence of SEQ ID NO: 10148, 10149, 10206, 10191, 10515, 10203, 10259, 10136, 10314, 10234, 10290, 10233, 10209, 10224, 10212, 10317, 10318, 10225, 10184, 10185, 10188, 10187, 10292, 10151, 10509, 10281, 10299, 10301, or 10177.

In some embodiments, preferred gRNA molecules are gRNA molecules comprising or consisting of a targeting domain sequence of SEQ ID NO: 10148, 10149, 10290, 10209, 10224, 10212, 10317, 10318, 10225, 10184, 10185, 10188, 10187, 10292, 10151, 10509, 10281, or 10177.

In some embodiments, preferred gRNA molecules are gRNA molecules comprising or consisting of a targeting domain sequence of SEQ ID NO: 10206, 10191, 10515, 10203, 10259, 10136, 10314, or 10234.

In some embodiments, preferred gRNA molecules are gRNA molecules comprising or consisting of a targeting domain sequence of SEQ ID NO: 10191, 10203, 10259, 10136, 10314, or 10234.

In some embodiments, preferred gRNA molecules are gRNA molecules comprising or consisting of a targeting domain sequence of SEQ ID NO: 10148, 10149, or 10206.

In some embodiments, preferred gRNA molecules are gRNA molecules comprising or consisting of a targeting domain sequence of SEQ ID NO: 10148. In some embodiments, preferred gRNA molecules are gRNA molecules comprising or consisting of a targeting domain sequence of SEQ ID NO: 10149. In some embodiments, preferred gRNA molecules are gRNA molecules comprising or consisting of a targeting domain sequence of SEQ ID NO: 10206.

In an aspect, the disclosure further provides for compositions useful for directing gene editing systems, e.g., a CRISPR system, zinc finger nuclease system, TALEN system, or meganuclease system, to a target sequence of a TET2 intron or TET2 intron-exon junction. In embodiments, the gene editing system further comprises a template nucleic acid, for example, for insertion of heterologous nucleic acid sequence (e.g., sequence encoding a CAR, e.g., as described herein) at or near the target locus. In an aspect, the gene editing system is a CRISPR system comprising a gRNA molecule comprising a targeting domain sequence complementary to a target sequence of a TET2 intron or TET2 intron-exon junction. In embodiments involving a CRISPR system, the gRNA molecule comprises a targeting domain sequence complementary to a target sequence adjacent to a PAM recognition sequence of the Cas molecule (e.g., Cas9 molecule) of the CRISPR system. Table 3 provides the genomic locations of the human TET2 introns according to hg38. In an aspect, the gene editing system, e.g., CRISPR system, creates a break (e.g., single or double-strand break) at a sequence (e.g., between two nucleotides) between the start nucleotide and the end nucleotide of an intron listed in Table 3. In one preferred aspect, the gene editing system, e.g., CRISPR system, creates a break (e.g., single or double-strand break) at a sequence (e.g., between two nucleotides) between the start nucleotide and the end nucleotide of the intron between exon 9 and exon 10 of Table 3 (e.g., at a position between ch4:105269748 and ch4:105272563 according to hg38).

TABLE 3

Human TET2 intron start nucleotide and end nucleotide genomic coordinates (according to hg38)

| Chromosome | Start Nucleotide | End Nucleotide | Intron |
|---|---|---|---|
| chr4 | 105146980 | 105190359 | intron between exon 1 and exon 2 |
| chr4 | 105190506 | 105233896 | intron between exon 2 and exon 3 |
| chr4 | 105237352 | 105241338 | intron between exon 3 and exon 4 |
| chr4 | 105241430 | 105242833 | intron between exon 4 and exon 5 |
| chr4 | 105242928 | 105243569 | intron between exon 5 and exon 6 |
| chr4 | 105243779 | 105259618 | intron between exon 6 and exon 7 |

TABLE 3-continued

Human TET2 intron start nucleotide and end nucleotide genomic coordinates (according to hg38)

| Chromosome | Start Nucleotide | End Nucleotide | Intron |
|---|---|---|---|
| chr4 | 105259770 | 105261758 | intron between exon 7 and exon 8 |
| chr4 | 105261849 | 105269609 | intron between exon 8 and exon 9 |
| chr4 | 105269748 | 105272563 | intron between exon 9 and exon 10 |
| chr4 | 105272919 | 105275047 | intron between exon 10 and exon 11 |

III. Methods for Designing gRNAs

Methods for designing gRNAs are described herein, including methods for selecting, designing and validating target sequences. Exemplary targeting domains are also provided herein. Targeting Domains discussed herein can be incorporated into the gRNAs described herein.

Methods for selection and validation of target sequences as well as off-target analyses are described, e.g., in. Mali el al., 2013 SCIENCE 339(6121): 823-826; Hsu et al., 2013 NAT BIOTECHNOL, 31 (9): 827-32; Fu et al., 2014 NAT BIOTECHNOL, doi: 10.1038/nbt.2808. PubMed PM ID: 24463574; Heigwer et al., 2014 NAT METHODS 11 (2): 122-3. doi: 10.1038/nmeth.2812. PubMed PMID: 24481216; Bae el al, 2014 BIOINFORMATICS PubMed PMID: 24463181; Xiao A el al, 2014 BIOINFORMATICS PubMed PMID: 24389662.

For example, a software tool can be used to optimize the choice of gRNA within a user's target sequence, e.g., to minimize total off-target activity across the genome. Off target activity may be other than cleavage. For each possible gRNA choice e.g., using *S. pyogenes* Cas9, the tool can identify all off-target sequences (e.g., preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described herein.

Although software algorithms may be used to generate an initial list of potential gRNA molecules, cutting efficiency and specificity will not necessarily reflect the predicted values, and gRNA molecules typically require screening in specific cell lines, e.g., primary human cell lines, e.g., primary human immune effector cells, e.g., primary human T cells, to determine, for example, cutting efficiency, indel formation, cutting specificity and change in desired phenotype. These properties may be assayed by the methods described herein.

IV. Cas Molecules

In some embodiments, the Cas molecule is a Class 1 Cas nuclease. In some embodiments, the Cas molecule is a Class 2 Cas nuclease. See, e.g., Makarova et al. (2015), *Nat Rev Microbiol,* 13(11): 722-36; Shmakov et al. (2015), *Molecular Cell,* 60:385-397. A Class 2 Cas molecule may be a single-protein endonuclease. In some embodiments, the Class 2 Cas molecule is from a Type II, V, or VI CRISPR/Cas system and may be a single-protein endonuclease. Non-limiting examples of Class 2 Cas molecules include Cas9, Cpf1, C2c1, C2c2, and C2c3 proteins. See, e.g., Yang et al. (2016), *Cell,* 167(7): 1814-28; Zetsche et al. (2015), *Cell,* 163: 1-13. In some embodiments, the Cas molecule is a Cpf1 molecule. Cpf1 may be homologous to Cas9 and contain a RuvC-like nuclease domain. See, e.g., Zetsche et al. (2015), the Cpf1 sequences of which are incorporated by reference in their entirety.

Cas9 Molecules

In some embodiments, the Cas molecule is a Cas9 molecule or fragment or variant, e.g., catalytic or non-catalytic variant, thereof. Cas9 molecules of a variety of species can be used in the methods and compositions described herein. While the *S. pyogenes* Cas9 molecule are the subject of much of the disclosure herein, Cas9 molecules of, derived from, or based on the Cas9 proteins of other species listed herein can be used as well. In other words, other Cas9 molecules, e.g., *S. thermophilus, Staphylococcus aureus* and/or *Neisseria meningitidis* Cas9 molecules, may be used in the systems, methods and compositions described herein.

In some embodiments, the Cas9 molecule is a high-fidelity variant harboring alterations designed to reduce non-specific DNA contacts. See, e.g., Kleinstiver et al. (2016), Nature 529(7587): 490-95; Slaymaker et al. (2016), Science, 351(6268): 84-88; Tsai et al. (2014), Nat. Biotech. 32:569-577. In some embodiments, the high-fidelity Cas9 retains on-target activities comparable to wild-type Cas9. In some embodiments, the high-fidelity Cas9 reduces off-target activities by at least about 50%, 60%, 70%, 80%, 90%, 95%, or 99% as compared to wild-type Cas9, e.g., as measured by genome-wide break capture and targeted sequencing methods. In some embodiments, the high-fidelity Cas9 renders off-target activities undetectable, e.g., as measured by genome-wide break capture and targeted sequencing methods. In some embodiments, the high-fidelity Cas9 is *Streptococcus pyogenes* SpCas9-HF 1 (Kleinstiver 2016) or Alt-R® S.p. HiFi Cas9 Nuclease 3NLS (IDT).

Additional Cas9 species include: *Acidovorax avenae, Actinobacillus pleuropneumoniae, Actinobacillus succinogenes, Actinobacillus suis, Actinomyces* sp., *Cycliphilus denitrificans, Aminomonas paucivorans, Bacillus cereus, Bacillus smithii, Bacillus thuringiensis, Bacteroides* sp., *Blastopirellula marina, Bradyrhiz' obium* sp., *Brevibacillus latemsporus, Campylobacter coli, Campylobacter jejuni, Campylobacter lad, Candidatus Puniceispirillum, Clostridiu cellulolyticum, Clostridium perfringens, Corynebacterium accolens, Corynebacterium diphtheria, Corynebacterium matruchotii, Dinoroseobacter sliibae, Eubacterium dolichum, gamma proteobacterium, Gluconacetobacler diazotrophicus, Haemophilus parainfluenzae, Haemophilus sputorum, Helicobacter canadensis, Helicobacter cinaedi, Helicobacter mustelae, Ilyobacler polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica. Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tislrella mobilis, Treponema* sp., or *Verminephrobacter eiseniae.*

A Cas9 molecule, as that term is used herein, refers to a molecule that can interact with a gRNA molecule (e.g., sequence of a domain of a tracr) and, in concert with the gRNA molecule, localize (e.g., target or home) to a site which comprises a target sequence and PAM sequence.

In an embodiment, the Cas9 molecule is capable of cleaving a target nucleic acid molecule, which may be referred to herein as an active Cas9 molecule. In an embodiment, an active Cas9 molecule, comprises one or more of the following activities: a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities; an endonuclease activity; an exonuclease activity; and a helicase activity, i.e., the ability to unwind the helical structure of a double stranded nucleic acid.

In an embodiment, an enzymatically active Cas9 molecule cleaves both DNA strands and results in a double stranded break. In an embodiment, a Cas9 molecule cleaves only one strand, e.g., the strand to which the gRNA hybridizes to, or the strand complementary to the strand the gRNA hybridizes with. In an embodiment, an active Cas9 molecule comprises cleavage activity associated with an HNH-like domain. In an embodiment, an active Cas9 molecule comprises cleavage activity associated with an N-terminal RuvC-like domain. In an embodiment, an active Cas9 molecule comprises cleavage activity associated with an HNH-like domain and cleavage activity associated with an N-terminal RuvC-like domain. In an embodiment, an active Cas9 molecule comprises an active, or cleavage competent, HNH-like domain and an inactive, or cleavage incompetent, N-terminal RuvC-like domain. In an embodiment, an active Cas9 molecule comprises an inactive, or cleavage incompetent, HNH-like domain and an active, or cleavage competent, N-terminal RuvC-like domain.

In an embodiment, the ability of an active Cas9 molecule to interact with and cleave a target nucleic acid is PAM sequence dependent. A PAM sequence is a sequence in the target nucleic acid. In an embodiment, cleavage of the target nucleic acid occurs upstream from the PAM sequence. Active Cas9 molecules from different bacterial species can recognize different sequence motifs (e.g., PAM sequences). In an embodiment, an active Cas9 molecule of *S. pyogenes* recognizes the sequence motif NGG and directs cleavage of a target nucleic acid sequence 1 to 10, e.g., 3 to 5, base pairs upstream from that sequence. See, e.g., *Mali* el al., SCIENCE 2013; 339(6121): 823-826. In an embodiment, an active Cas9 molecule of *S. thermophilus* recognizes the sequence motif NGGNG and NNAGAAW (W=A or T) and directs cleavage of a core target nucleic acid sequence 1 to 10, e.g., 3 to 5, base pairs upstream from these sequences. See, e.g., Horvath et al., SCIENCE 2010; 327(5962): 167-170, and Deveau et al, J BACTERIOL 2008; 190(4): 1390-1400. In an embodiment, an active Cas9 molecule of *S. mutans* recognizes the sequence motif NGG or NAAR (R-A or G) and directs cleavage of a core target nucleic acid sequence 1 to 10, e.g., 3 to 5 base pairs, upstream from this sequence. See, e.g., Deveau et al., J BACTERIOL 2008; 190(4): 1390-1400.

In an embodiment, an active Cas9 molecule of *S. aureus* recognizes the sequence motif NNGRR (R=A or G) and directs cleavage of a target nucleic acid sequence 1 to 10, e.g., 3 to 5, base pairs upstream from that sequence. See, e.g., Ran F. et al., NATURE, vol. 520, 2015, pp. 186-191. In an embodiment, an active Cas9 molecule of *N. meningitidis* recognizes the sequence motif NNNNGATT and directs cleavage of a target nucleic acid sequence 1 to 10, e.g., 3 to 5, base pairs upstream from that sequence. See, e.g., Hou et al., 110(39): 15644-49 (2013). The ability of a Cas9 molecule to recognize a PAM sequence can be determined, e.g., using a transformation assay described in Jinek et al, SCIENCE 2012, 337:816.

Some Cas9 molecules have the ability to interact with a gRNA molecule, and in conjunction with the gRNA molecule bind to (e.g., target or localize to) a core target domain, but are incapable of cleaving the target nucleic acid, or incapable of cleaving at efficient rates. Cas9 molecules having no, or no substantial, cleavage activity may be referred to herein as an inactive Cas9 (an enzymatically inactive Cas9), a dead Cas9, or a dCas9 molecule. See, e.g., Gilbert et al. (2013), Cell, 154(2): 442-51. For example, an inactive Cas9 molecule can lack cleavage activity or have substantially less, e.g., less than 20, 10, 5, 1 or 0.1% of the cleavage activity of a reference Cas9 molecule, as measured by an assay described herein.

Other Cas molecules, e.g., Cpf1, may also have the ability to interact with a gRNA molecule, and in conjunction with the gRNA molecule bind to (e.g., target or localize to) a core target domain, but may be incapable of cleaving the target nucleic acid, or incapable of cleaving at efficient rates. See, e.g., WO2016/205711A1, incorporated herein by reference. Cpf1 molecules having no, or no substantial, cleavage activity may be referred to herein as an inactive Cpf1 (an enzymatically inactive Cpf1), a dead Cpf1, a dCpf1, a DNase-dead Cpf1, or a ddCpf1 molecule. See, e.g., Zhang et al. (2017), Cell Discov. 3:17018. For example, a ddCpf1 molecule can lack cleavage activity, DNase activity, or have substantially less, e.g., less than 20, 10, 5, 1 or 0.1% of the cleavage activity of a reference Cpf1 molecule, as measured by an assay described herein.

Exemplary naturally occurring Cas9 molecules that may be used with the methods described herein are described in Chylinski et al, RNA Biology 2013; 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 1 1 bacterial family, a cluster 12 bacterial family, a cluster 13 bacterial family, a cluster 14 bacterial family, a cluster 1 bacterial family, a cluster 16 bacterial family, a cluster 17 bacterial family, a cluster 1 8 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 5 1 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. pyogenes* (e.g., strain SF370, MGAS 10270, MGAS 10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA 159, NN2025), *S. macacae* (e.g., strain NCTC1 1558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g.; strain F0211), *S. agalactia* (e.g., strain NEM316, A909), *Listeria monocytogenes* (e.g., strain F6854), *Listeria innocua* (*L. innocua*, e.g., strain Clip 1 1262), *EtUerococcus italicus* (e.g., strain DSM 15952), or *Enterococcus faecium* (e.g., strain 1,231, 408). Additional exemplary Cas9 molecules are a Cas9 molecule of *Neisseria meningitidis* (Hou et al. 110(39): 15644-49 (2013)) and a *S. aureus* Cas9 molecule.

In an embodiment, a Cas9 molecule, e.g., an active Cas9 molecule or inactive Cas9 molecule, comprises an amino acid sequence: having 60%, 65%, 70%, 75%, 80%, 85%, 90%, 95%, 96%, 97%, 98%, or 99% homology with; differs at no more than 1%, 2%, 5%, 10%, 15%, 20%, 30%, or 40% of the amino acid residues when compared with; differs by at least 1, 2, 5, 10 or 20 amino acids but by no more than 100, 80, 70, 60, 50, 40 or 30 amino acids from; or is identical to; any Cas9 molecule sequence described herein or a naturally occurring Cas9 molecule sequence, e.g., a Cas9 molecule from a species listed herein or described in Chylinski et al., RNA Biology 2013, 10:5,'I2'-T, 1 Hou et al. 110(39): 15644-49 (2013).

In an embodiment, a Cas9 molecule comprises an amino acid sequence having 60%, 65%, 70%, 75%, 80%, 85%, 90%, 95%, 96%, 97%, 98%, or 99% homology with; differs at no more than 1%, 2%, 5%, 10%, 15%, 20%, 30%, or 40% of the amino acid residues when compared with; differs by at least 1, 2, 5, 10 or 20 amino acids but by no more than 100, 80, 70, 60, 50, 40 or 30 amino acids from; or is identical to; *S. pyogenes* Cas9:

(SEQ ID NO: 90)

Met Asp Lys Lys Tyr Ser Ile Gly Leu Asp Ile Gly Thr Asn Ser Val
1               5                   10                  15

Gly Trp Ala Val Ile Thr Asp Glu Tyr Lys Val Pro Ser Lys Lys Phe
            20                  25                  30

```
Lys Val Leu Gly Asn Thr Asp Arg His Ser Ile Lys Lys Asn Leu Ile
         35                  40                  45

Gly Ala Leu Leu Phe Asp Ser Gly Glu Thr Ala Glu Ala Thr Arg Leu
 50                  55                  60

Lys Arg Thr Ala Arg Arg Tyr Thr Arg Arg Lys Asn Arg Ile Cys
 65              70                  75                  80

Tyr Leu Gln Glu Ile Phe Ser Asn Glu Met Ala Lys Val Asp Asp Ser
                 85                  90                  95

Phe Phe His Arg Leu Glu Glu Ser Phe Leu Val Glu Glu Asp Lys Lys
             100                 105                 110

His Glu Arg His Pro Ile Phe Gly Asn Ile Val Asp Glu Val Ala Tyr
             115                 120                 125

His Glu Lys Tyr Pro Thr Ile Tyr His Leu Arg Lys Lys Leu Val Asp
             130                 135                 140

Ser Thr Asp Lys Ala Asp Leu Arg Leu Ile Tyr Leu Ala Leu Ala His
145                 150                 155                 160

Met Ile Lys Phe Arg Gly His Phe Leu Ile Glu Gly Asp Leu Asn Pro
                 165                 170                 175

Asp Asn Ser Asp Val Asp Lys Leu Phe Ile Gln Leu Val Gln Thr Tyr
             180                 185                 190

Asn Gln Leu Phe Glu Glu Asn Pro Ile Asn Ala Ser Gly Val Asp Ala
             195                 200                 205

Lys Ala Ile Leu Ser Ala Arg Leu Ser Lys Ser Arg Arg Leu Glu Asn
210                 215                 220

Leu Ile Ala Gln Leu Pro Gly Glu Lys Lys Asn Gly Leu Phe Gly Asn
225                 230                 235                 240

Leu Ile Ala Leu Ser Leu Gly Leu Thr Pro Asn Phe Lys Ser Asn Phe
                 245                 250                 255

Asp Leu Ala Glu Asp Ala Lys Leu Gln Leu Ser Lys Asp Thr Tyr Asp
             260                 265                 270

Asp Asp Leu Asp Asn Leu Leu Ala Gln Ile Gly Asp Gln Tyr Ala Asp
             275                 280                 285

Leu Phe Leu Ala Ala Lys Asn Leu Ser Asp Ala Ile Leu Leu Ser Asp
290                 295                 300

Ile Leu Arg Val Asn Thr Glu Ile Thr Lys Ala Pro Leu Ser Ala Ser
305                 310                 315                 320

Met Ile Lys Arg Tyr Asp Glu His His Gln Asp Leu Thr Leu Leu Lys
                 325                 330                 335

Ala Leu Val Arg Gln Gln Leu Pro Glu Lys Tyr Lys Glu Ile Phe Phe
             340                 345                 350

Asp Gln Ser Lys Asn Gly Tyr Ala Gly Tyr Ile Asp Gly Gly Ala Ser
             355                 360                 365

Gln Glu Glu Phe Tyr Lys Phe Ile Lys Pro Ile Leu Glu Lys Met Asp
370                 375                 380

Gly Thr Glu Glu Leu Leu Val Lys Leu Asn Arg Glu Asp Leu Leu Arg
385                 390                 395                 400

Lys Gln Arg Thr Phe Asp Asn Gly Ser Ile Pro His Gln Ile His Leu
             405                 410                 415

Gly Glu Leu His Ala Ile Leu Arg Arg Gln Glu Asp Phe Tyr Pro Phe
             420                 425                 430

Leu Lys Asp Asn Arg Glu Lys Ile Glu Lys Ile Leu Thr Phe Arg Ile
             435                 440                 445

Pro Tyr Tyr Val Gly Pro Leu Ala Arg Gly Asn Ser Arg Phe Ala Trp
450                 455                 460
```

-continued

```
Met Thr Arg Lys Ser Glu Glu Thr Ile Thr Pro Trp Asn Phe Glu Glu
465                 470                 475                 480

Val Val Asp Lys Gly Ala Ser Ala Gln Ser Phe Ile Glu Arg Met Thr
            485                 490                 495

Asn Phe Asp Lys Asn Leu Pro Asn Glu Lys Val Leu Pro Lys His Ser
        500                 505                 510

Leu Leu Tyr Glu Tyr Phe Thr Val Tyr Asn Glu Leu Thr Lys Val Lys
            515                 520                 525

Tyr Val Thr Glu Gly Met Arg Lys Pro Ala Phe Leu Ser Gly Glu Gln
530                 535                 540

Lys Lys Ala Ile Val Asp Leu Leu Phe Lys Thr Asn Arg Lys Val Thr
545                 550                 555                 560

Val Lys Gln Leu Lys Glu Asp Tyr Phe Lys Lys Ile Glu Cys Phe Asp
                565                 570                 575

Ser Val Glu Ile Ser Gly Val Glu Asp Arg Phe Asn Ala Ser Leu Gly
            580                 585                 590

Thr Tyr His Asp Leu Leu Lys Ile Ile Lys Asp Lys Asp Phe Leu Asp
            595                 600                 605

Asn Glu Glu Asn Glu Asp Ile Leu Glu Asp Ile Val Leu Thr Leu Thr
610                 615                 620

Leu Phe Glu Asp Arg Glu Met Ile Glu Glu Arg Leu Lys Thr Tyr Ala
625                 630                 635                 640

His Leu Phe Asp Asp Lys Val Met Lys Gln Leu Lys Arg Arg Arg Tyr
                645                 650                 655

Thr Gly Trp Gly Arg Leu Ser Arg Lys Leu Ile Asn Gly Ile Arg Asp
            660                 665                 670

Lys Gln Ser Gly Lys Thr Ile Leu Asp Phe Leu Lys Ser Asp Gly Phe
            675                 680                 685

Ala Asn Arg Asn Phe Met Gln Leu Ile His Asp Asp Ser Leu Thr Phe
690                 695                 700

Lys Glu Asp Ile Gln Lys Ala Gln Val Ser Gly Gln Gly Asp Ser Leu
705                 710                 715                 720

His Glu His Ile Ala Asn Leu Ala Gly Ser Pro Ala Ile Lys Lys Gly
                725                 730                 735

Ile Leu Gln Thr Val Lys Val Val Asp Glu Leu Val Lys Val Met Gly
            740                 745                 750

Arg His Lys Pro Glu Asn Ile Val Ile Glu Met Ala Arg Glu Asn Gln
            755                 760                 765

Thr Thr Gln Lys Gly Gln Lys Asn Ser Arg Glu Arg Met Lys Arg Ile
770                 775                 780

Glu Glu Gly Ile Lys Glu Leu Gly Ser Gln Ile Leu Lys Glu His Pro
785                 790                 795                 800

Val Glu Asn Thr Gln Leu Gln Asn Glu Lys Leu Tyr Leu Tyr Tyr Leu
                805                 810                 815

Gln Asn Gly Arg Asp Met Tyr Val Asp Gln Glu Leu Asp Ile Asn Arg
            820                 825                 830

Leu Ser Asp Tyr Asp Val Asp His Ile Val Pro Gln Ser Phe Leu Lys
            835                 840                 845

Asp Asp Ser Ile Asp Asn Lys Val Leu Thr Arg Ser Asp Lys Asn Arg
850                 855                 860

Gly Lys Ser Asp Asn Val Pro Ser Glu Glu Val Val Lys Lys Met Lys
865                 870                 875                 880

Asn Tyr Trp Arg Gln Leu Leu Asn Ala Lys Leu Ile Thr Gln Arg Lys
                885                 890                 895
```

-continued

Phe Asp Asn Leu Thr Lys Ala Glu Arg Gly Gly Leu Ser Glu Leu Asp
            900                 905                 910
Lys Ala Gly Phe Ile Lys Arg Gln Leu Val Glu Thr Arg Gln Ile Thr
        915                 920                 925
Lys His Val Ala Gln Ile Leu Asp Ser Arg Met Asn Thr Lys Tyr Asp
    930                 935                 940
Glu Asn Asp Lys Leu Ile Arg Glu Val Lys Val Ile Thr Leu Lys Ser
945                 950                 955                 960
Lys Leu Val Ser Asp Phe Arg Lys Asp Phe Gln Phe Tyr Lys Val Arg
                965                 970                 975
Glu Ile Asn Asn Tyr His His Ala His Asp Ala Tyr Leu Asn Ala Val
            980                 985                 990
Val Gly Thr Ala Leu Ile Lys Lys Tyr Pro Lys Leu Glu Ser Glu Phe
        995                 1000                1005
Val Tyr Gly Asp Tyr Lys Val Tyr Asp Val Arg Lys Met Ile Ala Lys
    1010                1015                1020
Ser Glu Gln Glu Ile Gly Lys Ala Thr Ala Lys Tyr Phe Phe Tyr Ser
1025                1030                1035                1040
Asn Ile Met Asn Phe Phe Lys Thr Glu Ile Thr Leu Ala Asn Gly Glu
                1045                1050                1055
Ile Arg Lys Arg Pro Leu Ile Glu Thr Asn Gly Glu Thr Gly Glu Ile
            1060                1065                1070
Val Trp Asp Lys Gly Arg Asp Phe Ala Thr Val Arg Lys Val Leu Ser
        1075                1080                1085
Met Pro Gln Val Asn Ile Val Lys Lys Thr Glu Val Gln Thr Gly Gly
    1090                1095                1100
Phe Ser Lys Glu Ser Ile Leu Pro Lys Arg Asn Ser Asp Lys Leu Ile
1105                1110                1115                1120
Ala Arg Lys Lys Asp Trp Asp Pro Lys Lys Tyr Gly Gly Phe Asp Ser
                1125                1130                1135
Pro Thr Val Ala Tyr Ser Val Leu Val Val Ala Lys Val Glu Lys Gly
            1140                1145                1150
Lys Ser Lys Lys Leu Lys Ser Val Lys Glu Leu Leu Gly Ile Thr Ile
        1155                1160                1165
Met Glu Arg Ser Ser Phe Glu Lys Asn Pro Ile Asp Phe Leu Glu Ala
    1170                1175                1180
Lys Gly Tyr Lys Glu Val Lys Lys Asp Leu Ile Ile Lys Leu Pro Lys
1185                1190                1195                1200
Tyr Ser Leu Phe Glu Leu Glu Asn Gly Arg Lys Arg Met Leu Ala Ser
                1205                1210                1215
Ala Gly Glu Leu Gln Lys Gly Asn Glu Leu Ala Leu Pro Ser Lys Tyr
            1220                1225                1230
Val Asn Phe Leu Tyr Leu Ala Ser His Tyr Glu Lys Leu Lys Gly Ser
        1235                1240                1245
Pro Glu Asp Asn Glu Gln Lys Gln Leu Phe Val Glu Gln His Lys His
    1250                1255                1260
Tyr Leu Asp Glu Ile Ile Glu Gln Ile Ser Glu Phe Ser Lys Arg Val
1265                1270                1275                1280
Ile Leu Ala Asp Ala Asn Leu Asp Lys Val Leu Ser Ala Tyr Asn Lys
                1285                1290                1295
His Arg Asp Lys Pro Ile Arg Glu Gln Ala Glu Asn Ile Ile His Leu
            1300                1305                1310
Phe Thr Leu Thr Asn Leu Gly Ala Pro Ala Ala Phe Lys Tyr Phe Asp
        1315                1320                1325

```
Thr Thr Ile Asp Arg Lys Arg Tyr Thr Ser Thr Lys Glu Val Leu Asp
    1330                1335                1340

Ala Thr Leu Ile His Gln Ser Ile Thr Gly Leu Tyr Glu Thr Arg Ile
1345                1350                1355                1360

Asp Leu Ser Gln Leu Gly Gly Asp
                1365
```

In embodiments, the Cas9 molecule is a *S. pyogenes* Cas9 variant of SEQ ID NO: 90 that includes one or more mutations to positively charged amino acids (e.g., lysine, arginine or histidine) that introduce an uncharged or nonpolar amino acid, e.g., alanine, at said position. In embodiments, the mutation is to one or more positively charged amino acids in the nt-groove of Cas9. In embodiments, the Cas9 molecule is a *S. pyogenes* Cas9 variant of SEQ ID NO: 90 that includes a mutation at position 855 of SEQ ID NO: 90, for example a mutation to an uncharged amino acid, e.g., alanine, at position 855 of SEQ ID NO: 90. In embodiments, the Cas9 molecule has a mutation only at position 855 of SEQ ID NO: 90, relative to SEQ ID NO: 90, e.g., to an uncharged amino acid, e.g., alanine. In embodiments, the Cas9 molecule is a *S. pyogenes* Cas9 variant of SEQ ID NO: 90 that includes a mutation at position 810, a mutation at position 1003, and/or a mutation at position 1060 of SEQ ID NO: 90, for example a mutation to alanine at position 810, position 1003, and/or position 1060 of SEQ ID NO: 90. In embodiments, the Cas9 molecule has a mutation only at position 810, position 1003, and position 1060 of SEQ ID NO: 90, relative to SEQ ID NO: 90, e.g., where each mutation is to an uncharged amino acid, for example, alanine. In embodiments, the Cas9 molecule is a *S. pyogenes* Cas9 variant of SEQ ID NO: 90 that includes a mutation at position 848, a mutation at position 1003, and/or a mutation at position 1060 of SEQ ID NO: 90, for example a mutation to alanine at position 848, position 1003, and/or position 1060 of SEQ ID NO: 90. In embodiments, the Cas9 molecule has a mutation only at position 848, position 1003, and position 1060 of SEQ ID NO: 90, relative to SEQ ID NO: 90, e.g., where each mutation is to an uncharged amino acid, for example, alanine. In embodiments, the Cas9 molecule is a Cas9 molecule as described in Slaymaker et al., *Science Express*, available online Dec. 1, 2015 at Science DOI: 10.1126/science.aad5227.

In embodiments, the Cas9 molecule is a *S pyogenes* Cas9 variant of SEQ ID NO: 90 that includes one or more mutations. In embodiments, the Cas9 variant comprises a mutation at position 80 of SEQ ID NO: 90, e.g., includes a leucine at position 80 of SEQ ID NO: 90 (i.e., comprises or consists of, SEQ ID NO: 90 with a C80L mutation). In embodiments, the Cas9 variant comprises a mutation at position 574 of SEQ ID NO: 90, e.g., includes a glutamic acid at position 574 of SEQ ID NO: 90 (i.e., comprises or consists of, SEQ ID NO: 90 with a C574E mutation). In embodiments, the Cas9 variant comprises a mutation at position 80 and a mutation at position 574 of SEQ ID NO: 90, e.g., includes a leucine at position 80 of SEQ ID NO: 90, and a glutamic acid at position 574 of SEQ ID NO: 90 (i.e., comprises or consists of, SEQ ID NO: 90 with a C80L mutation and a C574E mutation). Without being bound by theory, it is believed that such mutations improve the solution properties of the Cas9 molecule.

In embodiments, the Cas9 molecule is a *S pyogenes* Cas9 variant of SEQ ID NO: 90 that includes one or more mutations. In embodiments, the Cas9 variant comprises a mutation at position 147 of SEQ ID NO: 90, e.g., includes a tyrosine at position 147 of SEQ ID NO: 90 (i.e., comprises or consists of, SEQ ID NO: 90 with a D147Y mutation). In embodiments, the Cas9 variant comprises a mutation at position 411 of SEQ ID NO: 90, e.g., includes a threonine at position 411 of SEQ ID NO: 90 (i.e., comprises or consists of, SEQ ID NO: 90 with a P411T mutation). In embodiments, the Cas9 variant comprises a mutation at position 147 and a mutation at position 411 of SEQ ID NO: 90, e.g., includes a tyrosine at position 147 of SEQ ID NO: 90, and a threonine at position 411 of SEQ ID NO: 90 (i.e., comprises or consists of, SEQ ID NO: 90 with a D147Y mutation and a P411T mutation). Without being bound by theory, it is believed that such mutations improve the targeting efficiency of the Cas9 molecule, e.g., in yeast.

In embodiments, the Cas9 molecule is a *S. pyogenes* Cas9 variant of SEQ ID NO: 90 that includes one or more mutations. In embodiments, the Cas9 variant comprises a mutation at position 1135 of SEQ ID NO: 90, e.g., includes a glutamic acid at position 1135 of SEQ ID NO: 90 (i.e., comprises or consists of, SEQ ID NO: 90 with a D1135E mutation). Without being bound by theory, it is believed that such mutations improve the selectivity of the Cas9 molecule for the NGG PAM sequence versus the NAG PAM sequence.

In embodiments, the Cas9 molecule is a *S. pyogenes* Cas9 variant of SEQ ID NO: 90 that includes one or more mutations that introduce an uncharged or nonpolar amino acid, e.g., alanine, at certain positions. In embodiments, the Cas9 molecule is a *S. pyogenes* Cas9 variant of SEQ ID NO: 90 that includes a mutation at position 497, a mutation at position 661, a mutation at position 695 and/or a mutation at position 926 of SEQ ID NO: 90, for example a mutation to alanine at position 497, position 661, position 695 and/or position 926 of SEQ ID NO: 90. In embodiments, the Cas9 molecule has a mutation only at position 497, position 661, position 695, and position 926 of SEQ ID NO: 90, relative to SEQ ID NO: 90, e.g., where each mutation is to an uncharged amino acid, for example, alanine. Without being bound by theory, it is believed that such mutations reduce the cutting by the Cas9 molecule at off-target sites It will be understood that the mutations described herein to the Cas9 molecule may be combined, and may be combined with any of the fusions or other modifications described herein, and the Cas9 molecule may be tested in any of the assays described herein.

Various types of Cas molecules can be used herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al., *PLoS COMPUTATIONAL BIOLOGY* 2005, 1(6): e60 and Makarova et al., *NATURE REVIEW MICROBIOLOGY* 2011 9:467-477, the contents of both references are incorporated herein by reference in their entirety.

In an embodiment, a Cas or Cas9 molecule used in the methods disclosed herein comprises one or more of the following activities: a nickase activity; a double stranded cleavage activity (e.g., an endonuclease and/or exonuclease activity); a helicase activity; or the ability, together with a gRNA molecule, to localize to a target nucleic acid.

Altered Cas9 Molecules

Naturally occurring Cas9 molecules may possess a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule used with the methods disclosed herein can include all or a subset of these properties. In typical embodiments, Cas9 molecules have the ability to interact with a gRNA molecule and, in concert with the gRNA molecule, localize to a site in a nucleic acid. Other activities, e.g., PAM specificity, cleavage activity, or helicase activity can vary more widely in Cas9 molecules.

Cas9 molecules with desired properties can be made in a number of ways, e.g., by alteration of a parental, e.g., naturally occurring Cas9 molecule to provide an altered Cas9 molecule having a desired property. For example, one or more mutations or differences relative to a parental Cas9 molecule can be introduced. Such mutations and differences may comprise: substitutions (e.g., conservative substitutions or substitutions of non-essential amino acids); insertions; or deletions. In an embodiment, a Cas9 molecule can comprises one or more mutations or differences, e.g., at least 1, 2, 3, 4, 5, 10, 15, 20, 30, 40 or 50 mutations but less than 200, 100, or 80 mutations relative to a reference Cas9 molecule while retaining or enhancing one or more activities of the reference Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein. In an embodiment, exemplary activities comprise one or more of PAM specificity, cleavage activity, and helicase activity. A mutation(s) can be present, e.g., in: one or more RuvC-like domain, e.g., an N-terminal RuvC-like domain; an HNH-like domain; a region outside the RuvC-like domains and the HNH-like domain. In some embodiments, a mutation(s) is present in an N-terminal RuvC-like domain. In some embodiments, a mutation(s) is present in an HNH-like domain. In some embodiments, mutations are present in both an N-terminal RuvC-like domain and an HNH-like domain.

Whether or not a particular sequence, e.g., a substitution, may affect one or more activity, such as targeting activity, cleavage activity, etc., can be evaluated or predicted by, e.g., evaluating whether the mutation is conservative or by the method described in Section III. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an active Cas9 molecule, without abolishing or more preferably, without substantially altering a Cas9 activity (e.g., cleavage activity), whereas changing an "essential" amino acid residue results in a substantial loss of activity (e.g., cleavage activity).

Cas9 Molecules with Altered PAM Recognition or No PAM Recognition

Naturally occurring Cas9 molecules may recognize specific PAM sequences, for example the PAM recognition sequences described above for *S. pyogenes, S. thermophilus, S. mutans, S. aureus* and *N. meningitidis*.

In an embodiment, a Cas9 molecule has the same PAM specificities as a naturally occurring Cas9 molecule. In other embodiments, a Cas9 molecule has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule recognizes to decrease off target sites and/or improve specificity; or eliminate a PAM recognition requirement. In an embodiment, a Cas9 molecule can be altered, e.g., to increase length of PAM recognition sequence and/or improve Cas9 specificity to high level of identity to decrease off target sites and increase specificity. In an embodiment, the length of the PAM recognition sequence is at least 4, 5, 6, 7, 8, 9, 10 or 15 amino acids in length. Cas9 molecules that recognize different PAM sequences and/or have reduced off-target activity can be generated using directed evolution. Exemplary methods and systems that can be used for directed evolution of Cas9 molecules are described, e.g., in Esvelt el al, Nature 2011, 472(7344): 499-503. Candidate Cas9 molecules can be evaluated, e.g., by methods described herein.

Non-Cleaving and Modified-Cleavage Cas9 Molecules

In an embodiment, a Cas9 molecule comprises a cleavage property that differs from a naturally occurring Cas9 molecule, e.g., that differs from the naturally occurring Cas9 molecule having the closest homology. For example, a Cas9 molecule can differ from naturally occurring Cas9 molecules, e.g., a Cas9 molecule of *S. pyogenes*, as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

Modified Cleavage Active Cas9 Molecules

In an embodiment, an active Cas9 molecule comprises one or more of the following activities: cleavage activity associated with an N-terminal RuvC-like domain; cleavage activity associated with an HNH-like domain; cleavage activity associated with an HNH domain and cleavage activity associated with an N-terminal RuvC-like domain.

In an embodiment, the Cas9 molecule is a Cas9 nickase, e.g., cleaves only a single strand of DNA. In some embodiments, the Cas9 nickase comprises a RuvC-like domain that is capable of cleavage and a HNH-like domain that has reduced cleavage capability or is incapable of cleavage. In alternate embodiments, the Cas9 nickase comprises a HNH-like domain that is capable of cleavage and a RuvC-like domain that has reduced cleavage capability or is incapable of cleavage. In an embodiment, the Cas9 nickase includes a mutation at position 10 and/or a mutation at position 840 of SEQ ID NO: 90, e.g., comprises a D10A and/or H840A mutation to SEQ ID NO: 90.

Non-Cleaving Inactive Cas9 Molecules

In an embodiment, the altered Cas9 molecule is an inactive Cas9 molecule which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, S. thermophilus, S. aureus or N. meningitidis. In an embodiment, the reference Cas9 molecule is the naturally occurring Cas9 molecule having the closest sequence identity or homology. In an embodiment, the inactive Cas9 molecule lacks substantial cleavage activity associated with an N-terminal RuvC-like domain and cleavage activity associated with an HNH-like domain.

In an embodiment, the Cas9 molecule is dCas9. See, e.g., Tsai et al. (2014), Nat. Biotech. 32:569-577.

A catalytically inactive Cas9 molecule may be fused with a transcription repressor. An inactive Cas9 fusion protein complexes with a gRNA and localizes to a DNA sequence specified by gRNA's targeting domain, but, unlike an active Cas9, it will not cleave the target DNA. Fusion of an effector domain, such as a transcriptional repression domain, to an inactive Cas9 enables recruitment of the effector to any DNA site specified by the gRNA. Site specific targeting of a Cas9 fusion protein to a promoter region of a gene can block or affect polymerase binding to the promoter region, for example, a Cas9 fusion with a transcription factor (e.g., a transcription activator) and/or a transcriptional enhancer binding to the nucleic acid to increase or inhibit transcription activation. Alternatively, site specific targeting of a Cas9-fusion to a transcription repressor to a promoter region of a gene can be used to decrease transcription activation.

Transcription repressors or transcription repressor domains that may be fused to an inactive Cas9 molecule can include ruppel associated box (KRAB or SKD), the Mad mSIN3 interaction domain (SID) or the ERF repressor domain (ERD).

In another embodiment, an inactive Cas9 molecule may be fused with a protein that modifies chromatin. For example, an inactive Cas9 molecule may be fused to heterochromatin protein 1 (HP1), a histone lysine methyltransferase (e.g., SUV39H 1, SUV39H2, G9A, ESET/SETDB1, Pr-SET7/8, SUV4-20H 1,RIZ1), a histone lysine demethylates (e.g., LSD1/BHC1 10, SpLsdl/Sw, 1/Safl 10, Su(var)3-3, JMJD2A/JHDM3A, JMJD2B, JMJD2C/GASC1, JMJD2D, Rph 1, JARID 1 A/RBP2, JARI DIB/PLU-I, JAR1D 1C/SMCX, JARID1 D/SMCY, Lid, Jhn2, Jmj2), a histone lysine deacetylases (e.g., HDAC1, HDAC2, HDAC3, HDAC8, Rpd3, Hos 1, Cir6, HDAC4, HDAC5, HDAC7, HDAC9, Hdal, Cir3, SIRT 1, SIRT2, Sir2, Hst 1, Hst2, Hst3, Hst4, HDAC 11) and a DNA methylases (DNMT1,DNMT2a/DMNT3b, MET 1). An inactive Cas9-chromatin modifying molecule fusion protein can be used to alter chromatin status to reduce expression a target gene.

The heterologous sequence (e.g., the transcription repressor domain) may be fused to the N- or C-terminus of the inactive Cas9 protein. In an alternative embodiment, the heterologous sequence (e.g., the transcription repressor domain) may be fused to an internal portion (i.e., a portion other than the N-terminus or C-terminus) of the inactive Cas9 protein.

The ability of a Cas9 molecule/gRNA molecule complex to bind to and cleave a target nucleic acid can be evaluated, e.g., by the methods described herein in Section II. The activity of a Cas9 molecule, e.g., either an active Cas9 or an inactive Cas9, alone or in a complex with a gRNA molecule may also be evaluated by methods well-known in the art, including, gene expression assays and chromatin-based assays, e.g., chromatin immunoprecipitation (ChiP) and chromatin in vivo assay (CiA).

Other Molecules

In embodiments, the Cas molecule, e.g., a Cas9 of S. pyogenes, may comprise one or more amino acid sequences that confer additional activity. Non-limiting examples include one or more of a nuclear localization signal or sequence, a mitochondrial localization signal, a chloroplast localization signal, a endoplasmic reticulum (ER) retention signal, a tag or a marker (e.g., a histidine tag or a fluorescent protein), or a larger polypeptide, e.g., an enzyme, a transcription factor, or a functional portion thereof (see, e.g., Maeder et al., 2013; Perez-Piniera et al., 2013; Gilbert et al., 2013; Guilinger et al., 2014).

In some aspects, the Cas9 molecule may comprise one or more nuclear localization sequences (NLSs), such as at least 1, 2, 3, 4, 5, 6, 7, 8, 9, 10, or more NLSs. In some embodiments, the Cas9 molecule comprises at least 1, 2, 3, 4, 5, 6, 7, 8, 9, 10, or more NLSs at or near the amino-terminus, at least 1, 2, 3, 4, 5, 6, 7, 8, 9, 10, or more NLSs at or near the carboxy-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Typically, an NLS consists of one or more short sequences of positively charged lysines or arginines exposed on the protein surface, but other types of NLS are known. Non-limiting examples of NLSs include an NLS sequence comprising or derived from: the NLS of the SV40 virus large T-antigen, having the amino acid sequence PKKKRKV (SEQ ID NO: 91); the NLS from nucleoplasmin (e.g. the nucleoplasmin bipartite NLS with the sequence KRPAATKKAGQAKKKK (SEQ ID NO: 92); the c-myc NLS having the amino acid sequence PAAKRVKLD (SEQ ID NO: 93) or RQRRNELKRSP (SEQ ID NO: 94); the hRNPA1 M9 NLS having the sequence NQSSNFGPMKGGNFGGRSSGPYGGGGQYFAK-PRNQGGY (SEQ ID NO: 95); the sequence RMRIZFKNKGKDTAELRRRRVEVSVELRKAKKD-EQILKRRNV (SEQ ID NO: 96) of the IBB domain from importin-alpha; the sequences VSRKRPRP (SEQ ID NO: 97) and PPKKARED (SEQ ID NO: 98) of the myoma T protein; the sequence PQPKKKPL (SEQ ID NO: 99) of human p53; the sequence SALIKKKKKMAP (SEQ ID NO: 100) of mouse c-ab1 IV; the sequences DRLRR (SEQ ID NO: 101) and PKQKKRK (SEQ ID NO: 102) of the influenza virus NS1; the sequence RKLKKKIKKL (SEQ ID NO: 103) of the Hepatitis virus delta antigen; the sequence REKKKFLKRR (SEQ ID NO: 104) of the mouse Mxl protein; the sequence KRKGDEVDGVDEVAKKKSKK (SEQ ID NO: 105) of the human poly(ADP-ribose) polymerase; and the sequence RKCLQAGMNLEARKTKK (SEQ ID NO: 106) of the steroid hormone receptors (human) glucocorticoid. Other suitable NLS sequences are known in the art (e.g., Sorokin, Biochemistry (Moscow) (2007) 72:13, 1439-1457; Lange J Biol Chem. (2007) 282:8, 5101-5).

In some aspects, the Cas9 molecule may comprise one or more amino acid sequences that allow the Cas9 molecule to be specifically recognized, for example a tag. In one embodiment, the tag is a Histidine tag, e.g., a histidine tag comprising at least 3, 4, 5, 6, 7, 8, 9, 10 or more histidine amino acids (SEQ ID NO: 107). In embodiments, the histidine tag is a His6 tag (six histidines) (SEQ ID NO: 108). In other embodiments, the histidine tag is a His8 tag (eight histidines) (SEQ ID NO: 109). In embodiments, the histidine tag may be separated from one or more other portions of the Cas9 molecule by a linker. In embodiments, the linker is GGS or a repeat of two or more GGS sequences. An example of such a fusion is the Cas9 molecule iProt106520.

In some aspects, the Cas9 molecule may comprise one or more amino acid sequences that are recognized by a protease (e.g., comprise a protease cleavage site). In embodiments, the cleavage site is the tobacco etch virus (TEV) cleavage site, e.g., comprises the sequence ENLYFQG (SEQ ID NO: 110). In some aspects the protease cleavage site, e.g., the TEV cleavage site is disposed between a tag, e.g., a His tag, e.g., a His6 (SEQ ID NO: 108) or His8 tag (SEQ ID NO: 109), and the remainder of the Cas9 molecule. Without being bound by theory it is believed that such introduction will allow for the use of the tag for, e.g., purification of the Cas9 molecule, and then subsequent cleavage so the tag does not interfere with the Cas9 molecule function.

In embodiments, the Cas9 molecule (e.g., a Cas9 molecule as described herein) comprises an N-terminal NLS, and a C-terminal NLS (e.g., comprises, from N- to C-terminal NLS-Cas9-NLS), e.g., wherein each NLS is an SV40 NLS (PKKKRKV (SEQ ID NO: 91)). In embodiments, the Cas9 molecule (e.g., a Cas9 molecule as described herein) comprises an N-terminal NLS, a C-terminal NLS, and a C-terminal His6 tag (SEQ ID NO: 108) (e.g., comprises, from N- to C-terminal NLS-Cas9-NLS-His tag), e.g., wherein each NLS is an SV40 NLS (PKKKRKV (SEQ ID NO: 91)). In embodiments, the Cas9 molecule (e.g., a Cas9 molecule as described herein) comprises an N-terminal His tag (e.g., His6 tag (SEQ ID NO: 108)), an N-terminal NLS, and a C-terminal NLS (e.g., comprises, from N- to C-terminal His tag-NLS-Cas9-NLS), e.g., wherein each NLS is an SV40 NLS (PKKKRKV (SEQ ID NO: 91)). In embodiments, the Cas9 molecule (e.g., a Cas9 molecule as described herein) comprises an N-terminal NLS and a C-terminal His tag (e.g., His6 tag (SEQ ID NO: 108)) (e.g., comprises from N- to C-terminal His tag-Cas9-NLS), e.g., wherein the NLS is an SV40 NLS (PKKKRKV (SEQ ID NO: 91)). In embodiments, the Cas9 molecule (e.g., a Cas9 molecule as described herein) comprises an N-terminal His tag (e.g., His6 tag (SEQ ID NO: 108)) and a C-terminal NLS (e.g., comprises from N- to C-terminal NLS-Cas9-His tag), e.g., wherein the NLS is an SV40 NLS (PKKKRKV (SEQ ID NO: 91)). In embodiments, the Cas9 molecule (e.g., a Cas9 molecule as described herein) comprises an N-terminal His tag (e.g., His8 tag (SEQ ID NO: 109)), an N-terminal cleavage domain (e.g., a tobacco etch virus (TEV) cleavage domain (e.g., comprises the sequence ENLYFQG (SEQ ID NO: 110))), an N-terminal NLS (e.g., an SV40 NLS; SEQ ID NO: 91), and a C-terminal NLS (e.g., an SV40 NLS; SEQ ID NO: 91) (e.g., comprises from N- to C-terminal His tag-TEV-NLS-Cas9-NLS). In any of the aforementioned embodiments the Cas9 has the sequence of SEQ ID NO: 90. Alternatively, in any of the aforementioned embodiments, the Cas9 has a sequence of a Cas9 variant of SEQ ID NO: 90, e.g., as described herein. In any of the aforementioned embodiments, the Cas9 molecule comprises a linker between the His tag and another portion of the molecule, e.g., a GGS linker. Amino acid sequences of exemplary Cas9 molecules described above are provided below. In some embodiments, a Cas9 molecule comprises an amino sequence having at least about 60%, 65%, 70%, 75%, 80%, 85%, 90%, 95%, 96%, 97%, 98%, or 99% homology with; differs at no more than 1%, 2%, 5%, 10%, 15%, 20%, 30%, or 40% of the amino acid residues when compared with; differs by at least 1, 2, 5, 10 or 20 amino acids but by no more than 100, 80, 70, 60, 50, 40 or 30 amino acids from; or is identical to to a Cas9 sequence provided herein, e.g., SEQ ID NO: 90, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, or SEQ ID NO: 123. "iProt" identifiers match those in FIG. 1.

iProt105026 (also referred to as iProt106154, iProt106331, iProt106545, and PID426303, depending on the preparation of the protein)

```
(SEQ ID NO: 111):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKINRKVIVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR
```

```
LSDYDVDHIV PQSFLKDDSI DNKVLTRSDK NRGKSDNVPS EEVVKKMKNY WRQLLNAKLI

TQRKFDNLIK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH;

iProt106518 (SEQ ID NO: 112):
MAPKKKRKVD KKYSIGLDIG TNSVGWAVIT DEYKVPSKKF KVLGNTDRHS IKKNLIGALL

FDSGETAEAT RLKRTARRRY TRRKNRILYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKINRKVTVK QLKEDYFKKI EEFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLKDDSI DNKVLTRSDK NRGKSDNVPS EEVVKKMKNY WRQLLNAKLI

TQRKFDNLIK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iProt106519 (SEQ ID NO: 113):
MGSSHHHHHH HHENLYFQGS MDKKYSIGLD IGTNSVGWAV ITDEYKVPSK KFKVLGNTDR

HSIKKNLIGA LLFDSGETAE ATRLKRTARR RYTRRKNRIC YLQEIFSNEM AKVDDSFFHR

LEESFLVEED KKHERHPIFG NIVDEVAYHE KYPTIYHLRK KLVDSTDKAD LRLIYLALAH

MIKFRGHFLI EGDLNPDNSD VDKLFIQLVQ TYNQLFEENP INASGVDAKA ILSARLSKSR

RLENLIAQLP GEKKNGLFGN LIALSLGLTP NFKSNFDLAE DAKLQLSKDT YDDDLDNLLA

QIGDQYADLF LAAKNLSDAI LLSDILRVNT EITKAPLSAS MIKRYDEHHQ DLTLLKALVR
```

-continued

```
QQLPEKYKEI FFDQSKNGYA GYIDGGASQE EFYKFIKPIL EKMDGTEELL VKLNREDLLR
KQRTFDNGSI PHQIHLGELH AILRRQEDFY PFLKDNREKI EKILTFRIPY YVGPLARGNS
RFAWMTRKSE ETITPWNFEE VVDKGASAQS FIERMTNFDK NLPNEKVLPK HSLLYEYFTV
YNELTKVKYV TEGMRKPAFL SGEQKKAIVD LLFKINRKVT VKQLKEDYFK KIECFDSVEI
SGVEDRFNAS LGTYHDLLKI IKDKDFLDNE ENEDILEDIV LTLTLFEDRE MIEERLKTYA
HLFDDKVMKQ LKRRRYTGWG RLSRKLINGI RDKQSGKTIL DFLKSDGFAN RNFMQLIHDD
SLTFKEDIQK AQVSGQGDSL HEHIANLAGS PAIKKGILQT VKVVDELVKV MGRHKPENIV
IEMARENQTT QKGQKNSRER MKRIEEGIKE LGSQILKEHP VENTQLQNEK LYLYYLQNGR
DMYVDQELDI NRLSDYDVDH IVPQSFLKDD SIDNKVLTRS DKNRGKSDNV PSEEVVKKMK
NYWRQLLNAK LITQRKFDNL TKAERGGLSE LDKAGFIKRQ LVETRQITKH VAQILDSRMN
TKYDENDKLI REVKVITLKS KLVSDFRKDF QFYKVREINN YHHAHDAYLN AVVGTALIKK
YPKLESEFVY GDYKVYDVRK MIAKSEQEIG KATAKYFFYS NIMNFFKTEI TLANGEIRKR
PLIETNGETG EIVWDKGRDF ATVRKVLSMP QVNIVKKTEV QTGGFSKESI LPKRNSDKLI
ARKKDWDPKK YGGFDSPTVA YSVLVVAKVE KGKSKKLKSV KELLGITIME RSSFEKNPID
FLEAKGYKEV KKDLIIKLPK YSLFELENGR KRMLASAGEL QKGNELALPS KYVNFLYLAS
HYEKLKGSPE DNEQKQLFVE QHKHYLDEII EQISEFSKRV ILADANLDKV LSAYNKHRDK
PIREQAENII HLFTLTNLGA PAAFKYFDTT IDRKRYTSTK EVLDATLIHQ SITGLYETRI
DLSQLGGDGG GSPKKKRKV iProt106520 (SEQ ID NO: 114):
MAHHHHHHGG SPKKKRKVDK KYSIGLDIGT NSVGWAVITD EYKVPSKKFK VLGNTDRHSI
KKNLIGALLF DSGETAEATR LKRTARRRYT RRKNRICYLQ EIFSNEMAKV DDSFFHRLEE
SFLVEEDKKH ERHPIFGNIV DEVAYHEKYP TIYHLRKKLV DSTDKADLRL IYLALAHMIK
FRGHFLIEGD LNPDNSDVDK LFIQLVQTYN QLFEENPINA SGVDAKAILS ARLSKSRRLE
NLIAQLPGEK KNGLFGNLIA LSLGLTPNFK SNFDLAEDAK LQLSKDTYDD DLDNLLAQIG
DQYADLFLAA KNLSDAILLS DILRVNTEIT KAPLSASMIK RYDEHHQDLT LLKALVRQQL
PEKYKEIFFD QSKNGYAGYI DGGASQEEFY KFIKPILEKM DGTEELLVKL NREDLLRKQR
TFDNGSIPHQ IHLGELHAIL RRQEDFYPFL KDNREKIEKI LTFRIPYYVG PLARGNSRFA
WMTRKSEETI TPWNFEEVVD KGASAQSFIE RMTNFDKNLP NEKVLPKHSL LYEYFTVYNE
LTKVKYVTEG MRKPAFLSGE QKKAIVDLLF KINRKVIVKQ LKEDYFKKIE CFDSVEISGV
EDRFNASLGT YHDLLKIIKD KDFLDNEENE DILEDIVLTL TLFEDREMIE ERLKTYAHLF
DDKVMKQLKR RRYTGWGRLS RKLINGIRDK QSGKTILDFL KSDGFANRNF MQLIHDDSLT
FKEDIQKAQV SGQGDSLHEH IANLAGSPAI KKGILQTVKV VDELVKVMGR HKPENIVIEM
ARENQTTQKG QKNSRERMKR IEEGIKELGS QILKEHPVEN TQLQNEKLYL YYLQNGRDMY
VDQELDINRL SDYDVDHIVP QSFLKDDSID NKVLTRSDKN RGKSDNVPSE EVVKKMKNYW
RQLLNAKLIT QRKFDNLTKA ERGGLSELDK AGFIKRQLVE TRQITKHVAQ ILDSRMNTKY
DENDKLIREV KVITLKSKLV SDFRKDFQFY KVREINNYHH AHDAYLNAVV GTALIKKYPK
LESEFVYGDY KVYDVRKMIA KSEQEIGKAT AKYFFYSNIM NFFKTEITLA NGEIRKRPLI
ETNGETGEIV WDKGRDFATV RKVLSMPQVN IVKKTEVQTG GFSKESILPK RNSDKLIARK
KDWDPKKYGG FDSPTVAYSV LVVAKVEKGK SKKLKSVKEL LGITIMERSS FEKNPIDFLE
AKGYKEVKKD LIIKLPKYSL FELENGRKRM LASAGELQKG NELALPSKYV NFLYLASHYE
KLKGSPEDNE QKQLFVEQHK HYLDEIIEQI SEFSKRVILA DANLDKVLSA YNKHRDKPIR
```

EQAENIIHLF TLTNLGAPAA FKYFDTTIDR KRYTSTKEVL DATLIHQSIT GLYETRIDLS

QLGGDSRADP KKKRKV iProt106521 (SEQ ID NO: 115):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKINRKVIVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLKDDSI DNKVLTRSDK NRGKSDNVPS EEVVKKMKNY WRQLLNAKLI

TQRKFDNLIK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

HHHHHH iProt106522 (SEQ ID NO: 116):
MAHHHHHHGG SDKKYSIGLD IGTNSVGWAV ITDEYKVPSK KFKVLGNTDR HSIKKNLIGA

LLFDSGETAE ATRLKRTARR RYTRRKNRIC YLQEIFSNEM AKVDDSFFHR LEESFLVEED

KKHERHPIFG NIVDEVAYHE KYPTIYHLRK KLVDSTDKAD LRLIYLALAH MIKFRGHFLI

EGDLNPDNSD VDKLFIQLVQ TYNQLFEENP INASGVDAKA ILSARLSKSR RLENLIAQLP

GEKKNGLFGN LIALSLGLTP NFKSNFDLAE DAKLQLSKDT YDDDLDNLLA QIGDQYADLF

LAAKNLSDAI LLSDILRVNT EITKAPLSAS MIKRYDEHHQ DLTLLKALVR QQLPEKYKEI

FFDQSKNGYA GYIDGGASQE EFYKFIKPIL EKMDGTEELL VKLNREDLLR KQRTFDNGSI

PHQIHLGELH AILRRQEDFY PFLKDNREKI EKILTFRIPY YVGPLARGNS RFAWMTRKSE

ETITPWNFEE VVDKGASAQS FIERMTNFDK NLPNEKVLPK HSLLYEYFTV YNELTKVKYV

TEGMRKPAFL SGEQKKAIVD LLFKINRKVT VKQLKEDYFK KIECFDSVEI SGVEDRFNAS

LGTYHDLLKI IKDKDFLDNE ENEDILEDIV LTLTLFEDRE MIEERLKTYA HLFDDKVMKQ

LKRRRYTGWG RLSRKLINGI RDKQSGKTIL DFLKSDGFAN RNFMQLIHDD SLTFKEDIQK

AQVSGQGDSL HEHIANLAGS PAIKKGILQT VKVVDELVKV MGRHKPENIV IEMARENQTT

-continued

QKGQKNSRER MKRIEEGIKE LGSQILKEHP VENTQLQNEK LYLYYLQNGR DMYVDQELDI

NRLSDYDVDH IVPQSFLKDD SIDNKVLTRS DKNRGKSDNV PSEEVVKKMK NYWRQLLNAK

LITQRKFDNL TKAERGGLSE LDKAGFIKRQ LVETRQITKH VAQILDSRMN TKYDENDKLI

REVKVITLKS KLVSDFRKDF QFYKVREINN YHHAHDAYLN AVVGTALIKK YPKLESEFVY

GDYKVYDVRK MIAKSEQEIG KATAKYFFYS NIMNFFKTEI TLANGEIRKR PLIETNGETG

EIVWDKGRDF ATVRKVLSMP QVNIVKKTEV QTGGFSKESI LPKRNSDKLI ARKKDWDPKK

YGGFDSPTVA YSVLVVAKVE KGKSKKLKSV KELLGITIME RSSFEKNPID FLEAKGYKEV

KKDLIIKLPK YSLFELENGR KRMLASAGEL QKGNELALPS KYVNFLYLAS HYEKLKGSPE

DNEQKQLFVE QHKHYLDEII EQISEFSKRV ILADANLDKV LSAYNKHRDK PIREQAENII

HLFTLTNLGA PAAFKYFDTT IDRKRYTSTK EVLDATLIHQ SITGLYETRI DLSQLGGDSR

ADPKKKRKV iProt106658 (SEQ ID NO: 117):
MGSSHHHHHH HHENLYFQGS MDKKYSIGLD IGTNSVGWAV ITDEYKVPSK KFKVLGNTDR

HSIKKNLIGA LLFDSGETAE ATRLKRTARR RYTRRKNRIC YLQEIFSNEM AKVDDSFFHR

LEESFLVEED KKHERHPIFG NIVDEVAYHE KYPTIYHLRK KLVDSTDKAD LRLIYLALAH

MIKFRGHFLI EGDLNPDNSD VDKLFIQLVQ TYNQLFEENP INASGVDAKA ILSARLSKSR

RLENLIAQLP GEKKNGLFGN LIALSLGLTP NFKSNFDLAE DAKLQLSKDT YDDDLDNLLA

QIGDQYADLF LAAKNLSDAI LLSDILRVNT EITKAPLSAS MIKRYDEHHQ DLTLLKALVR

QQLPEKYKEI FFDQSKNGYA GYIDGGASQE EFYKFIKPIL EKMDGTEELL VKLNREDLLR

KQRTFDNGSI PHQIHLGELH AILRRQEDFY PFLKDNREKI EKILTFRIPY YVGPLARGNS

RFAWMTRKSE ETITPWNFEE VVDKGASAQS FIERMTNFDK NLPNEKVLPK HSLLYEYFTV

YNELTKVKYV TEGMRKPAFL SGEQKKAIVD LLFKINRKVT VKQLKEDYFK KIECFDSVEI

SGVEDRFNAS LGTYHDLLKI IKDKDFLDNE ENEDILEDIV LTLTLFEDRE MIEERLKTYA

HLFDDKVMKQ LKRRRYTGWG RLSRKLINGI RDKQSGKTIL DFLKSDGFAN RNFMQLIHDD

SLTFKEDIQK AQVSGQGDSL HEHIANLAGS PAIKKGILQT VKVVDELVKV MGRHKPENIV

IEMARENQTT QKGQKNSRER MKRIEEGIKE LGSQILKEHP VENTQLQNEK LYLYYLQNGR

DMYVDQELDI NRLSDYDVDH IVPQSFLKDD SIDNKVLTRS DKNRGKSDNV PSEEVVKKMK

NYWRQLLNAK LITQRKFDNL TKAERGGLSE LDKAGFIKRQ LVETRQITKH VAQILDSRMN

TKYDENDKLI REVKVITLKS KLVSDFRKDF QFYKVREINN YHHAHDAYLN AVVGTALIKK

YPKLESEFVY GDYKVYDVRK MIAKSEQEIG KATAKYFFYS NIMNFFKTEI TLANGEIRKR

PLIETNGETG EIVWDKGRDF ATVRKVLSMP QVNIVKKTEV QTGGFSKESI LPKRNSDKLI

ARKKDWDPKK YGGFDSPTVA YSVLVVAKVE KGKSKKLKSV KELLGITIME RSSFEKNPID

FLEAKGYKEV KKDLIIKLPK YSLFELENGR KRMLASAGEL QKGNELALPS KYVNFLYLAS

HYEKLKGSPE DNEQKQLFVE QHKHYLDEII EQISEFSKRV ILADANLDKV LSAYNKHRDK

PIREQAENII HLFTLTNLGA PAAFKYFDTT IDRKRYTSTK EVLDATLIHQ SITGLYETRI

DLSQLGGDGG GSPKKKRKV iProt106745 (SEQ ID NO: 118):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

-continued

```
AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKINRKVIVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLKDDSI DNAVLTRSDK NRGKSDNVPS EEVVKKMKNY WRQLLNAKLI

TQRKFDNLIK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iProt106746 (SEQ ID NO: 119):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKINRKVIVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEALY LYYLQNGRDM YVDQELDINR

LSDYDVDHIV PQSFLKDDSI DNKVLTRSDK NRGKSDNVPS EEVVKKMKNY WRQLLNAKLI

TQRKFDNLIK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP ALESEFVYGD

YKVYDVRKMI AKSEQEIGKA TAKYFFYSNI MNFFKTEITL ANGEIRKAPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN
```

```
EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iProt106747 (SEQ ID NO: 120):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKINRKVIVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLADDSI DNKVLTRSDK NRGKSDNVPS EEVVKKMKNY WRQLLNAKLI

TQRKFDNLIK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP ALESEFVYGD

YKVYDVRKMI AKSEQEIGKA TAKYFFYSNI MNFFKTEITL ANGEIRKAPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iProt106884 (SEQ ID NO: 121):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTAFDKNL PNEKVLPKHS LLYEYFTVYN ELTKVKYVTE

GMRKPAFLSG EQKKAIVDLL FKTNRKVTVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGAL SRKLINGIRD KQSGKTILDF LKSDGFANRN FMALIHDDSL TFKEDIQKAQ
```

```
-continued
VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLKDDSI DNKVLTRSDK NRGKSDNVPS EEVVKKMKNY WRQLLNAKLI

TQRKFDNLTK AERGGLSELD KAGFIKRQLV ETRAITKHVA QILDSRMNTK YDENDKLIRE

VKVITLKSKL VSDFRKDFQF YKVREINNYH HAHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iPROT 109496 (SEQ ID NO: 123):
MAPKKKRKVDKKYSIGLDIGTNSVGWAVITDEYKVPSKKFKVLGNTDRHSIKKNLIGALLFDS

GETAEATRLKRTARRRYTRRKNRILYLQEIFSNEMAKVDDSFFHRLEESFLVEEDKKHERHPI

FGNIVDEVAYHEKYPTIYHLRKKLVDSTDKADLRLIYLALAHMIKFRGHFLIEGDLNPDNSDV

DKLFIQLVQTYNQLFEENPINASGVDAKAILSARLSKSRRLENLIAQLPGEKKNGLFGNLIAL

SLGLTPNFKSNFDLAEDAKLQLSKDTYDDDLDNLLAQIGDQYADLFLAAKNLSDAILLSDILR

VNTEITKAPLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQEDFYPFL

KDNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRKV

TVKQLKEDYFKKIEEFDSVEISGVEDRFNASLGTYHDLLKIIKDKDFLDNEENEDILEDIVLT

LTLFEDREMIEERLKTYAHLFDDKVMKQLKRRRYTGWGRLSRKLINGIRDKQSGKTILDFLKS

DGFANRNFMQLIHDDSLTFKEDIQKAQVSGQGDSLHEHIANLAGSPAIKKGILQTVKVVDELV

KVMGRHKPENIVIEMARENQTTQKGQKNSRERMKRIEEGIKELGSQILKEHPVENTQLQNEKL

YLYYLQNGRDMYVDQELDINRLSDYDVDHIVPQSFLKDDSIDNKVLTRSDKNRGKSDNVPSEE

VVKKMKNYWRQLLNAKLITQRKFDNLTKAERGGLSELDKAGFIKRQLVETRQITKHVAQILDS

RMNTKYDENDKLIREVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEITLANGEIRKRPLI

ETNGETGEIVWDKGRDFATVRKVLSMPQVNIVKKTEVQTGGFSKESILPKRNSDKLIARKKDW

DPKKYGGFDSPTVAYSVLVVAKVEKGKSKKLKSVKELLGITIMERSSFEKNPIDFLEAKGYKE

VKKDLIIKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIHLFTL

TNLGAPAAFKYFDTTIDRKRYTSTKEVLDATLIHQSITGLYETRIDLSQLGGDSRADHHHHHH
```

Nucleic Acids Encoding Cas9 Molecules

Nucleic acids encoding the Cas9 molecules discussed above, e.g., an active Cas9 molecule or an inactive Cas9 molecule are provided herein.

Exemplary nucleic acids encoding Cas9 molecules are described in Cong et al, SCIENCE 2013, 399(6121):819-823; Wang et al, CELL 2013, 153(4):910-918; Mali et al., SCIENCE 2013, 399(6121):823-826; Jinek et al, SCIENCE 2012, 337(6096):816-821.

In an embodiment, a nucleic acid encoding a Cas9 molecule can be a synthetic nucleic acid sequence. For example, the synthetic nucleic acid molecule can be chemically modified, e.g., as described in Section XIII. In an embodiment, the Cas9 mRNA has one or more of, e.g., all of the following properties: it is capped, polyadenylated, substituted with 5-methylcytidine and/or pseudouridine.

In addition or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

Provided below is an exemplary codon optimized nucleic acid sequence encoding a Cas9 molecule of *S. pyogenes*.

(SEQ ID NO: 122)

```
atggataaaa agtacagcat cgggctggac atcggtacaa actcagtggg gtgggccgtg   60
attacggacg agtacaaggt accctccaaa aaatttaaag tgctgggtaa cacggacaga  120
cactctataa agaaaaatct tattggagcc ttgctgttcg actcaggcga gacagccgaa  180
gccacaaggt tgaagcggac cgccaggagg cggtatacca ggagaaagaa ccgcatatgc  240
tacctgcaag aaatcttcag taacgagatg gcaaaggttg acgatagctt tttccatcgc  300
ctggaagaat cctttcttgt tgaggaagac aagaagcacg aacggcaccc catctttggc  360
aatattgtcg acgaagtggc atatcacgaa aagtacccga ctatctacca cctcaggaag  420
aagctggtgg actctaccga taaggcggac ctcagactta tttatttggc actcgcccac  480
atgattaaat ttagaggaca tttcttgatc gagggcgacc tgaacccgga caacagtgac  540
gtcgataagc tgttcatcca acttgtgcag acctacaatc aactgttcga agaaaaccct  600
ataaatgctt caggagtcga cgctaaagca atcctgtccg cgcgcctctc aaaatctaga  660
agacttgaga atctgattgc tcagttgccc ggggaaaaga aaaatggatt gtttggcaac  720
ctgatcgccc tcagtctcgg actgacccca aatttcaaaa gtaacttcga cctggccgaa  780
gacgctaagc tccagctgtc caaggacaca tacgatgacg acctcgacaa tctgctggcc  840
cagattgggg atcagtacgc cgatctcttt ttggcagcaa agaacctgtc cgacgccatc  900
ctgttgagcg atatcttgag agtgaacacc gaaattacta agcacccct tagcgcatct  960
atgatcaagc ggtacgacga gcatcatcag gatctgaccc tgctgaaggc tcttgtgagg 1020
caacagctcc ccgaaaaata caaggaaatc ttctttgacc agagcaaaaa cggctacgct 1080
ggctatatag atggtgggc cagtcaggag gaattctata aattcatcaa gcccattctc 1140
gagaaaatgg acggcacaga ggagttgctg gtcaaactta caggggagga cctgctgcgg 1200
aagcagcgga cctttgacaa cgggtctatc ccccaccaga ttcatctggg cgaactgcac 1260
gcaatcctga ggaggcagga ggatttttat ccttttctta agataaccg cgagaaaata 1320
gaaagattc ttacattcag gatcccgtac tacgtgggac ctctcgcccg gggcaattca 1380
cggtttgcct ggatgacaag gaagtcagag gagactatta ccccttggaa cttcgaagaa 1440
gtggtggaca agggtgcatc tgcccagtct ttcatcgagc ggatgacaaa ttttgacaag 1500
aacctcccta tgagaaggt gctgcccaaa cattctctgc tctacgagta ctttaccgtc 1560
tacaatgaac tgactaaagt caagtacgtc accgagggaa tgaggaagcc ggcattcctt 1620
agtggagaac agaagaaggc gattgtagac ctgttgttca gaccaacag gaaggtgact 1680
gtgaagcaac ttaaagaaga ctactttaag aagatcgaat gttttgacag tgtggaaatt 1740
tcaggggttg aagaccgctt caatgcgtca ttggggactt accatgatct tctcaagatc 1800
ataaaggaca aagacttcct ggacaacgaa gaaaatgagg atattctcga agacatcgtc 1860
ctcaccctga ccctgttcga agacagggaa atgatagaag agcgcttgaa aacctatgcc 1920
cacctcttcg acgataaagt tatgaagcag ctgaagcgca ggagatacac aggatgggga 1980
agattgtcaa ggaagctgat caatggaatt agggataaac agagtggcaa gaccatactg 2040
gatttcctca aatctgatgg cttcgccaat aggaacttca tgcaactgat tcacgatgac 2100
tctcttacct tcaaggagga cattcaaaag gctcaggtga gcgggcaggg agactccctt 2160
```

```
-continued
catgaacaca tcgcgaattt ggcaggttcc cccgctatta aaaagggcat ccttcaaact  2220
gtcaaggtgg tggatgaatt ggtcaaggta atgggcagac ataagccaga aaatattgtg  2280
atcgagatgg cccgcgaaaa ccagaccaca cagaagggcc agaaaaatag tagagagcgg  2340
atgaagagga tcgaggaggg catcaaagag ctgggatctc agattctcaa agaacacccc  2400
gtagaaaaca cacagctgca gaacgaaaaa ttgtacttgt actatctgca gaacggcaga  2460
gacatgtacg tcgaccaaga acttgatatt aatagactgt ccgactatga cgtagaccat  2520
atcgtgcccc agtccttcct gaaggacgac tccattgata acaaagtctt gacaagaagc  2580
gacaagaaca ggggtaaaag tgataatgtg cctagcgagg aggtggtgaa aaaaatgaag  2640
aactactggc gacagctgct taatgcaaag ctcattacac aacggaagtt cgataatctg  2700
acgaaagcag agagaggtgg cttgtctgag ttggacaagg cagggtttat taagcggcag  2760
ctggtggaaa ctaggcagat cacaaagcac gtggcgcaga ttttggacag ccggatgaac  2820
acaaaatacg acgaaaatga taaactgata cgagaggtca aagttatcac gctgaaaagc  2880
aagctggtgt ccgattttcg gaaagacttc cagttctaca aagttcgcga gattaataac  2940
taccatcatg ctcacgatgc gtacctgaac gctgttgtcg ggaccgcctt gataaagaag  3000
tacccaaagc tggaatccga gttcgtatac ggggattaca aagtgtacga tgtgaggaaa  3060
atgatagcca agtccgagca ggagattgga aaggccacag ctaagtactt cttttattct  3120
aacatcatga ttttttttaa gacgaaaatt accctggcca acggagagat cagaaagcgg  3180
ccccttatag agacaaatgg tgaaacaggt gaaatcgtct gggataaggg cagggatttc  3240
gctactgtga ggaaggtgct gagtatgcca caggtaaata tcgtgaaaaa aaccgaagta  3300
cagaccggag gattttccaa ggaaagcatt ttgcctaaaa gaaactcaga caagctcatc  3360
gcccgcaaga aagattggga ccctaagaaa tacgggggat ttgactcacc caccgtagcc  3420
tattctgtgc tggtggtagc taaggtggaa aaaggaaagt ctaagaagct gaagtccgtg  3480
aaggaactct tgggaatcac tatcatggaa agatcatcct ttgaaaagaa ccctatcgat  3540
ttcctggagg ctaagggtta caaggaggtc aagaaagacc tcatcattaa actgccaaaa  3600
tactctctct tcgagctgga aaatggcagg aagagaatgt tggccagcgc cggagagctg  3660
caaaagggaa acgagcttgc tctgccctcc aaatatgtta attttctcta tctcgcttcc  3720
cactatgaaa agctgaaagg gtctcccgaa gataacgagc agaagcagct gttcgtcgaa  3780
cagcacaagc actatctgga tgaaataatc gaacaaataa gcgagttcag caaaagggtt  3840
atcctggcgg atgctaattt ggacaaagta ctgtctgctt ataacaagca ccgggataag  3900
cctattaggg aacaagccga gaatataatt caccttcttta cactcacgaa tctcggagcc  3960
cccgccgcct tcaaatactt tgatacgact atcgaccgga aacggtatac cagtaccaaa  4020
gaggtcctcg atgccaccct catccaccag tcaattactg gcctgtacga aacacggatc  4080
gacctctctc aactgggcgg cgactag                                       4107
```

If a Cas9 sequence, e.g., the sequence listed above, is fused with a peptide or polypeptide at the C-terminus (e.g., an inactive Cas9 fused with a transcription repressor at the C-terminus), it is understood that the stop codon will be removed.

V. Chimeric Antigen Receptors

Disclosed herein are chimeric antigen receptor (CAR) immune effector cells, e.g., T cells, or chimeric TCR-transduced immune effector cells, e.g., T cells. In particular, disclosed herein are improved CAR immune effector cells modified in a tet gene intron or intron-exon junction, for example at a TET2 intron or intron-exon junction, for example, at the intron between exons 9 and 10 of TET2. In some embodiments, disclosed herein are CAR immune effector cells that have been modified to exhibit partial (but not full) inhibition of the function and/or expression of TET2 to enhance immune effector cell function. In some embodiments, disclosed herein are CAR immune effector cells that have been modified to exhibit full inhibition of the function and/or expression of TET2 to enhance immune effector cell function. In some embodiments, the CAR immune effector cells are modified in a tet gene intron or intron-exon junction, for example at a TET2 intron or intron-exon junction, to specifically disrupt TET2 function and/or insert a heterologous protein specifically at that position. In some embodiments, the disclosure provides for gRNA molecules and CRISPR systems for use in connection with these adoptive immunotherapy methods and reagents to produce CAR immune effector cells, e.g., T cells, or chimeric TCR-transduced immune effector cells, e.g., T cells. The gRNA molecules and CRISPR systems of the disclosure can be used to create adoptive immunotherapy cells and compositions with improved properties, such as efficacy and safety. This section describes, in some embodiments, CAR technology in conjunction with the gRNA molecules and CRISPR systems of the disclosure, and describes improved CAR reagents, e.g., cells and compositions, and methods. Other methods for inserting chimeric antigen receptors into immune effector cells can also be employed, including those described herein or otherwise known to the skilled artisan.

In general, aspects of the disclosure pertain to or include an isolated nucleic acid molecule encoding a chimeric antigen receptor (CAR), wherein the CAR comprises an antigen binding domain (e.g., antibody or antibody fragment, TCR or TCR fragment) that binds to a tumor antigen as described herein, a transmembrane domain (e.g., a transmembrane domain described herein), and an intracellular signaling domain (e.g., an intracellular signaling domain described herein). In various embodiments, the intracellular signaling domain comprises a costimulatory domain (e.g., a costimulatory domain described herein) and/or a primary signaling domain (e.g., a primary signaling domain described herein).

In other aspects, the disclosure includes: host cells containing the above nucleic acids and isolated proteins encoded by such nucleic acid molecules. CAR nucleic acid constructs, encoded proteins, vectors containing the CAR nucleic acid constructs, host cells, pharmaceutical compositions, and methods of administration and treatment are also disclosed herein. Further details on their preparation and use are provided in International Patent Application Publication No. WO2015142675, which is incorporated by reference in its entirety.

In one aspect, the disclosure pertains to a chimeric antigen receptor (CAR) and/or an isolated nucleic acid molecule encoding the CAR, wherein the CAR comprises an antigen binding domain (e.g., antibody or antibody fragment, TCR or TCR fragment) that binds to a tumor-supporting antigen (e.g., a tumor-supporting antigen as described herein), a transmembrane domain (e.g., a transmembrane domain described herein), and an intracellular signaling domain (e.g., an intracellular signaling domain described herein). In some embodiments, the intracellular signaling domain comprises a costimulatory domain (e.g., an intracellular signaling domain comprising a costimulatory domain (e.g., a costimulatory domain described herein) and/or a primary signaling domain (e.g., a primary signaling domain described herein). In some embodiments, the tumor-supporting antigen is an antigen present on a stromal cell or a myeloid-derived suppressor cell (MDSC). In other aspects, the disclosure features polypeptides encoded by such nucleic acids and host cells containing such nucleic acids and/or polypeptides.

Alternatively, aspects of the disclosure pertain to isolated nucleic acid encoding a chimeric T cell receptor (TCR) comprising a TCR alpha and/or TCR beta variable domain with specificity for a cancer antigen described herein. See for example, Dembic et al., Nature, 320, 232-238 (1986), Schumacher, Nat. Rev. Immunol., 2, 512-519 (2002), Kershaw et al., Nat. Rev. Immnol., 5, 928-940 (2005), Xue et al., Clin. KvEp. Immunol, 139, 167-172 (2005), Rossig et al., Mol. Ther., 10, 5-18 (2004), and Murphy et al., Immunity, 22, 403-414 (2005); (Morgan et al., J. Immunol., 171, 3287-3295 (2003), Hughes et al., Hum. Gene Ther., 16, 1-16 (2005), Zhao et al., J. Immunol., 174, 4415-4423 (2005). Roszkowski et al, Cancer Res., 65, 1570-1576 (2005), and Engels et al., Hun. Gene Ther., 16, 799-810 (2005); US2009/03046557, the contents of which are hereby incorporated by reference in their entirety. Such chimeric TCRs may recognize, for example, cancer antigens such as MART-1, gp-100, p53, and NY-ESO-1, MAGE A3/A6, MAGEA3, SSX2, HPV-16 E6 or HPV-16 E7. In other aspects, the disclosure features polypeptides encoded by such nucleic acids and host cells containing such nucleic acids and/or polypeptides.

Targets

The present disclosure provides cells, e.g., immune effector cells (e.g., T cells, NK cells), that comprise or at any time comprised a gRNA molecule or CRISPR system as described herein, that are further engineered to contain one or more CARs that direct the immune effector cells to undesired cells (e.g., cancer cells). This is achieved through an antigen binding domain on the CAR that is specific for a cancer associated antigen. There are two classes of cancer associated antigens (tumor antigens) that can be targeted by the CARs of the instant disclosure: (1) a cancer associated antigens that is expressed on the surface of a cancer cell; and (2) a cancer-associated antigen that itself is intracellular, however, a fragment of such antigen (peptide) is presented on the surface of the cancer cells by MHC (major histocompatibility complex).

In some embodiments, the tumor antigen is chosen from one or more of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bDGalp(1-4)bDGlcp(1-1) Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES 1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

A CAR described herein can comprise an antigen binding domain (e.g., antibody or antibody fragment, TCR or TCR fragment) that binds to a tumor-supporting antigen (e.g., a tumor-supporting antigen as described herein). In some embodiments, the tumor-supporting antigen is an antigen present on a stromal cell or a myeloid-derived suppressor cell (MDSC). Stromal cells can secrete growth factors to promote cell division in the microenvironment. MDSC cells can inhibit T cell proliferation and activation. Without wishing to be bound by theory, in some embodiments, the CAR-expressing cells destroy the tumor-supporting cells, thereby indirectly inhibiting tumor growth or survival.

In embodiments, the stromal cell antigen is chosen from one or more of: bone marrow stromal cell antigen 2 (BST2), fibroblast activation protein (FAP) and tenascin. In an embodiment, the FAP-specific antibody is, competes for binding with, or has the same CDRs as, sibrotuzumab. In embodiments, the MDSC antigen is chosen from one or more of: CD33, CD1 b, C14, CD15, and CD66b. Accordingly, in some embodiments, the tumor-supporting antigen is chosen from one or more of: bone marrow stromal cell antigen 2 (BST2), fibroblast activation protein (FAP) or tenascin, CD33, CD1 b, C14, CD15, and CD66b.

In some embodiments, more than one CAR gene is inserted into an intron (or intron-exon junction) of the TET2 gene, e.g., sequence encoding a first CAR and sequence encoding a second CAR is inserted into an intron (or intron-exon junction) of the TET2 gene. In embodiments, the sequence encoding the first CAR and the sequence encoding the second CAR are separated by sequence of a 2A site, as described herein. In embodiments, the first CAR is a CD19 CAR and the second CAR is a CD20 CAR or CD22 CAR.

In some embodiments, a CAR gene inserted into an intron of the TET2 gene encodes a CAR comprising two or more antigen binding domains, e.g., two or more antigen binding domains targeting different antigens. Examples of CARs comprising two or more antigen binding domains are described, for example, in WO2016/164731, incorporated herein by reference in its entirety. In embodiments, the first antigen binding domain binds CD19 and the second antigen binding domain binds CD20 or CD22.

In some embodiments, a CAR gene inserted into an intron of the TET2 gene encodes a regulatable CAR gene system. Examplary regulatable CAR systems are described in, for example, WO2017/181119, incorporated herein by reference in its entirety.

In some embodiments, a CAR gene inserted into an intron of the TET2 gene is a CD19 CAR gene. In some embodiments, a CAR gene inserted into an intron of the TET2 gene is a BCMA CAR gene. In some embodiments, a CAR gene inserted into an intron of the TET2 gene is a CD22 CAR gene.

In some embodiments, a CAR gene inserted into an intron between exons 9 and 10 of the TET2 gene is a CD19 CAR gene. In some embodiments, a CAR gene inserted into an intron between exons 9 and 10 of the TET2 gene is a BCMA CAR gene. In some embodiments, a CAR gene inserted into an intron between exons 9 and 10 of the TET2 gene is a CD22 CAR gene.

Antigen-Binding Domain Structures

In some embodiments, the antigen binding domain of the encoded CAR molecule comprises an antibody, an antibody fragment, an scFv, a Fv, a Fab, a (Fab')2, a single domain antibody (SDAB), a VH and/or VL domain, a camelid VHH domain, a bi-functional (e.g. bi-specific), or multispecific hybrid antibody (e.g., Lanzavecchia et al., Eur. J. Immunol. 17, 105 (1987)).

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules can comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as (Gly4Ser)n, where n is a positive integer equal to or greater than 1 (SEQ ID NO: 26). In one embodiment, the linker can be (Gly$_4$Ser)$_4$ (SEQ ID NO:34) or (Gly$_4$Ser)$_3$ (SEQ ID NO:35). Variation in the linker length may retain or enhance activity, giving rise to superior efficacy in activity studies.

In another aspect, the antigen binding domain is a T cell receptor ("TCR"), or a fragment thereof, for example, a single chain TCR (scTCR). Methods to make such TCRs are known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contains the Vα and Vβ genes from a T cell clone linked by a linker (e.g., a flexible peptide). This approach is very useful to cancer associated target that itself is intracellular, however, a fragment of such antigen (peptide) is presented on the surface of the cancer cells by MHC.

In certain embodiments, the encoded antigen binding domain has a binding affinity KD of $10^{-4}$ M to $10^{-8}$ M.

In one embodiment, the encoded CAR molecule comprises an antigen binding domain that has a binding affinity KD of $10^{-4}$ M to $10^{-8}$ M, e.g., $10^{-5}$ M to $10^{-7}$ M, e.g., $10^{-6}$ M or $10^{-7}$ M, for the target antigen. In one embodiment, the antigen binding domain has a binding affinity that is at least five-fold, 10-fold, 20-fold, 30-fold, 50-fold, 100-fold or 1,000-fold less than a reference antibody, e.g., an antibody described herein. In one embodiment, the encoded antigen binding domain has a binding affinity at least 5-fold less than a reference antibody (e.g., an antibody from which the antigen binding domain is derived). In one aspect such antibody fragments are functional in that they provide a biological response that can include, but is not limited to, activation of an immune response, inhibition of signal-transduction origination from its target antigen, inhibition of kinase activity, and the like, as will be understood by a skilled artisan.

In one aspect, the antigen binding domain of the CAR is a scFv antibody fragment that is humanized compared to the murine sequence of the scFv from which it is derived.

In one aspect, the antigen binding domain of a CAR of the disclosure (e.g., a scFv) is encoded by a nucleic acid molecule whose sequence has been codon optimized for expression in a mammalian cell. In one aspect, entire CAR construct of the disclosure is encoded by a nucleic acid molecule whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

Antigen-Binding Domains (and the Targeted Antigens)

In one embodiment, an antigen binding domain against CD19 is an antigen binding portion, e.g., CDRs, of a CAR, antibody or antigen-binding fragment thereof described in, e.g., PCT publication WO2012/079000; PCT publication WO2014/153270; Kochenderfer, J. N. et al., J. Immunother. 32 (7), 689-702 (2009); Kochenderfer, J. N., et al., Blood, 116 (20), 4099-4102 (2010); PCT publication WO2014/031687; Bejcek, Cancer Research, 55, 2346-2351, 1995; or U.S. Pat. No. 7,446,190.

In one embodiment, an antigen binding domain against mesothelin is an antigen binding portion, e.g., CDRs, of an antibody, antigen-binding fragment or CAR described in, e.g., PCT publication WO2015/090230. In one embodiment, an antigen binding domain against mesothelin is an antigen binding portion, e.g., CDRs, of an antibody, antigen-binding fragment, or CAR described in, e.g., PCT publication WO1997/025068, WO1999/028471, WO2005/014652, WO2006/099141, WO2009/045957, WO2009/068204, WO2013/142034, WO2013/040557, or WO2013/063419. In one embodiment, an antigen binding domain against mesothelin is an antigen binding portion, e.g., CDRs, of an antibody, antigen-binding fragment, or CAR described in WO/2015/090230.

In one embodiment, an antigen binding domain against CD123 is an antigen binding portion, e.g., CDRs, of an antibody, antigen-binding fragment or CAR described in, e.g., PCT publication WO2014/130635. In one embodiment, an antigen binding domain against CD123 is an antigen binding portion, e.g., CDRs, of an antibody, antigen-binding fragment, or CAR described in, e.g., PCT publication WO2014/138805, WO2014/138819, WO2013/173820, WO2014/144622, WO2001/66139, WO2010/126066, WO2014/144622, or US2009/0252742. In one embodiment, an antigen binding domain against CD123 is an antigen binding portion, e.g., CDRs, of an antibody, antigen-binding fragment, or CAR described in WO/2016/028896.

Examples include CAR molecules which include an antigen binding domain, or a VL and VH (in the sequences below, separated by a (G4S)3 linker (SEQ ID NO: 35)) of:

CD123-1:
(SEQ ID NO: 150)
QVQLVQSGAEVKKPGASVKVSCKASGYTFTGYYMHWVRQAPGQGLEWMGWI

NPNSGGTNYAQKFQGRVTMTRDTSISTAYMELSRLRSDDTAVYYCARDMNI

LATVPFDIWGQGTMVTVSSGGGGSGGGGSGGGGSDIQMTQSPSSLSASVGD

RVTITCRASQSISTYLNWYQQKPGKAPNLLIYAAFSLQSGVPSRFSGSGSG

TDFTLTINSLQPEDFATYYCQQGDSVPLTFGGGTKLEIK;

CD123-2:
(SEQ ID NO: 151)
QVQLVQSGAEVKKPGASVKVSCKASGYTFTGYYMHWVRQAPGQGLEWMGWI
NPNSGGTNYAQKFQGRVTLTRDTSISTVYMELSRLRSDDTAVYYCARDMNI
LATVPFDIWGQGTMVTVSSGGGGSGGGGSGGGGSDIQMTQSPSSLSASVGD
RVTITCRASQSISSYLNWYQQKPGKAPKLLIYAASSLQSGVPSRFSGSGSG
TDFTLTVNSLQPEDFATYYCQQGDSVPLTFGGGTRLEIK;

CD123-3:
(SEQ ID NO: 153)
QVQLVQSGAEVKKPGASVKVSCKASGYIFTGYYIHWVRQAPGQGLEWMGWI
NPNSGGTNYAQKFQGRVTMTRDTSISTAYMELSGLRSDDPAVYYCARDMNI
LATVPFDIWGQGTLVTVSSGGGGSGGGGSGGGGSDIQLTQSPSSLSASVGD
RVTITCRASQSISSYLNWYQQKPGKAPKLLIYAASSLQSGVPSRFSGSGSG
TDFTLTVNSLQPEDFATYYCQQGDSVPLTFGGGTKVEIK;
OR

CD123-4:
(SEQ ID NO: 154)
QVQLQQSGAEVKKSGASVKVSCKASGYTFTDYYMEIWLRQAPGQGLEWMGW
INPNSGDTNYAQKFQGRVTLTRDTSISTVYMELSRLRSDDTAVYYCARDMN
ILATVPFDIWGQGTMVTVSSASGGGGSGGRASGGGGSDIQMTQSPSSLSAS
VGDRVTITCRASQSISSYLNWYQQKPGKAPKLLIYAASSLQSGVPSRFSGS
GSGTDFTLTISSLQPEDFATYYCQQGDSVPLTFGGGTKVEIK,
from WO2016/0028896.

The CAR comprising said anti-CD123 binding domain may comprise, for example, the amino acid sequence of:

CAR123-2:
(SEQ ID NO: 155)
MALPVTALLLPLALLLHAARPQVQLVQSGAEVKKPGASVKVSCKASGYTFT
GYYMHWVRQAPGQGLEWMGWINPNSGGTNYAQKFQGRVTLTRDTSISTVYM
ELSRLRSDDTAVYYCARDMNILATVPFDIWGQGTMVTVSSGGGGSGGGGSG
GGGSDIQMTQSPSSLSASVGDRVTITCRASQSISSYLNWYQQKPGKAPKLL
IYAASSLQSGVPSRFSGSGSGTDFTLTVNSLQPEDFATYYCQQGDSVPLTF
GGGTRLEIKTTTPAPRPPTPAPTIASQPLSLRPEACRPAAGGAVHTRGLDF
ACDIYIWAPLAGTCGVLLLSLVITLYCKRGRKKLLYIFKQPFMRPVQTTQE
EDGCSCRFPEEEEGGCELRVKFSRSADAPAYKQGQNQLYNELNLGRREEYD
VLDKRRGRDPEMGGKPRRKNPQEGLYNELQKDKMAEAYSEIGMKGERRRGK
GHDGLYQGLSTATKDTYDALHMQALPPR;

CAR123-3:
(SEQ ID NO: 156)
MALPVTALLLPLALLLHAARPQVQLVQSGAEVKKPGASVKVSCKASGYIFT
GYYIHWVRQAPGQGLEWMGWINPNSGGTNYAQKFQGRVTMTRDTSISTAYM
ELSGLRSDDPAVYYCARDMNILATVPFDIWGQGTLVTVSSGGGGSGGGGSG
GGGSDIQLTQSPSSLSASVGDRVTITCRASQSISSYLNWYQQKPGKAPKLL
IYAASSLQSGVPSRFSGSGSGTDFTLTVNSLQPEDFATYYCQQGDSVPLTF
GGGTKVEIKTTTPAPRPPTPAPTIASQPLSLRPEACRPAAGGAVHTRGLDF
ACDIYIWAPLAGTCGVLLLSLVITLYCKRGRKKLLYIFKQPFMRPVQTTQE
EDGCSCRFPEEEEGGCELRVKFSRSADAPAYKQGQNQLYNELNLGRREEYD
VLDKRRGRDPEMGGKPRRKNPQEGLYNELQKDKMAEAYSEIGMKGERRRGK
GHDGLYQGLSTATKDTYDALHMQALPPR;

CAR123-4:
(SEQ ID NO: 157)
MALPVTALLLPLALLLHAARPQVQLQQSGAEVKKSGASVKVSCKASGYTFT
DYYMHWLRQAPGQGLEWMGWINPNSGDTNYAQKFQGRVTLTRDTSISTVYM
ELSRLRSDDTAVYYCARDMNILATVPFDIWGQGTMVTVSSASGGGGSGGRA
SGGGGSDIQMTQSPSSLSASVGDRVTITCRASQSISSYLNWYQQKPGKAPK
LLIYAASSLQSGVPSRFSGSGSGTDFTLTISSLQPEDFATYYCQQGDSVPL
TFGGGTKVEIKTTTPAPRPPTPAPTIASQPLSLRPEACRPAAGGAVHTRGL
DFACDIYIWAPLAGTCGVLLLSLVITLYCK;
OR

CAR123-1:
(SEQ ID NO: 158)
MALPVTALLLPLALLLHAARPQVQLVQSGAEVKKPGASVKVSCKASGYTFT
GYYMHWVRQAPGQGLEWMGWINPNSGGTNYAQKFQGRVTMTRDTSISTAYM
ELSRLRSDDTAVYYCARDMNILATVPFDIWGQGTMVTVSSGGGGSGGGGSG
GGGSDIQMTQSPSSLSASVGDRVTITCRASQSISTYLNWYQQKPGKAPNLL
IYAAFSLQSGVPSRFSGSGSGTDFTLTINSLQPEDFATYYCQQGDSVPLTF
GGGTKLEIKTTTPAPRPPTPAPTIASQPLSLRPEACRPAAGGAVHTRGLDF
ACDIYIWAPLAGTCGVLLLSLVITLYCKRGRKKLLYIFKQPFMRPVQTTQE
EDGCSCRFPEEEEGGCELRVKFSRSADAPAYKQGQNQLYNELNLGRREEYD
VLDKRRGRDPEMGGKPRRKNPQEGLYNELQKDKMAEAYSEIGMKGERRRGK
GHDGLYQGLSTATKDTYDALHMQALPPR.

In each case, the CAR may optionally comprise or not comprise the leader sequence included in each of the above sequences (MALPVTALLLPLALLLHAARP; SEQ ID NO: 2).

In one embodiment, an antigen binding domain against EGFRvIII is an antigen binding portion, e.g., CDRs, of an antibody, antigen-binding fragment or CAR described in, e.g., WO/2014/130657.

In one embodiment, an antigen binding domain against CD22 is an antigen binding portion, e.g., CDRs, of an antibody described in, e.g., Haso et al., Blood, 121(7): 1165-1174 (2013); Wayne et al., Clin Cancer Res 16(6): 1894-1903 (2010); Kato et al., Leuk Res 37(1):83-88 (2013); Creative BioMart (creativebiomart.net): MOM-18047-S(P).

In one embodiment, an antigen binding domain against CS-1 is an antigen binding portion, e.g., CDRs, of Elotuzumab (BMS), see e.g., Tai et al., 2008, Blood 112(4): 1329-37; Tai et al., 2007, Blood. 110(5): 1656-63.

In one embodiment, an antigen binding domain against CLL-1 is an antigen binding portion, e.g., CDRs, of an antibody available from R&D, ebiosciences, Abcam, for example, PE-CLL1-hu Cat #353604 (BioLegend); and PE-CLL1 (CLEC12A) Cat #562566 (BD). In one embodiment, an antigen binding domain against CLL-1 is an antigen binding portion, e.g., CDRs, of an antibody, antigen-binding fragment, or CAR described in WO/2016/014535.

In one embodiment, an antigen binding domain against CD33 is an antigen binding portion, e.g., CDRs, of an antibody described in, e.g., Bross et al., Clin Cancer Res 7(6): 1490-1496 (2001) (Gemtuzumab Ozogamicin, hP67.6), Caron et al., Cancer Res 52(24):6761-6767 (1992) (Lintuzumab, HuM195), Lapusan et al., Invest New Drugs 30(3):1121-1131 (2012) (AVE9633), Aigner et al., Leukemia 27(5): 1107-1115 (2013) (AMG330, CD33 BiTE), Dutour et al., Adv hematol 2012:683065 (2012), and Pizzitola et al., Leukemia doi:10.1038/Lue.2014.62 (2014). In one embodiment, an antigen binding domain against CD33 is an antigen binding portion, e.g., CDRs, of an antibody, antigen-binding fragment, or CAR described in WO/2016/014576.

In one embodiment, an antigen binding domain against GD2 is an antigen binding portion, e.g., CDRs, of an antibody described in, e.g., Mujoo et al., Cancer Res. 47(4):1098-1104 (1987); Cheung et al., Cancer Res 45(6): 2642-2649 (1985), Cheung et al., J Clin Oncol 5(9):1430-1440 (1987), Cheung et al., J Clin Oncol 16(9):3053-3060 (1998), Handgretinger et al., Cancer Immunol Immunother 35(3): 199-204 (1992). In some embodiments, an antigen binding domain against GD2 is an antigen binding portion of an antibody selected from mAb 14.18, 14G2a, ch14.18, hu14.18, 3F8, hu3F8, 3G6, 8B6, 60C3, 10B8, ME36.1, and 8H9, see e.g., WO2012033885, WO2013040371, WO2013192294, WO2013061273, WO2013123061, WO2013074916, and WO201385552. In some embodiments, an antigen binding domain against GD2 is an antigen binding portion of an antibody described in US Publication No.: 20100150910 or PCT Publication No.: WO 2011160119.

In one embodiment, an antigen binding domain against BCMA is an antigen binding portion, e.g., CDRs, of an antibody described in, e.g., WO2012163805, WO200112812, and WO2003062401. In one embodiment, an antigen binding domain against BCMA is an antigen binding portion, e.g., CDRs, of an antibody, antigen-binding fragment, or CAR described in WO/2016/014565.

In one embodiment, an antigen binding domain against Tn antigen is an antigen binding portion, e.g., CDRs, of an antibody described in, e.g., U.S. Pat. No. 8,440,798, Brooks et al., PNAS 107(22):10056-10061 (2010), and Stone et al., OncoImmunology 1(6):863-873(2012).

In one embodiment, an antigen binding domain against PSMA is an antigen binding portion, e.g., CDRs, of an antibody described in, e.g., Parker et al., Protein Expr Purif 89(2):136-145 (2013), US 20110268656 (J591 ScFv); Frigerio et al, European J Cancer 49(9):2223-2232 (2013) (scFvD2B); WO 2006125481 (mAbs 3/A12, 3/E7 and 3/F11) and single chain antibody fragments (scFv A5 and D7).

In one embodiment, an antigen binding domain against ROR1 is an antigen binding portion, e.g., CDRs, of an antibody described in, e.g., Hudecek et al., Clin Cancer Res 19(12):3153-3164 (2013); WO 2011159847; and US20130101607.

In one embodiment, an antigen binding domain against FLT3 is an antigen binding portion, e.g., CDRs, of an antibody described in, e.g., WO2011076922, U.S. Pat. No. 5,777,084, EP0754230, US20090297529, and several commercial catalog antibodies (R&D, ebiosciences, Abcam).

In one embodiment, an antigen binding domain against TAG72 is an antigen binding portion, e.g., CDRs, of an antibody described in, e.g., Hombach et al., Gastroenterology 113(4):1163-1170 (1997); and Abcam ab691.

In one embodiment, an antigen binding domain against FAP is an antigen binding portion, e.g., CDRs, of an antibody described in, e.g., Ostermann et al., Clinical Cancer Research 14:4584-4592 (2008) (FAPS), US Pat. Publication No. 2009/0304718; sibrotuzumab (see e.g., Hofheinz et al., Oncology Research and Treatment 26(1), 2003); and Tran et al., J Exp Med 210(6):1125-1135 (2013).

In one embodiment, an antigen binding domain against CD38 is an antigen binding portion, e.g., CDRs, of daratumumab (see, e.g., Groen et al., Blood 116(21):1261-1262 (2010); MOR202 (see, e.g., U.S. Pat. No. 8,263,746); or antibodies described in U.S. Pat. No. 8,362,211.

In one embodiment, an antigen binding domain against CD44v6 is an antigen binding portion, e.g., CDRs, of an antibody described in, e.g., Casucci et al., Blood 122(20): 3461-3472 (2013).

In one embodiment, an antigen binding domain against CEA is an antigen binding portion, e.g., CDRs, of an antibody described in, e.g., Chmielewski et al., Gastoenterology 143(4):1095-1107 (2012).

In one embodiment, an antigen binding domain against EPCAM is an antigen binding portion, e.g., CDRS, of an antibody selected from MT110, EpCAM-CD3 bispecific Ab (see, e.g., clinicaltrials.gov/ct2/show/NCT00635596); Edrecolomab; 3622W94; ING-1; and adecatumumab (MT201).

In one embodiment, an antigen binding domain against PRSS21 is an antigen binding portion, e.g., CDRs, of an antibody described in U.S. Pat. No. 8,080,650.

In one embodiment, an antigen binding domain against B7H3 is an antigen binding portion, e.g., CDRs, of an antibody MGA271 (Macrogenics).

In one embodiment, an antigen binding domain against KIT is an antigen binding portion, e.g., CDRs, of an antibody described in, e.g., U.S. Pat. No. 7,915,391, US20120288506, and several commercial catalog antibodies.

In one embodiment, an antigen binding domain against IL-13Ra2 is an antigen binding portion, e.g., CDRs, of an antibody described in, e.g., WO2008/146911, WO2004087758, several commercial catalog antibodies, and WO2004087758.

In one embodiment, an antigen binding domain against CD30 is an antigen binding portion, e.g., CDRs, of an antibody described in, e.g., U.S. Pat. No. 7,090,843 B1, and EP0805871.

In one embodiment, an antigen binding domain against GD3 is an antigen binding portion, e.g., CDRs, of an antibody described in, e.g., U.S. Pat. Nos. 7,253,263; 8,207,308; US 20120276046; EP1013761; WO2005035577; and U.S. Pat. No. 6,437,098.

In one embodiment, an antigen binding domain against CD171 is an antigen binding portion, e.g., CDRs, of an antibody described in, e.g., Hong et al., *J Immunother* 37(2):93-104 (2014).

In one embodiment, an antigen binding domain against IL-11Ra is an antigen binding portion, e.g., CDRs, of an antibody available from Abcam (cat # ab55262) or Novus Biologicals (cat # EPR5446). In another embodiment, an antigen binding domain again IL-11Ra is a peptide, see, e.g., Huang et al., Cancer Res 72(1):271-281 (2012).

In one embodiment, an antigen binding domain against PSCA is an antigen binding portion, e.g., CDRs, of an antibody described in, e.g., Morgenroth et al., Prostate 67(10):1121-1131 (2007) (scFv 7F5); Nejatollahi et al., J of Oncology 2013(2013), article ID 839831 (scFv C5-II); and US Pat Publication No. 20090311181.

In one embodiment, an antigen binding domain against VEGFR2 is an antigen binding portion, e.g., CDRs, of an antibody described in, e.g., Chinnasamy et al., J Clin Invest 120(11):3953-3968 (2010).

In one embodiment, an antigen binding domain against LewisY is an antigen binding portion, e.g., CDRs, of an antibody described in, e.g., Kelly et al., Cancer Biother Radiopharm 23(4):411-423 (2008) (hu3S193 Ab (scFvs)); Dolezal et al., Protein Engineering 16(1):47-56 (2003) (NC10 scFv).

In one embodiment, an antigen binding domain against CD24 is an antigen binding portion, e.g., CDRs, of an antibody described in, e.g., Maliar et al., Gastroenterology 143(5):1375-1384 (2012).

In one embodiment, an antigen binding domain against PDGFR-beta is an antigen binding portion, e.g., CDRs, of an antibody Abcam ab32570.

In one embodiment, an antigen binding domain against SSEA-4 is an antigen binding portion, e.g., CDRs, of antibody MC813 (Cell Signaling), or other commercially available antibodies.

In one embodiment, an antigen binding domain against CD20 is an antigen binding portion, e.g., CDRs, of the antibody Rituximab, Ofatumumab, Ocrelizumab, Veltuzumab, or GA101.

In one embodiment, an antigen binding domain against Folate receptor alpha is an antigen binding portion, e.g., CDRs, of the antibody IMGN853, or an antibody described in US20120009181; U.S. Pat. No. 4,851,332, LK26: U.S. Pat. No. 5,952,484.

In one embodiment, an antigen binding domain against ERBB2 (Her2/neu) is an antigen binding portion, e.g., CDRs, of the antibody trastuzumab, or pertuzumab.

In one embodiment, an antigen binding domain against MUC1 is an antigen binding portion, e.g., CDRs, of the antibody SAR566658.

In one embodiment, the antigen binding domain against EGFR is antigen binding portion, e.g., CDRs, of the antibody cetuximab, panitumumab, zalutumumab, nimotuzumab, or matuzumab.

In one embodiment, an antigen binding domain against NCAM is an antigen binding portion, e.g., CDRs, of the antibody clone 2-2B: MAB5324 (EMD Millipore).

In one embodiment, an antigen binding domain against Ephrin B2 is an antigen binding portion, e.g., CDRs, of an antibody described in, e.g., Abengozar et al., *Blood* 119(19): 4565-4576 (2012).

In one embodiment, an antigen binding domain against IGF-I receptor is an antigen binding portion, e.g., CDRs, of an antibody described in, e.g., U.S. Pat. No. 8,344,112 B2; EP2322550 A1; WO 2006/138315, or PCT/US2006/022995.

In one embodiment, an antigen binding domain against CAIX is an antigen binding portion, e.g., CDRs, of the antibody clone 303123 (R&D Systems).

In one embodiment, an antigen binding domain against LMP2 is an antigen binding portion, e.g., CDRs, of an antibody described in, e.g., U.S. Pat. No. 7,410,640, or US20050129701.

In one embodiment, an antigen binding domain against gp100 is an antigen binding portion, e.g., CDRs, of the antibody HMB45, NKIbetaB, or an antibody described in WO2013165940, or US20130295007

In one embodiment, an antigen binding domain against tyrosinase is an antigen binding portion, e.g., CDRs, of an antibody described in, e.g., U.S. Pat. No. 5,843,674; or U.S. Ser. No. 19/950,504048.

In one embodiment, an antigen binding domain against EphA2 is an antigen binding portion, e.g., CDRs, of an antibody described in, e.g., Yu et al., Mol Ther 22(1):102-111 (2014).

In one embodiment, an antigen binding domain against GD3 is an antigen binding portion, e.g., CDRs, of an antibody described in, e.g., U.S. Pat. Nos. 7,253,263; 8,207, 308; US 20120276046; EP1013761 A3; 20120276046; WO2005035577; or U.S. Pat. No. 6,437,098.

In one embodiment, an antigen binding domain against fucosyl GM1 is an antigen binding portion, e.g., CDRs, of an antibody described in, e.g., US20100297138; or WO2007/067992.

In one embodiment, an antigen binding domain against sLe is an antigen binding portion, e.g., CDRs, of the antibody G193 (for lewis Y), see Scott A M et al, Cancer Res 60: 3254-61 (2000), also as described in Neeson et al, J Immunol May 2013 190 (Meeting Abstract Supplement) 177.10.

In one embodiment, an antigen binding domain against GM3 is an antigen binding portion, e.g., CDRs, of the antibody CA 2523449 (mAb 14F7).

In one embodiment, an antigen binding domain against HMWMAA is an antigen binding portion, e.g., CDRs, of an antibody described in, e.g., Kmiecik et al., Oncoimmunology 3(1):e27185 (2014) (PMID: 24575382) (mAb9.2.27); U.S. Pat. No. 6,528,481; WO2010033866; or US 20140004124.

In one embodiment, an antigen binding domain against o-acetyl-GD2 is an antigen binding portion, e.g., CDRs, of the antibody 8B6.

In one embodiment, an antigen binding domain against TEM1/CD248 is an antigen binding portion, e.g., CDRs, of an antibody described in, e.g., Marty et al., Cancer Lett 235(2):298-308 (2006); Zhao et al., J Immunol Methods 363(2):221-232 (2011).

In one embodiment, an antigen binding domain against CLDN6 is an antigen binding portion, e.g., CDRs, of the antibody IMAB027 (Ganymed Pharmaceuticals), see e.g., clinicaltrial.gov/show/NCT02054351.

In one embodiment, an antigen binding domain against TSHR is an antigen binding portion, e.g., CDRs, of an antibody described in, e.g., U.S. Pat. Nos. 8,603,466; 8,501, 415; or U.S. Pat. No. 8,309,693.

In one embodiment, an antigen binding domain against GPRC5D is an antigen binding portion, e.g., CDRs, of the antibody FAB6300A (R&D Systems); or LS-A4180 (Lifespan Biosciences).

In one embodiment, an antigen binding domain against CD97 is an antigen binding portion, e.g., CDRs, of an antibody described in, e.g., U.S. Pat. No. 6,846,911; de Groot et al., J Immunol 183(6):4127-4134 (2009); or an antibody from R&D:MAB3734.

In one embodiment, an antigen binding domain against ALK is an antigen binding portion, e.g., CDRs, of an antibody described in, e.g., Mino-Kenudson et al., Clin Cancer Res 16(5):1561-1571 (2010).

In one embodiment, an antigen binding domain against polysialic acid is an antigen binding portion, e.g., CDRs, of an antibody described in, e.g., Nagae et al., J Biol Chem 288(47):33784-33796 (2013).

In one embodiment, an antigen binding domain against PLAC1 is an antigen binding portion, e.g., CDRs, of an antibody described in, e.g., Ghods et al., Biotechnol Appl Biochem 2013 doi:10.1002/bab.1177.

In one embodiment, an antigen binding domain against GloboH is an antigen binding portion of the antibody VK9; or an antibody described in, e.g., Kudryashov V et al, Glycoconj J.15(3):243-9 (1998), Lou et al., Proc Natl Acad Sci USA 111(7):2482-2487 (2014); MBrl: Bremer E-G et al. J Biol Chem 259:14773-14777 (1984).

In one embodiment, an antigen binding domain against NY-BR-1 is an antigen binding portion, e.g., CDRs of an antibody described in, e.g., Jager et al., Appl Immunohistochem Mol Morphol 15(1):77-83 (2007).

In one embodiment, an antigen binding domain against WT-1 is an antigen binding portion, e.g., CDRs, of an antibody described in, e.g., Dao et al., Sci Transl Med 5(176):176ra33 (2013); or WO2012/135854.

In one embodiment, an antigen binding domain against MAGE-A1 is an antigen binding portion, e.g., CDRs, of an antibody described in, e.g., Willemsen et al., J Immunol 174(12):7853-7858 (2005) (TCR-like scFv).

In one embodiment, an antigen binding domain against sperm protein 17 is an antigen binding portion, e.g., CDRs, of an antibody described in, e.g., Song et al., Target Oncol 2013 Aug. 14 (PMID: 23943313); Song et al., Med Oncol 29(4):2923-2931 (2012).

In one embodiment, an antigen binding domain against Tie 2 is an antigen binding portion, e.g., CDRs, of the antibody AB33 (Cell Signaling Technology).

In one embodiment, an antigen binding domain against MAD-CT-2 is an antigen binding portion, e.g., CDRs, of an antibody described in, e.g., PMID: 2450952; U.S. Pat. No. 7,635,753.

In one embodiment, an antigen binding domain against Fos-related antigen 1 is an antigen binding portion, e.g., CDRs, of the antibody 12F9 (Novus Biologicals).

In one embodiment, an antigen binding domain against MelanA/MART1 is an antigen binding portion, e.g., CDRs, of an antibody described in, EP2514766 A2; or U.S. Pat. No. 7,749,719.

In one embodiment, an antigen binding domain against sarcoma translocation breakpoints is an antigen binding portion, e.g., CDRs, of an antibody described in, e.g., Luo et al, EMBO Mol. Med. 4(6):453-461 (2012).

In one embodiment, an antigen binding domain against TRP-2 is an antigen binding portion, e.g., CDRs, of an antibody described in, e.g., Wang et al, J Exp Med. 184(6): 2207-16 (1996).

In one embodiment, an antigen binding domain against CYP1B1 is an antigen binding portion, e.g., CDRs, of an antibody described in, e.g., Maecker et al, Blood 102 (9): 3287-3294 (2003).

In one embodiment, an antigen binding domain against RAGE-1 is an antigen binding portion, e.g., CDRs, of the antibody MAB5328 (EMD Millipore).

In one embodiment, an antigen binding domain against human telomerase reverse transcriptase is an antigen binding portion, e.g., CDRs, of the antibody cat no: LS-B95-100 (Lifespan Biosciences)

In one embodiment, an antigen binding domain against intestinal carboxyl esterase is an antigen binding portion, e.g., CDRs, of the antibody 4F12: cat no: LS-B6190-50 (Lifespan Biosciences).

In one embodiment, an antigen binding domain against mut hsp70-2 is an antigen binding portion, e.g., CDRs, of the antibody Lifespan Biosciences: monoclonal: cat no: LS-C133261-100 (Lifespan Biosciences).

In one embodiment, an antigen binding domain against CD79a is an antigen binding portion, e.g., CDRs, of the antibody Anti-CD79a antibody [HM47/A9] (ab3121), available from Abcam; antibody CD79A Antibody #3351 available from Cell Signalling Technology; or antibody HPA017748-Anti-CD79A antibody produced in rabbit, available from Sigma Aldrich.

In one embodiment, an antigen binding domain against CD79b is an antigen binding portion, e.g., CDRs, of the antibody polatuzumab vedotin, anti-CD79b described in Dornan et al., "Therapeutic potential of an anti-CD79b antibody-drug conjugate, anti-CD79b-vc-MMAE, for the treatment of non-Hodgkin lymphoma" Blood. 2009 Sep. 24; 114(13):2721-9. doi: 10.1182/blood-2009-02-205500. Epub 2009 Jul. 24, or the bispecific antibody Anti-CD79b/CD3 described in "4507 Pre-Clinical Characterization of T Cell-Dependent Bispecific Antibody Anti-CD79b/CD3 As a Potential Therapy for B Cell Malignancies" Abstracts of 56th ASH Annual Meeting and Exposition, San Francisco, CA Dec. 6-9, 2014.

In one embodiment, an antigen binding domain against CD72 is an antigen binding portion, e.g., CDRs, of the antibody J3-109 described in Myers, and Uckun, "An anti-CD72 immunotoxin against therapy-refractory B-lineage acute lymphoblastic leukemia." Leuk Lymphoma. 1995 June; 18(1-2):119-22, or anti-CD72 (10D6.8.1, mIgGi) described in Polson et al., "Antibody-Drug Conjugates for the Treatment of Non-Hodgkin's Lymphoma: Target and Linker-Drug Selection" Cancer Res Mar. 15, 2009 69; 2358.

In one embodiment, an antigen binding domain against LAIR1 is an antigen binding portion, e.g., CDRs, of the antibody ANT-301 LAIR1 antibody, available from ProSpec; or anti-human CD305 (LAIR1) Antibody, available from BioLegend.

In one embodiment, an antigen binding domain against FCAR is an antigen binding portion, e.g., CDRs, of the antibody CD89/FCAR Antibody (Catalog #10414-H08H), available from Sino Biological Inc.

In one embodiment, an antigen binding domain against LILRA2 is an antigen binding portion, e.g., CDRs, of the antibody LILRA2 monoclonal antibody (M17), clone 3C7, available from Abnova, or Mouse Anti-LILRA2 antibody, Monoclonal (2D7), available from Lifespan Biosciences.

In one embodiment, an antigen binding domain against CD300LF is an antigen binding portion, e.g., CDRs, of the antibody Mouse Anti-CMRF35-like molecule 1 antibody, Monoclonal[UP-D2, available from BioLegend, or Rat Anti-CMRF35-like molecule 1 antibody, Monoclonal[234903], available from R&D Systems.

In one embodiment, an antigen binding domain against CLEC12A is an antigen binding portion, e.g., CDRs, of the antibody Bispecific T cell Engager (BiTE) scFv-antibody and ADC described in Noordhuis et al., "Targeting of CLEC12A In Acute Myeloid Leukemia by Antibody-Drug-Conjugates and Bispecific CLL-1×CD3 BiTE Antibody" 53rd ASH Annual Meeting and Exposition, Dec. 10-13, 2011, and MCLA-117 (Merus).

In one embodiment, an antigen binding domain against BST2 (also called CD317) is an antigen binding portion, e.g., CDRs, of the antibody Mouse Anti-CD317 antibody, Monoclonal[3H4], available from Antibodies-Online or Mouse Anti-CD317 antibody, Monoclonal [696739], available from R&D Systems.

In one embodiment, an antigen binding domain against EMR2 (also called CD312) is an antigen binding portion, e.g., CDRs, of the antibody Mouse Anti-CD312 antibody, Monoclonal[LS-B8033] available from Lifespan Biosciences, or Mouse Anti-CD312 antibody, Monoclonal [494025] available from R&D Systems.

In one embodiment, an antigen binding domain against LY75 is an antigen binding portion, e.g., CDRs, of the antibody Mouse Anti-Lymphocyte antigen 75 antibody, Monoclonal[HD30] available from EMD Millipore or Mouse Anti-Lymphocyte antigen 75 antibody, Monoclonal [A15797] available from Life Technologies.

In one embodiment, an antigen binding domain against GPC3 is an antigen binding portion, e.g., CDRs, of the antibody hGC33 described in Nakano K, Ishiguro T, Konishi H, et al. Generation of a humanized anti-glypican 3 antibody by CDR grafting and stability optimization. Anticancer Drugs. 2010 November; 21(10):907-916, or MDX-1414, HN3, or YP7, all three of which are described in Feng et al., "Glypican-3 antibodies: a new therapeutic target for liver cancer." FEBS Lett. 2014 Jan. 21; 588(2):377-82.

In one embodiment, an antigen binding domain against FCRL5 is an antigen binding portion, e.g., CDRs, of the anti-FcRL5 antibody described in Elkins et al., "FcRL5 as a target of antibody-drug conjugates for the treatment of multiple myeloma" *Mol Cancer Ther.* 2012 October; 11(10): 2222-32. In one embodiment, an antigen binding domain against FCRL5 is an antigen binding portion, e.g., CDRs, of the anti-FcRL5 antibody described in, for example, WO2001/038490, WO/2005/117986, WO2006/039238, WO2006/076691, WO2010/114940, WO2010/120561, or WO2014/210064.

In one embodiment, an antigen binding domain against IGLL1 is an antigen binding portion, e.g., CDRs, of the Mouse Anti-Immunoglobulin lambda-like polypeptide 1 antibody, Monoclonal[AT1G4] available from Lifespan Biosciences, Mouse Anti-Immunoglobulin lambda-like polypeptide 1 antibody, Monoclonal[HSL11] available from BioLegend.

In one embodiment, the antigen binding domain comprises one, two, or three (e.g., all three) heavy chain CDRs, HC CDR1, HC CDR2 and HC CDR3, from an antibody listed above, and/or one, two, or three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed above. In some embodiments, the CAR comprises an antigen-binding domain and an Fc region as described herein.

In another aspect, the antigen binding domain comprises a humanized antibody or an antibody fragment. In some aspects, a non-human antibody is humanized, where specific sequences or regions of the antibody are modified to increase similarity to an antibody naturally produced in a human or fragment thereof. In one aspect, the antigen binding domain is humanized. In some embodiments, a non-human antibody or fragment is humanized and back-mutated to bring the antigen binding affinity of the humanized antibody closer to that of the original non-human antibody or fragment.

In an embodiment, the antigen-binding domain of a CAR, e.g., a CAR expressed by a cell binds to CD19. CD19 is found on B cells throughout differentiation of the lineage from the pro/pre-B cell stage through the terminally differentiated plasma cell stage. In an embodiment, the antigen binding domain comprises a murine scFv domain that binds to human CD19, e.g., the antigen binding domain of CTL019 (e.g., SEQ ID NO: 160). In an embodiment, the antigen binding domain comprises a humanized antibody or antibody fragment, e.g., a scFv domain, derived from the murine CTL019 scFv. In an embodiment, the antigen binding domain is a human antibody or antibody fragment that binds to human CD19. Exemplary scFv domains (and their sequences, e.g., CDRs, VL and VH sequences) that bind to CD19 are provided in Table 4. The scFv domain sequences provided in Table 4 include a light chain variable region (VL) and a heavy chain variable region (VH). The VL and VH are attached by a linker comprising the sequence GGGGSGGGGSGGGGS (SEQ ID NO: 35), e.g., in the following orientation: VL-linker-VH.

TABLE 4

Antigen Binding domains that bind CD19

| Antigen | Name | Amino Acid Sequence | SEQ ID NO: |
|---|---|---|---|
| CD19 | muCTL019 | DIQMTQTTSSLSASLGDRVTISCRASQDISKYLNWYQQKPDGTVKLLI YHTSRLHSGVPSRFSGSGSGTDYSLTISNLEQEDIATYFCQQGNTLPY TFGGGTKLEITGGGGSGGGGSGGGGSEVKLQESGPGLVAPSQSLSVTC TVSGVSLPDYGVSWIRQPPRKGLEWLGVIWGSETTYYNSALKSRLTII KDNSKSQVFLKMNSLQTDDTAIYYCAKHYYYGGSYAMDYWGQGTSVTV SS | 160 |
| CD19 | huscFv1 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSQVQLQESGPGLVKPSETLSLTC TVSGVSLPDYGVSWIRQPPGKGLEWIGVIWGSETTYYSSSLKSRVTIS KDNSKNQVSLKLSSVTAADTAVYYCAKHYYYGGSYAMDYWGQGTLVTV SS | 161 |
| CD19 | huscFv2 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSQVQLQESGPGLVKPSETLSLTC TVSGVSLPDYGVSWIRQPPGKGLEWIGVIWGSETTYYQSSLKSRVTIS KDNSKNQVSLKLSSVTAADTAVYYCAKHYYYGGSYAMDYWGQGTLVTV SS | 162 |
| CD19 | huscFv3 | QVQLQESGPGLVKPSETLSLICTVSGVSLPDYGVSWIRQPPGKGLEWI GVIWGSETTYYSSSLKSRVTISKDNSKNQVSLKLSSVTAADTAVYYCA KHYYYGGSYAMDYWGQGTLVTVSSGGGGSGGGGSGGGGSEIVMTQSPA TLSLSPGERATLSCRASQDISKYLNWYQQKPGQAPRLLIYHTSRLHSG IPARFSGSGSGTDYTLTISSLQPEDFAVYFCQQGNTLPYTFGQGTKLE IK | 163 |

TABLE 4-continued

Antigen Binding domains that bind CD19

| Antigen | Name | Amino Acid Sequence | SEQ ID NO: |
|---|---|---|---|
| CD19 | huscFv4 | QVQLQESGPGLVKPSETLSLICTVSGVSLPDYGVSWIRQPPGKGLEWI GVIWGSETTYYQSSLKSRVTISKDNSKNQVSLKLSSVTAADTAVYYCA KHYYYGGSYAMDYWGQGTLVTVSSGGGGSGGGGSGGGGSEIVMTQSPA TLSLSPGERATLSCRASQDISKYLNWYQQKPGQAPRLLIYHTSRLHSG IPARFSGSGSGTDYTLTISSLQPEDFAVYFCQQGNTLPYTFGQGTKLE IK | 164 |
| CD19 | huscFv5 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSGGGGSQVQLQESGPGLVKPSET LSLICTVSGVSLPDYGVSWIRQPPGKGLEWIGVIWGSETTYYSSSLKS RVTISKDNSKNQVSLKLSSVTAADTAVYYCAKHYYYGGSYAMDYWGQG TLVTVSS | 165 |
| CD19 | huscFv6 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSGGGGSQVQLQESGPGLVKPSET LSLICTVSGVSLPDYGVSWIRQPPGKGLEWIGVIWGSETTYYQSSLKS RVTISKDNSKNQVSLKLSSVTAADTAVYYCAKHYYYGGSYAMDYWGQG TLVTVSS | 166 |
| CD19 | huscFv7 | QVQLQESGPGLVKPSETLSLICTVSGVSLPDYGVSWIRQPPGKGLEWI GVIWGSETTYYSSSLKSRVTISKDNSKNQVSLKLSSVTAADTAVYYCA KHYYYGGSYAMDYWGQGTLVTVSSGGGGSGGGGSGGGGSGGGGSEIVM TQSPATLSLSPGERATLSCRASQDISKYLNWYQQKPGQAPRLLTYHTS RLHSGIPARFSGSGSGTDYTLTISSLQPEDFAVYFCQQGNTLPYTFGQ GTKLEIK | 167 |
| CD19 | huscFv8 | QVQLQESGPGLVKPSETLSLICTVSGVSLPDYGVSWIRQPPGKGLEWI GVIWGSETTYYQSSLKSRVTISKDNSKNQVSLKLSSVTAADTAVYYCA KHYYYGGSYAMDYWGQGTLVTVSSGGGGSGGGGSGGGGSGGGGSEIVM TQSPATLSLSPGERATLSCRASQDISKYLNWYQQKPGQAPRLLTYHTS RLHSGIPARFSGSGSGTDYTLTISSLQPEDFAVYFCQQGNTLPYTFGQ GTKLEIK | 168 |
| CD19 | huscFv9 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSGGGGSQVQLQESGPGLVKPSET LSLICTVSGVSLPDYGVSWIRQPPGKGLEWIGVIWGSETTYYNSSLKS RVTISKDNSKNQVSLKLSSVTAADTAVYYCAKHYYYGGSYAMDYWGQG TLVTVSS | 169 |
| CD19 | HuscFv10 | QVQLQESGPGLVKPSETLSLICTVSGVSLPDYGVSWIRQPPGKGLEWI GVIWGSETTYYNSSLKSRVTISKDNSKNQVSLKLSSVTAADTAVYYCA KHYYYGGSYAMDYWGQGTLVTVSSGGGGSGGGGSGGGGSGGGGSEIVM TQSPATLSLSPGERATLSCRASQDISKYLNWYQQKPGQAPRLLIYHTS RLHSGIPARFSGSGSGTDYTLTISSLQPEDFAVYFCQQGNTLPYTFGQ GTKLEIK | 170 |
| CD19 | HuscFv11 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSQVQLQESGPGLVKPSETLSLTC TVSGVSLPDYGVSWIRQPPGKGLEWIGVIWGSETTYYNSSLKSRVTIS KDNSKNQVSLKLSSVTAADTAVYYCAKHYYYGGSYAMDYWGQGTLVTV SS | 171 |
| CD19 | HuscFv12 | QVQLQESGPGLVKPSETLSLICTVSGVSLPDYGVSWIRQPPGKGLEWI GVIWGSETTYYNSSLKSRVTISKDNSKNQVSLKLSSVTAADTAVYYCA KHYYYGGSYAMDYWGQGTLVTVSSGGGGSGGGGSGGGGSEIVMTQSPA TLSLSPGERATLSCRASQDISKYLNWYQQKPGQAPRLLIYHTSRLHSG IPARFSGSGSGTDYTLTISSLQPEDFAVYFCQQGNTLPYTFGQGTKLE IK | 172 |

The sequences of the CDR sequences of the scFv domains of the CD19 antigen binding domains provided in Table 4 are shown in Table 5 for the heavy chain variable domains and in Table 6 for the light chain variable domains. "ID" stands for the respective SEQ ID NO for each CDR.

In one embodiment, the CD19 binding domain comprises one or more (e.g., all three) light chain complementary determining region 1 (LC CDR1), light chain complementary determining region 2 (LC CDR2), and light chain complementary determining region 3 (LC CDR3) of a CD19 binding domain described herein, e.g., provided in Table 4 or 6, and/or one or more (e.g., all three) heavy chain complementary determining region 1 (HC CDR1), heavy chain complementary determining region 2 (HC CDR2), and heavy chain complementary determining region 3 (HC CDR3) of a CD19 binding domain described herein, e.g., provided in Table 4 or 5. In one embodiment, the CD19 binding domain comprises one, two, or all of LC CDR1, LC CDR2, and LC CDR3 of any amino acid sequences as provided in Table 6, incorporated herein by reference; and one, two or all of HC CDR1, HC CDR2, and HC CDR3 of any amino acid sequences as provided in Table 5.

In one embodiment, the CD19 antigen binding domain comprises:

TABLE 5

Heavy Chain Variable Domain CDRs

| Description | FW | HCDR1 | ID | HCDR2 | ID | HCDR3 | ID |
|---|---|---|---|---|---|---|---|
| murine_CART19 | | GVSLPDYGVS | 176 | VIWGSETTYYNSALKS | 177 | HYYYGGSYAMDY | 181 |
| humanized_CART19 a | VH4 | GVSLPDYGVS | 176 | VIWGSETTYY*SS*LKS | 178 | HYYYGGSYAMDY | 181 |
| humanized_CART19 b | VH4 | GVSLPDYGVS | 176 | VIWGSETTYY*QSS*LKS | 179 | HYYYGGSYAMDY | 181 |
| humanized_CART19 c | VH4 | GVSLPDYGVS | 176 | VIWGSETTYYNS*S*LKS | 180 | HYYYGGSYAMDY | 181 |

TABLE 6

Light Chain Variable Domain CDRs

| Description | FW | LCDR1 | ID | LCDR2 | ID | LCDR3 | ID |
|---|---|---|---|---|---|---|---|
| murine_CART19 | | RASQDISKYLN | 182 | HTSRLHS | 183 | QQGNTLPYT | 184 |
| humanized_CART19 a | VK3 | RASQDISKYLN | 182 | HTSRLHS | 183 | QQGNTLPYT | 184 |
| humanized_CART19 b | VK3 | RASQDISKYLN | 182 | HTSRLHS | 183 | QQGNTLPYT | 184 |
| humanized_CART19 c | VK3 | RASQDISKYLN | 182 | HTSRLHS | 183 | QQGNTLPYT | 184 |

In an embodiment, the antigen binding domain comprises an anti-CD19 antibody, or fragment thereof, e.g., an scFv. For example, the antigen binding domain comprises a variable heavy chain and/or a variable light chain listed in Table 7. The linker sequence joining the variable heavy and variable light chains can be any of the linker sequences described herein, or alternatively, can be GST-SGSGKPGSGEGSTKG (SEQ ID NO: 38). The light chain variable region and heavy chain variable region of a scFv can be, e.g., in any of the following orientations: light chain variable region-linker-heavy chain variable region or heavy chain variable region-linker-light chain variable region.

TABLE 7

Additional Anti-CD19 antibody binding domains

| Ab Name | VH Sequence | VL Sequence |
|---|---|---|
| SJ25-C1 | QVQLLESGAELVRPGSSVKISCKASG YAFSSYWMNWVKQRPGQGLEWIGQIY PGDGDTNYNGKFKGQATLTADKSSST AYMQLSGLTSEDSAVYSCARKTISSV VDFYFDYWGQGTTVT (SEQ ID NO: 173) | ELVLTQSPKFMSTSVGDRVSVTCKASQNV GTNVAWYQQKPGQSPKPLIYSATYRNSGV PDRFTGSGSGTDFTLTITNVQSKDLADYF YFCQYNRYPYTSGGGTKLEIKRRS (SEQ ID NO: 174) |
| | ScFv Sequence | |
| SJ25-C1 scFv | QVQLLESGAELVRPGSSVKISCKASGYAFSSYWMNWVKQRPGQGLEWIGQIYPGDGD TNYNGKFKGQATLTADKSSSTAYMQLSGLTSEDSAVYSCARKTISSVVDFYFDYWGQ GTTVTGSTSGSGKPGSGEGSTKGELVLTQSPKFMSTSVGDRVSVTCKASQNVGTNVA WYQQKPGQSPKPLIYSATYRNSGVPDRFTGSGSGTDFTLTITNVQSKDLADYFYFCQ YNRYPYTSGGGTKLEIKRRS (SEQ ID NO: 175) | |

(i) (a) a LC CDR1 amino acid sequence of SEQ ID NO: 182, a LC CDR2 amino acid sequence of SEQ ID NO: 183, and a LC CDR3 amino acid sequence of SEQ ID NO: 184; and
  (b) a HC CDR1 amino acid sequence of SEQ ID NO: 176, a HC CDR2 amino acid sequence of SEQ ID NO: 177, and a HC CDR3 amino acid sequence of SEQ ID NO: 181
(ii) (a) a LC CDR1 amino acid sequence of SEQ ID NO: 182, a LC CDR2 amino acid sequence of SEQ ID NO: 183, and a LC CDR3 amino acid sequence of SEQ ID NO: 184; and
  (b) a HC CDR1 amino acid sequence of SEQ ID NO: 176, a HC CDR2 amino acid sequence of SEQ ID NO: 178, and a HC CDR3 amino acid sequence of SEQ ID NO: 181;
(iii) (a) a LC CDR1 amino acid sequence of SEQ ID NO: 182, a LC CDR2 amino acid sequence of SEQ ID NO: 183, and a LC CDR3 amino acid sequence of SEQ ID NO: 184; and
  (b) a HC CDR1 amino acid sequence of SEQ ID NO: 176, a HC CDR2 amino acid sequence of SEQ ID NO: 179, and a HC CDR3 amino acid sequence of SEQ ID NO: 181; or
(iv) (a) a LC CDR1 amino acid sequence of SEQ ID NO: 182, a LC CDR2 amino acid sequence of SEQ ID NO: 183, and a LC CDR3 amino acid sequence of SEQ ID NO: 184; and
  (b) a HC CDR1 amino acid sequence of SEQ ID NO: 176, a HC CDR2 amino acid sequence of SEQ ID NO: 180, and a HC CDR3 amino acid sequence of SEQ ID NO: 181.

In one embodiment, the CD19 binding domain comprises a light chain variable region described herein (e.g., in Table 4 or 7) and/or a heavy chain variable region described herein (e.g., in Table 4 or 7). In one embodiment, the CD19 binding domain is a scFv comprising a light chain and a heavy chain of an amino acid sequence listed in Table 4 or 7. In an embodiment, the CD19 binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 4 or 7, or a sequence with 95-99% identity with an amino acid sequence provided in Table 4 or 7; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 4 or 7, or a sequence with 95-99% identity to an amino acid sequence provided in Table 4 or 7.

In one embodiment, the CD19 binding domain comprises an amino acid sequence selected from a group consisting of SEQ ID NO: 161; SEQ ID NO: 162, SEQ ID NO: 163; SEQ ID NO: 164; SEQ ID NO: 165; SEQ ID NO: 166; SEQ ID NO: 167, SEQ ID NO: 168, SEQ ID NO: 169, SEQ ID NO: 170, SEQ ID NO: 171, SEQ ID NO: 172, SEQ ID NO: 160, and SEQ ID NO: 175; or an amino acid sequence having at least one, two or three modifications (e.g., substitutions, e.g., conservative substitutions) but not more than 30, 20 or 10 modifications (e.g., substitutions, e.g., conservative substitutions) to any of the aforesaid sequences; or a sequence with 95-99% identity to any of the aforesaid sequences. In one embodiment, the CD19 binding domain is a scFv, and a light chain variable region comprising an amino acid sequence described herein, e.g., in Table 4 or 7, is attached to a heavy chain variable region comprising an amino acid sequence described herein, e.g., in Table 4 or 7, via a linker, e.g., a linker described herein. In one embodiment, the CD19 binding domain includes a (Gly4-Ser)n linker, wherein n is 1, 2, 3, 4, 5, or 6 (SEQ ID NO: 10561), preferably 3 (SEQ ID NO: 35). The light chain variable region and heavy chain variable region of a scFv can be, e.g., in any of the following orientations: light chain variable region-linker-heavy chain variable region or heavy chain variable region-linker-light chain variable region.

Any known CD19 CAR, e.g., the CD19 antigen binding domain of any known CD19 CAR, in the art can be used in accordance with the instant disclosure to construct a CAR. For example, LG-740; CD19 CAR described in the U.S. Pat. Nos. 8,399,645; 7,446,190; Xu et al., Leuk Lymphoma. 2013 54(2):255-260(2012); Cruz et al., Blood 122(17): 2965-2973 (2013); Brentjens et al., Blood, 118(18):4817-4828 (2011); Kochenderfer et al., Blood 116(20):4099-102 (2010); Kochenderfer et al., Blood 122 (25):4129-39(2013); and 16th Annu Meet Am Soc Gen Cell Ther (ASGCT) (May 15-18, Salt Lake City) 2013, Abst 10. In one embodiment, an antigen binding domain against CD19 comprises an antigen binding portion, e.g., the CDRs, of a CAR, antibody or antigen-binding fragment thereof described in, e.g., PCT publication WO2012/079000; PCT publication WO2014/153270; Kochenderfer, J. N. et al., J. Immunother. 32 (7), 689-702 (2009); Kochenderfer, J. N., et al., Blood, 116 (20), 4099-4102 (2010); PCT publication WO2014/031687; Bejcek, Cancer Research, 55, 2346-2351, 1995; or U.S. Pat. No. 7,446,190.

In an embodiment, the antigen-binding domain of CAR, e.g., a CAR expressed by a cell of the disclosure, binds to BCMA. BCMA is found preferentially expressed in mature B lymphocytes. In an embodiment, the antigen binding domain is a murine scFv domain that binds to human BCMA. In an embodiment, the antigen binding domain is a humanized antibody or antibody fragment, e.g., scFv domain, that binds human BCMA. In an embodiment, the antigen binding domain is a humanized and back-mutated antibody or antibody fragment, e.g., scFv domain, that binds human BCMA. In an embodiment, the antigen binding domain is a human antibody or antibody fragment that binds to human BCMA. Exemplary scFv domains (and their sequences, e.g., CDRs, VL and VH sequences) that bind to BCMA are provided in Table 8, Table 9, Table 10 and Table 11. The scFv domain sequences provided in Table 8 and Table 9 include a light chain variable region (VL) and a heavy chain variable region (VH). The VL and VH are attached by a linker, e.g., in the following orientation: VH-linker-VL.

TABLE 8

Antigen Binding domains that bind BCMA
The amino acid sequences of variable heavy chain and variable
light chain sequences for each
scFv are also provided.

| Name/ Description | SEQ ID NO: | Sequence |
|---|---|---|
| 139109 | | |
| 139109-aa ScFv domain | 249 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSDIQLTQSPSSLSASVGDR VTITCRASQSISSYLNWYQQKPGKAPKLLIYAASSLQSGVPSRFSGSGSG TDFTLTISSLQPEDFATYYCQQSYSTPYTFGQGTKVEIK |
| 139109-nt ScFv domain | 264 | GAAGTGCAATTGGTGGAATCAGGGGGAGGACTTGTGCAGCCTGGAGGATC GCTGAGACTGTCATGTGCCGTGTCCGGCTTTGCCCTGTCCAACCACGGGA TGTCCTGGGTCCGCCGCGCCTGGAAAGGGCCTCGAATGGGTGTCGGGT ATTGTGTACAGCGGTAGCACCTACTATGCCGCATCCGTGAAGGGGAGATT CACCATCAGCCGGGACAACTCCAGGAACACTCTGTACCTCCAAATGAATT CGCTGAGGCCAGAGGACACTGCCATCTACTACTGCTCCGCGCATGGCGGA GAGTCCGACGTCTGGGGACAGGGGACCACCGTGACCGTGTCTAGCGCGTC CGGCGGAGGCGGCAGCGGGGGTCGGGCATCAGGGGGCGGCGGATCGGACA TCCAGCTCACCCAGTCCCCGAGCTCGCTGTCCGCCTCCGTGGGAGATCGG GTCACCATCACGTGCCGCGCCAGCCAGTCGATTTCCTCCTACCTGAACTG GTACCAACAGAAGCCCGGAAAAGCCCCGAAGCTTCTCATCTACGCCGCCT CGAGCCTGCAGTCAGGAGTGCCCTCACGGTTCTCCGGCTCCGGTTCCGGT ACTGATTTCACCCTGACCATTTCCTCCCTGCAACCGGAGGACTTCGCTAC TTACTACTGCCAGCAGTCGTACTCCACCCCCTACACTTTCGGACAAGGCA CCAAGGTCGAAATCAAG |
| 139109-aa VH | 279 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139109-aa VL | 294 | DIQLTQSPSSLSASVGDRVTITCRASQSISSYLNWYQQKPGKAPKLLIYA ASSLQSGVPSRFSGSGSGTDFTLTISSLQPEDFATYYCQQSYSTPYTFGQ GTKVEIK |
| 139103 | | |
| 139103-aa ScFv domain | 239 | QVQLVESGGGLVQPGRSLRLSCAASGFTFSNYAMSWVRQAPGKGLGWVSG ISRSGENTYYADSVKGRFTISRDNSKNTLYLQMNSLRDEDTAVYYCARSP AHYYGGMDVWGQGTTVTVSSASGGGGSGGRASGGGGSDIVLTQSPGTLSL SPGERATLSCRASQSISSSFLAWYQQKPGQAPRLLIYGASRRATGIPDRF SGSGSGTDFTLTISRLEPEDSAVYYCQQYHSSPSWTFGQGTKLEIK |
| 139103-nt ScFv domain | 254 | CAAGTGCAACTCGTGGAATCTGGTGGAGGACTCGTGCAACCCGGAAGATC GCTTAGACTGTCGTGTGCCGCCAGCGGGTTCACTTTCTCGAACTACGCGA TGTCCTGGGTCCGCCAGGCACCCGGAAAGGGACTCGGTTGGGTGTCCGGC ATTTCCCGGTCCGGCGAAAATACCTACTACGCCGACTCCGTGAAGGGCCG CTTCACCATCTCAAGGGACAACAGCAAAAACACCCTGTACTTGCAAATGA ACTCCCTGCGGGATGAAGATACAGCCGTGTACTATTGCGCCCGGTCGCCT GCCCATTACTACGGCGGAATGGACGTCTGGGGACAGGGAACCACTGTGAC TGTCAGCAGCGCGTCGGGTGGCGGCGGCTCAGGGGGTCGGGCCTCCGGGG GGGAGGGTCCGACATCGTGCTGACCCAGTCCCCGGGAACCCTGAGCCTG AGCCCGGGAGAGCGCGCGACCCTGTCATGCCGGGCATCCCAGAGCATTAG CTCCTCCTTTCTCGCCTGGTATCAGCAGAAGCCCGGACAGGCCCCGAGGC TGCTGATCTACGGCGCTAGCAGAAGGGCTACCGGAATCCCAGACCGGTTC TCCGGCTCCGGTTCCGGGACCGATTTCACCCTTACTATCTCGCGCCTGGA ACCTGAGGACTCCGCCGTCTACTACTGCCAGCAGTACCACTCATCCCCGT CGTGGACGTTCGGACAGGGCACCAAGCTGGAGATTAAG |
| 139103-aa VH | 269 | QVQLVESGGGLVQPGRSLRLSCAASGFTFSNYAMSWVRQAPGKGLGWVSG ISRSGENTYYADSVKGRFTISRDNSKNTLYLQMNSLRDEDTAVYYCARSP AHYYGGMDVWGQGTTVTVSS |
| 139103-aa VL | 284 | DIVLTQSPGTLSLSPGERATLSCRASQSISSSFLAWYQQKPGQAPRLLIY GASRRATGIPDRFSGSGSGTDFTLTISRLEPEDSAVYYCQQYHSSPSWTF GQGTKLEIK |
| 139105 | | |
| 139105-aa ScFv domain | 240 | QVQLVESGGGLVQPGRSLRLSCAASGFTFDDYAMHWVRQAPGKGLEWVSG ISWNSGSIGYADSVKGRFTISRDNAKNSLYLQMNSLRAEDTALYYCSVHS FLAYWGQGTLVTVSSASGGGGSGGRASGGGGSDIVMTQTPLSLPVTPGEP ASISCRSSQSLLHSNGYNYLDWYLQKPGQSPQLLIYLGSNRASGVPDRFS GSGSGTDFTLKISRVEAEDVGVYYCMQALQTPYTFGQGTKVEIK |
| 139105-nt ScFv domain | 255 | CAAGTGCAACTCGTCGAATCCGGTGGAGGTCTGGTCCAACCTGGTAGAAG CCTGAGACTGTCGTGTGCGGCCAGCGGATTCACCTTTGATGACTATGCTA TGCACTGGGTGCGGCAGGCCCCAGGAAAGGGCCTGGAATGGGTGTCGGGA ATTAGCTGGAACTCCGGGTCCATTGGCTACGCCGACTCCGTGAAGGGCCG CTTCACCATCTCCCGCGACAACGCAAAGAACTCCCTGTACTTGCAAATGA ACTCGCTCAGGGCTGAGGATACCGCGCTGTACTACTGCTCCGTGCATTCC |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| | | TTCCTGGCCTACTGGGGACAGGGAACTCTGGTCACCGTGTCGAGCGCCTC CGGCGGCGGGGGCTCGGGTGGACGGGCCTCGGGCGGAGGGGGTCCGACA TCGTGATGACCCAGACCCCGCTGAGCTTGCCCGTGACTCCCGGAGAGCCT GCATCCATCTCCTGCCGGTCATCCCAGTCCCTTCTCCACTCCAACGGATA CAACTACCTCGACTGGTACCTCCAGAAGCCGGGACAGAGCCCTCAGCTTC TGATCTACCTGGGGTCAAATAGAGCCTCAGGAGTGCCGGATCGGTTCAGC GGATCTGGTTCGGGAACTGATTTCACTCTGAAGATTTCCCGCGTGGAAGC CGAGGACGTGGGCGTCTACTACTGTATGCAGGCGCTGCAGACCCCCTATA CCTTCGGCCAAGGGACGAAAGTGGAGATCAAG |
| 139105-aa VH | 270 | QVQLVESGGGLVQPGRSLRLSCAASGFTFDDYAMHWVRQAPGKGLEWVSG ISWNSGSIGYADSVKGRFTISRDNAKNSLYLQMNSLRAEDTALYYCSVHS FLAYWGQGTLVTVSS |
| 139105-aa VL | 285 | DIVMTQTPLSLPVTPGEPASISCRSSQSLLHSNGYNYLDWYLQKPGQSPQ LLIYLGSNRASGVPDRFSGSGSGTDFTLKISRVEAEDVGVYYCMQALQTP YTFGQGTKVEIK |

139111

| 139111-aa ScFv domain | 241 | EVQLLESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSDIVMTQTPLSLSVTPGQP ASISCKSSQSLLRNDGKTPLYWYLQKAGQPPQLLIYEVSNRFSGVPDRFS GSGSGTDFTLKISRVEAEDVGAYYCMQNIQFPSFGGGTKLEIK |
| 139111-nt ScFv domain | 256 | GAAGTGCAATTGTTGGAATCTGGAGGAGGACTTGTGCAGCCTGGAGGATC ACTGAGACTTTCGTGTGCGGTGTCAGGCTTCGCCCTGAGCAACCACGGCA TGAGCTGGGTGCGGAGAGCCCCGGGGAAGGGTCTGGAATGGGTGTCCGGG ATCGTCTACTCCGGTTCAACTTACTACGCCGGAAGCGTGAAGGGTCGCTT CACCATTTCCCGCGATAACTCCCGGAACACCCTGTACCTCCAAATGAACT CCCTGCGGCCCGAGGACACCGCCATCTACTACTGTTCCGCGCATGGAGGA GAGTCCGATGTCTGGGGACAGGGCACTACCGTGACCGTGTCGAGCGCCTC GGGGGGAGGAGGCTCCGGCGGTCGCGCCTCCGGGGGGGTGGCAGCGACA TTGTGATGACGCAGACTCCACTCTCGCTGTCCGTGACCCCGGGACAGCCC GCGTCCATCTCGTGCAAGAGCTCCCAGAGCCTGCTGAGGAACGACGGAAA GACTCCTCTGTATTGGTACCTCCAGAAGGCTGGACAGCCCCCGCAACTGC TCATCTACGAAGTGTCAAATCGCTTCTCCGGGGTGCCGGATCGGTTTTCC GGCTCGGGATCGGGCACCGACTTCACCCTGAAAATCTCCAGGGTCGAGGC CGAGGACGTGGGAGCCTACTGCATGCAAAACATCCAGTTCCCTTCCT TCGGCGGCGGCACAAAGCTGGAGATTAAG |
| 139111-aa VH | 271 | EVQLLESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139111-aa VL | 286 | DIVMTQTPLSLSVTPGQPASISCKSSQSLLRNDGKTPLYWYLQKAGQPPQ LLIYEVSNRFSGVPDRFSGSGSGTDFTLKISRVEAEDVGAYYCMQNIQFP SFGGGTKLEIK |

139100

| 139100-aa ScFv domain | 242 | QVQLVQSGAEVRKTGASVKVSCKASGYIFDNFGINWVRQAPGQGLEWMGW INPKNNNTNYAQKFQGRVTITADESTNTAYMEVSSLRSEDTAVYYCARGP YYYQSYMDVWGQGTMVTVSSASGGGGSGGRASGGGGSDIVMTQTPLSLPV TPGEPASISCRSSQSLLHSNGYNYLNWYLQKPGQSPQLLIYLGSKRASGV PDRFSGSGSGTDFTLHITRVGAEDVGVYYCMQALQTPYTFGQGTKLEIK |
| 139100-nt ScFv domain | 257 | CAAGTCCAACTCGTCCAGTCCGGCGCAGAAGTCAGAAAAACCGGTGCTAG CGTGAAAGTGTCCTGCAAGGCCTCCGGCTACATTTTCGATAACTTCGGAA TCAACTGGGTCAGACAGGCCCCGGGCCAGGGGCTGGAATGGATGGGATGG ATCAACCCCAAGAACAACAACACCAACTACGCACAGAAGTTCCAGGGCCG CGTGACTATCACCGCCGATGAATCGACCAATACCGCCTACATGGAGGTGT CCTCCCTGCGGTCGGAGGACACTGCCGTGTATTACTGCGCGAGGGGCCCA TACTACTACCAAAGCTACATGGACGTCTGGGGACAGGGAACCATGGTGAC CGTGTCATCCGCCTCCGGTGGTGGAGGCTCCGGGGGGCGGGCTTCAGGAG GCGGAGGAAGCGATATTGTGATGACCCAGACTCCGCTTAGCCTGCCCGTG ACTCCTGGAGAACCGGCCTCCATTTCCTGCCGGTCCTCGCAATCACTCCT GCATTCCAACGGTTACAACTACCTGAATTGGTACCTCCAGAAGCCTGGCC AGTCGCCCCAGTTGCTGATCTATCTGGGCTCGAAGCGCGCCTCCGGGGTG CCTGACCGGTTTAGCGGATCTGGGAGCGGCACGGACTTCACTCTCCACAT CACCCGCGTGGGAGCGGAGGACGTGGGAGTGTACTACTGTATGCAGGCGC TGCAGACTCCGTACACATTCGGACAGGGCACCAAGCTGGAGATCAAG |
| 139100-aa VH | 272 | QVQLVQSGAEVRKTGASVKVSCKASGYIFDNFGINWVRQAPGQGLEWMGW INPKNNNTNYAQKFQGRVTITADESTNTAYMEVSSLRSEDTAVYYCARGP YYYQSYMDVWGQGTMVTVSS |

TABLE 8-continued

Antigen Binding domains that bind BCMA
The amino acid sequences of variable heavy chain and variable light chain sequences for each scFv are also provided.

| Name/ Description | SEQ ID NO: | Sequence |
|---|---|---|
| 139100-aa VL | 287 | DIVMTQTPLSLPVTPGEPASISCRSSQSLLHSNGYNYLNWYLQKPGQSPQ LLIYLGSKRASGVPDRFSGSGSGTDFTLHITRVGAEDVGVYYCMQALQTP YTFGQGTKLEIK |
| 139101 | | |
| 139101-aa ScFv domain | 243 | QVQLQESGGGLVQPGGSLRLSCAASGFTFSSDAMTWVRQAPGKGLEWVSV ISGSGGTTYYADSVKGRFTISRDNSKNTLYLQMNSLRAEDTAVYYCAKLD SSGYYYARGPRYWGQGTLVTVSSASGGGGSGGRASGGGGSDIQLTQSPSS LSASVGDRVTITCRASQSISSYLNWYQQKPGKAPKLLIYGASTLASGVPA RFSGSGSGTHFTLTINSLQSEDSATYYCQQSYKRASFGQGTKVEIK |
| 139101-nt ScFv domain | 258 | CAAGTGCAACTTCAAGAATCAGGCGGAGGACTCGTGCAGCCCGGAGGATC ATTGCGGCTCTCGTGCGCCGCCTCGGGCTTCACCTTCTCGAGCGACGCCA TGACCTGGGTCCGCCAGGCCCCGGGGAAGGGGCTGGAATGGGTGTCTGTG ATTTCCGGCTCCGGGGGAACTACGTACTACGCCGATTCCGTGAAAGGTCG CTTCACTATCTCCCGGGACAACAGCAAGAACACCCTTTATCTGCAAATGA ATTCCCTCCGCGCCGAGGACACCGCCGTGTACTACTGCGCCAAGCTGGAC TCCTCGGGCTACTACTATGCCCGGGGTCCGAGATACTGGGGACAGGGAAC CCTCGTGACCGTGTCCTCCGCGTCCGGCGGAGGAGGGTCGGGAGGCGGG CCTCCGGCGGCGGCGGTTCGGACATCCAGCTGACCCAGTCCCCATCCTCA CTGAGCGCAAGCGTGGGCGACAGAGTCACCATTACATGCAGGGCGTCCCA GAGCATCAGCTCCTACCTGAACTGGTACCAACAGAAGCCTGGAAAGGCTC CTAAGCTGTTGATCTACGGGGCTTCGACCCTGGCATCCGGGGTGCCCGCG AGGTTTAGCGGAAGCGGTAGCGGCACTCACTTCACTCTGACCATTAACAG CCTCCAGTCCGAGGATTCAGCCACTTACTACTGTCAGCAGTCCTACAAGC GGGCCAGCTTCGGACAGGGCACTAAGGTCGAGATCAAG |
| 139101-aa VH | 273 | QVQLQESGGGLVQPGGSLRLSCAASGFTFSSDAMTWVRQAPGKGLEWVSV ISGSGGTTYYADSVKGRFTISRDNSKNTLYLQMNSLRAEDTAVYYCAKLD SSGYYYARGPRYWGQGTLVTVSS |
| 139101-aa VL | 288 | DIQLTQSPSSLSASVGDRVTITCRASQSISSYLNWYQQKPGKAPKLLIYG ASTLASGVPARFSGSGSGTHFTLTINSLQSEDSATYYCQQSYKRASFGQG TKVEIK |
| 139102 | | |
| 139102-aa ScFv domain | 244 | QVQLVQSGAEVKKPGASVKVSCKASGYTFSNYGITWVRQAPGQGLEWMGW ISAYNGNTNYAQKFQGRVTMTRNTSISTAYMELSSLRSEDTAVYYCARGP YYYYMDVWGKGTMVTVSSASGGGGSGGRASGGGGSEIVMTQSPLSLPVTP GEPASISCRSSQSLLYSNGYNYVDWYLQKPGQSPQLLIYLGSNRASGVPD RFSGSGSGTDFKLQISRVEAEDVGIYYCMQGRQFPYSFGQGTKVEIK |
| 139102-nt ScFv domain | 259 | CAAGTCCAACTGGTCCAGAGCGGTGCAGAAGTGAAGAAGCCCGGAGCGAG CGTGAAAGTGTCCTGCAAGGCTTCCGGGTACACCTTCTCCAACTACGGCA TCACTTGGGTGCGCCAGGCCCCGGGACAGGGCCTGGAATGGATGGGGTGG ATTTCCGCGTACAACGGCAATACGAACTACGCTCAGAAGTTCCAGGGTAG AGTGACCATGACTAGGAACACCTCCATTTCCACCGCCTACATGGAACTGT CCTCCCTGCGGAGCGAGGACACCGCCGTGTACTATTGCGCCCGGGGACCA TACTACTACTACATGGATGTCTGGGGGAAGGGGACTATGGTCACCGTGTC ATCCGCCTCGGGAGGCGGCGGATCAGGAGGACGCGCCTCTGGTGGTGGAG GATCGGAGATCGTGATGACCCAGAGCCCTCTCTCCTTGCCCGTGACTCCT GGGGAGCCCGCATCCATTTCATGCCGGAGCTCCCAGTCACTTCTCTACTC CAACGGCTATAACTACGTGGATTGGTACCTCCAAAAGCCGGGCCAGAGCC CGCAGCTGCTGATCTACCTGGGCTCGAACAGGGCCAGCGGAGTGCCTGAC CGGTTCTCCGGGTCGGAAGCGGGACCGACTTCAAGCTGCAAATCTCGAG AGTGGAGGCCGAGGACGTGGGAATCTACTACTGTATGCAGGGCCGCCAGT TTCCGTACTCGTTCGGACAGGGCACCAAAGTGGAAATCAAG |
| 139102-aa VH | 274 | QVQLVQSGAEVKKPGASVKVSCKASGYTFSNYGITWVRQAPGQGLEWMGW ISAYNGNTNYAQKFQGRVTMTRNTSISTAYMELSSLRSEDTAVYYCARGP YYYYMDVWGKGTMVTVSS |
| 139102-aa VL | 289 | EIVMTQSPLSLPVTPGEPASISCRSSQSLLYSNGYNYVDWYLQKPGQSPQ LLIYLGSNRASGVPDRFSGSGSGTDFKLQISRVEAEDVGIYYCMQGRQFP YSFGQGTKVEIK |
| 139104 | | |
| 139104-aa ScFv domain | 245 | EVQLLETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSAGGGGSGGRASGGGGSEIVLTQSPATLSVSPGES ATLSCRASQSVSSNLAWYQQKPGQAPRLLIYGASTRASGIPDRFSGSGSG TDFTLTISSLQAEDVAVYYCQQYGSSLTFGGGTKVEIK |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| 139104-nt ScFv domain | 260 | GAAGTGCAATTGCTCGAAACTGGAGGAGGTCTGGTGCAACCTGGAGGATC ACTTCGCCTGTCCTGCGCCGTGTCGGGCTTTGCCCTGTCCAACCATGGAA TGAGCTGGGTCCGCCGCGCGCCGGGGAAGGGCCTCGAATGGGTGTCCGGC ATCGTCTACTCCGGCTCCACCTACTACGCCGCGTCCGTGAAGGGCCGGTT CACGATTTCACGGGACAACTCGCGGAACACCCTGTACCTCCAAATGAATT CCCTTCGGCCGGAGGATACTGCCATCTACTACTGCTCCGCCCACGGTGGC GAATCCGACGTCTGGGGCCAGGGAACCACCGTGACCGTGTCCAGCGCGTC CGGGGGAGGAGGAAGCGGGGGTAGAGCATCGGGTGGAGGCGGATCAGAGA TCGTGCTGACCCAGTCCCCCGCCACCTTGAGCGTGTCACCAGGAGAGTCC GCCACCCTGTCATGCCGCGCCAGCCAGTCCGTGTCCTCCAACCTGGCTTG GTACCAGCAGAAGCCGGGGCAGGCCCCTAGACTCCTGATCTATGGGGCGT CGACCCGGGCATCTGGAATTCCCGATAGGTTCAGCGGATCGGGCTCGGGC ACTGACTTCACTCTGACCATCTCCTCGCTGCAAGCCGAGGACGTGGCTGT GTACTACTGTCAGCAGTACGGAAGCTCCCTGACTTTCGGTGGCGGGACCA AAGTCGAGATTAAG |
| 139104-aa VH | 275 | EVQLLETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139104-aa VL | 290 | EIVLTQSPATLSVSPGESATLSCRASQSVSSNLAWYQQKPGQAPRLLIYG ASTRASGIPDRFSGSGSGTDFTLTISSLQAEDVAVYYCQQYGSSLTFGGG TKVEIK |
| 139106 | | |
| 139106-aa ScFv domain | 246 | EVQLVETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSEIVMTQSPAILSVSPGER ATLSCRASQSVSSKLAWYQQKPGQAPRLLMYGASIRATGIPDRFSGSGSG TEFTLTISSLEPEDFAVYYCQQYGSSSWTFGQGTKVEIK |
| 139106-nt ScFv domain | 261 | GAAGTGCAATTGGTGGAAACTGGAGGAGGACTTGTGCAACCTGGAGGATC ATTGAGACTGAGCTGCGCAGTGTCGGATTCGCCCTGAGCAACCATGGAA TGTCCTGGGTCAGAAGGGCCCCTGGAAAAGGCCTCGAATGGGTGTCAGGG ATCGTGTACTCCGGTTCCACTTACTACGCCGCCTCCGTGAAGGGCGCTT CACTATCTCACGGGATAACTCCCGCAATACCCTGTACCTCCAAATGAACA GCCTGCGGCCGGAGGATACCGCCATCTACTACTGTTCCGCCCACGGTGGA GAGTCTGACGTCTGGGGCCAGGGAACTACCGTGACCGTGTCCTCCGCGTC CGGCGGTGGAGGGAGCGGCGGCCGCGCCAGCGGCGGCGGAGGCTCCGAGA TCGTGATGACCCAGAGCCCCGCTACTCTGTCGGTGTCGCCCGGAGAAAGG GCGACCCTGTCCTGCCGGGCGTCGCAGTCCGTGAGCAGCAAGCTGGCTTG GTACCAGCAGAAGCCGGGCCAGGCACCACGCCTGCTTATGTACGGTGCCT CCATTCGGGCCACCGGAATCCCGGACCGGTTCTCGGGGTCGGGGTCCGGT ACCGAGTTCACACTGACCATTTCCTCGCTCGAGCCCGAGGACTTTGCCGT CTATTACTGCCAGCAGTACGGCTCCTCCTCATGGACGTTCGGCCAGGGGA CCAAGGTCGAAATCAAG |
| 139106-aa VH | 276 | EVQLVETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139106-aa VL | 291 | EIVMTQSPATLSVSPGERATLSCRASQSVSSKLAWYQQKPGQAPRLLMYG ASIRATGIPDRFSGSGSGTEFTLTISSLEPEDFAVYYCQQYGSSSWTFGQ GTKVEIK |
| 139107 | | |
| 139107-aa ScFv domain | 247 | EVQLVETGGGVVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSEIVLTQSPGTLSLSPGER ATLSCRASQSVGSTNLAWYQQKPGQAPRLLIYDASNRATGIPDRFSGGGS GTDFTLTISRLEPEDFAVYYCQQYGSSPPWTFGQGTKVEIK |
| 139107-nt ScFv domain | 262 | GAAGTGCAATTGGTGGAGACTGGAGGAGGAGTGGTGCAACCTGGAGGAAG CCTGAGACTGTCATGCGCGGTGTCGGCTTCGCCCTCTCCAACCACGGAAA TGTCCTGGGTCCGCCGGGCCCCTGGGAAAGGACTTGAATGGGTGTCCGGC ATCGTGTACTCGGGTTCCACCTACTACGCGGCCTCAGTGAAGGGCCGGTT TACTATTAGCCGCGACAACTCCAGAAACACACTGTACCTCCAAATGAACT CGCTGCGGCCGGAAGATACCGCTATCTACTACTGCTCCGCCCATGGGGGA GAGTCGGACGTCTGGGGACAGGGCACCACTGTCACTGTGTCCAGCGCTTC CGGCGGTGGTGAAGCGGGGAGCGGGCCTCAGGAGGCGGTGGCAGCGAGA TTGTGCTGACCCAGTCCCCCGGGACCCTGAGCCTGTCCCGGGAGAAAGG GCCACCCTCTCCTGTCGGGCATCCCAGTCCGTGGGTCTACTAACCTTGC ATGGTACCAGCAGAAGCCCGGCCAGGCCCCTCGCCTGCTGATCTACGACG CGTCCAATAGAGCCACCGGCATCCCGGATCGCTTCAGCGGAGGCGGATCG GGCACCGACTTCACCCTCACCATTTCAAGGCTGGAACCGGAGGACTTCGC |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| | | CGTGTACTACTGCCAGCAGTATGGTTCGTCCCCACCCTGGACGTTCGGCC AGGGGACTAAGGTCGAGATCAAG |
| 139107-aa VH | 277 | EVQLVETGGGVVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139107-aa VL | 292 | EIVLTQSPGTLSLSPGERATLSCRASQSVGSTNLAWYQQKPGQAPRLLIY DASNRATGIPDRFSGGGSGTDFTLTISRLEPEDFAVYYCQQYGSSPPWTF GQGTKVEIK |
| 139108 | | |
| 139108-aa ScFv domain | 248 | QVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARES GDGMDVWGQGTTVTVSSASGGGGSGGRASGGGGSDIQMTQSPSSLSASVG DRVTITCRASQSISSYLNWYQQKPGKAPKLLIYAASSLQSGVPSRFSGSG SGTDFTLTISSLQPEDFATYYCQQSYTLAFGQGTKVDIK |
| 139108-nt ScFv domain | 263 | CAAGTGCAACTCGTGGAATCTGGTGGAGGACTCGTGAAACCTGGAGGATC ATTGAGACTGTCATGCGCGGCCTCGGGATTCACGTTCTCCGATTACTACA TGAGCTGGATTCGCCAGGCTCCGGGGAAGGGACTGGAATGGGTGTCCTAC ATTTCCTCATCCGGCTCCACCATCTACTACGCGGACTCCGTGAAGGGGAG ATTCACCATTAGCCGCGATAACGCCAAGAACAGCCTGTACCTTCAGATGA ACTCCCTGCGGGCTGAAGATACTGCCGTCTACTACTGCGCAAGGGAGAGC GGAGATGGGATGGACGTCTGGGGACAGGGTACCACTGTGACCGTGTCGTC GGCCTCCGGCGAGGGGGTTCGGGTGGAAGGGCCAGCGGCGGCGGAGGCA GCGACATCCAGATGACCCAGTCCCCCTCATCGCTGTCCGCCTCCGTGGGC GACCGCGTCACCATCACATGCCGGGCCTCACAGTCGATCTCCTCCTACCT CAATTGGTATCAGCAGAAGCCCGGAAAGGCCCCTAAGCTTCTGATCTACG CAGCGTCCTCCCTGCAATCCGGGGTCCCATCTCGGTTCTCCGGCTCGGGC AGCGGTACCGACTTCACTCTGACCATCTCGAGCCTGCAGCCGGAGGACTT CGCCACTTACTACTGTCAGCAAAGCTACACCCTCGCGTTTGGCCAGGGCA CCAAAGTGGACATCAAG |
| 139108-aa VH | 278 | QVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARES GDGMDVWGQGTTVTVSS |
| 139108-aa VL | 293 | DIQMTQSPSSLSASVGDRVTITCRASQSISSYLNWYQQKPGKAPKLLIYA ASSLQSGVPSRFSGSGSGTDFTLTISSLQPEDFATYYCQQSYTLAFGQGT KVDIK |
| 139110 | | |
| 139110-aa ScFv domain | 250 | QVQLVQSGGGLVKPGGSLRLSCAASGFTFSDYYMSWIRQAPGKGLEWVSY ISSSGNTIYYADSVKGRFTISRDNAKNSLYLQMNSLRAEDTAVYYCARST MVREDYWGQGTLVTVSSASGGGGSGGRASGGGGSDIVLTQSPLSLPVTLG QPASISCKSSESLVHNSGKTYLNWFHQRPGQSPRRLIYEVSNRDSGVPDR FTGSGSGTDFTLKISRVEAEDVGVYYCMQGTHWPGTFGQGTKLEIK |
| 139110-nt ScFv domain | 265 | CAAGTGCAACTGGTGCAAAGCGGAGGAGGATTGGTCAAACCCGGAGGAAG CCTGAGACTGTCATGCGCGGCCTCTGGATTCACCTTCTCCGATTACTACA TGTCATGGATCAGACAGGCCCCGGGGAAGGGCCTCGAATGGGTGTCCTAC ATCTCGTCCTCCGGGAACACCATCTACTACGCCGACAGCGTGAAGGGCCG CTTTACCATTTCCCGCGACAACGCAAAGAACTCGCTGTACCTTCAGATGA ATTCCCTGCGGGCTGAAGATACCGCGGTGTACTATTGCGCCCGGTCCACT ATGGTCCGGGAGGACTACTGGGGACAGGGCACACTCGTGACCGTGTCCAG CGCGAGCGGGGTGGAGGCAGCGGTGGACGCGCCTCCGGCGGCGGCGGTT CAGACATCGTGCTGACTCAGTCGCCCCTGTCGCTGCCGGTCACCCTGGGC CAACCGGCCTCAATTAGCTGCAAGTCCTCGGAGAGCCTGGTGCACAACTC AGGAAAGACTTACCTGAACTGGTTCCATCAGCGGCCTGGACAGTCCCCAC GGAGGCTCATCTATGAAGTGTCCAACAGGGATTCGGGGGTGCCCGACCGC TTCACTGGCTCCGGGTCCGGCACCGACTTCACCTTGAAAATCTCCAGAGT GGAAGCCGAGGACGTGGGCGTGTACTACTGTATGCAGGGTACCCACTGGC CTGGAACCTTTGGACAAGGAACTAAGCTCGAGATTAAG |
| 139110-aa VH | 280 | QVQLVQSGGGLVKPGGSLRLSCAASGFTFSDYYMSWIRQAPGKGLEWVSY ISSSGNTIYYADSVKGRFTISRDNAKNSLYLQMNSLRAEDTAVYYCARST MVREDYWGQGTLVTVSS |
| 139110-aa VL | 295 | DIVLTQSPLSLPVTLGQPASISCKSSESLVHNSGKTYLNWFHQRPGQSPR RLIYEVSNRDSGVPDRFTGSGSGTDFTLKISRVEAEDVGVYYCMQGTHWP GTFGQGTKLEIK |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| 139112 | | |
| 139112-aa ScFv domain | 251 | QVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSDIRLTQSPSPLSASVGDR VTITCQASEDINKFLNWYHQTPGKAPKLLIYDASTLQTGVPSRFSGSGSG TDFTLTINSLQPEDIGTYYCQQYESLPLTFGGGTKVEIK |
| 139112-nt ScFv domain | 266 | CAAGTGCAACTCGTGGAATCTGGTGGAGGACTCGTGCAACCCGGTGGAAG CCTTAGGCTGTCGTGCGCCGTCAGCGGGTTTGCTCTGAGCAACCATGGAA TGTCCTGGGTCCGCCGGGCACCGGGAAAGGGCTGGAATGGGTGTCCGGC ATCGTGTACAGCGGGTCAACCTATTACGCCGCGTCCGTGAAGGGCAGATT CACTATCTCAAGAGACAACAGCCGGAACACCCTGTACTTGCAAATGAATT CCCTGCGCCCCGAGGACACCGCCATCTACTACTGCTCCGCCCACGGAGGA GAGTCGGACGTGTGGGGCCAGGGAACGACTGTGACTGTGTCCAGCGCATC AGGAGGGGGTGGTTCGGGCGGCCGGGCCTCGGGGGGAGGAGGTTCCGACA TTCGGCTGACCCAGTCCCCGTCCCACTGTCGGCCTCCGTCGGCGACCGC GTGACCATCACTTGTCAGGCGTCCGAGGACATTAACAAGTTCCTGAACTG GTACCACCAGACCCCTGGAAAGGCCCCAAGCTGCTGATCTACGATGCCT CGACCCCTTCAAACTGGAGTGCCTAGCCGGTTCTCCGGGTCCGGCTCCGGC ACTGATTTCACTCTGACCATCAACTCATTGCAGCCGGAAGATATCGGGAC CTACTATTGCCAGCAGTACGAATCCCTCCCGCTCACATTCGGCGGGGAA CCAAGGTCGAGATTAAG |
| 139112-aa VH | 281 | QVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139112-aa VL | 296 | DIRLTQSPSPLSASVGDRVTITCQASEDINKFLNWYHQTPGKAPKLLIYD ASTLQTGVPSRFSGSGSGTDFTLTINSLQPEDIGTYYCQQYESLPLTFGG GTKVEIK |
| 139113 | | |
| 139113-aa ScFv domain | 252 | EVQLVETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSETTLTQSPAILSVSPGER ATLSCRASQSVGSNLAWYQQKPGQGPRLLIYGASTRATGIPARFSGSGSG TEFTLTISSLQPEDFAVYYCQQYNDWLPVTFGQGTKVEIK |
| 139113-nt ScFv domain | 267 | GAAGTGCAATTGGTGGAAACTGGAGGAGGACTTGTGCAACCTGGAGGATC ATTGCGGCTCTCATGCGCTGTCTCCGGCTTCGCCCTGTCAAATCACGGGA TGTCGTGGGTCAGACGGGCCCCGGGAAAGGGTCTGGAATGGGTGTCGGGG ATTGTGTACAGCGGCTCCACCTACTACGCCGCTTCGGTCAAGGGCCGCTT CACTATTTCACGGGACAACAGCCGCAACACCCTCTATCTGCAAATGAACT CTCTCCGCCCCGAGGATACCGCCATCTACTACTGCTCCGCACACGGCGGC GAATCCGACGTGTGGGGACAGGGAACCACTGTCACCGTGTCGTCCGCATC CGGTGGCGGAGGATCGGGTGGCCGGGCCTCCGGGGGCGGCGGCAGCGAGA CTACCCTGACCCAGTCCCCTGCCACTCTGTCCGTGAGCCCGGGAGAGAGA GCCACCCTTAGCTGCCGGGCCAGCCAGAGCGTGGGCTCCAACCTGGCCTG GTACCAGCAGAAGCCAGGACAGGGTCCCAGGCTGCTGATCTACGGAGCCT CCACTCGCGCGACCGGCATCCCCGCGAGGTTCTCCGGGTCGGGTTCCGGG ACCGAGTTCACCCTGACCATCTCCTCCCTCCAACCGGAGGACTTCGCGGT GTACTACTGTCAGCAGTACAACGATTGGCTGCCCGTGACATTTGGACAGG GGACGAAGGTGGAAATCAAA |
| 139113-aa VH | 282 | EVQLVETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139113-aa VL | 297 | ETTLTQSPATLSVSPGERATLSCRASQSVGSNLAWYQQKPGQGPRLLIYG ASTRATGIPARFSGSGSGTEFTLTISSLQPEDFAVYYCQQYNDWLPVTFG QGTKVEIK |
| 139114 | | |
| 139114-aa ScFv domain | 253 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSEIVLTQSPGTLSLSPGER ATLSCRASQSIGSSSLAWYQQKPGQAPRLLMYGASSRASGIPDRFSGSGS GTDFTLTISRLEPEDFAVYYCQQYAGSPPFTFGQGTKVEIK |
| 139114-nt ScFv domain | 268 | GAAGTGCAATTGGTGGAATCTGGTGGAGGACTTGTGCAACCTGGAGGATC ACTGAGACTGTCATGCGCGGTGTCCGGTTTTGCCCTGAGCAATCATGGGA TGTCGTGGGTCCGGCGCGCCCCCGGAAAGGGTCTGGAATGGGTGTCGGGT ATCGTCTACTCCGGGAGCACTTACTACGCCGCGAGCGTGAAGGGCCGCTT CACCATTTCCCGCGATAACTCCCGCAACACCCTGTACTTGCAAATGAACT |

TABLE 8-continued

Antigen Binding domains that bind BCMA
The amino acid sequences of variable heavy chain and variable light chain sequences for each scFv are also provided.

| Name/ Description | SEQ ID NO: | Sequence |
| --- | --- | --- |
| | | CGCTCCGGCCTGAGGACACTGCCATCTACTACTGCTCCGCACACGGAGGA GAATCCGACGTGTGGGGCCAGGGAACTACCGTGACCGTCAGCAGCGCCTC CGGCGGCGGGGGCTCAGGCGGACGGGCTAGCGGCGGCGGTGGCTCCGAGA TCGTGCTGACCCAGTCGCCTGGCACTCTCTCGCTGAGCCCCGGGGAAAGG GCAACCCTGTCCTGTCGGGCCAGCCAGTCCATTGGATCATCCTCCCTCGC CTGGTATCAGCAGAAACCGGGACAGGCTCCGGCTGCTTATGTATGGGG CCAGCTCAAGAGCCTCCGGCATTCCCGACCGGTTCTCCGGGTCCGGTTCC GGCACCGATTTCACCCTGACTATCTCGAGGCTGGAGCCAGAGGACTTCGC CGTGTACTACTGCCAGCAGTACGCGGGGTCCCCGCCGTTCACGTTCGGAC AGGGAACCAAGGTCGAGATCAAG |
| 139114-aa VH | 283 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139114-aa VL | 298 | EIVLTQSPGILSLSPGERATLSCRASQSIGSSSLAWYQQKPGQAPRLLMY GASSRASGIPDRFSGSGSGTDFTLTISRLEPEDFAVYYCQQYAGSPPFTF GQGTKVEIK |
| 149362 | | |
| 149362-aa ScFv domain | 329 | QVQLQESGPGLVKPSETLSLTCTVSGGSISSSYYYWGWIRQPPGKGLEWI GSIYYSGSAYYNPSLKSRVTISVDTSKNQFSLRLSSVTAADTAVYYCARH WQEWPDAFDIWGQGTMVTVSSGGGGSGGGGSGGGGSETTLTQSPAFMSAT PGDKVIISCKASQDIDDAMNWYQQKPGEAPLFIIQSATSPVPGIPPRFSG SGFGTDFSLTINNIESEDAAYYFCLQHDNFPLTFGQGTKLEIK |
| 149362-nt ScFv domain | 350 | CAAGTGCAGCTTCAGGAAAGCGGACCGGGCCTGGTCAAGCCATCCGAAAC TCTCTCCCTGACTTGCACTGTGTCTGGCGGTTCCATCTCATCGTCGTACT ACTACTGGGGCTGGATTAGGCAGCCGCCCGGAAAGGGACTGGAGTGGATC GGAAGCATCTACTATTCCGGCTCGGCGTACTACAACCCTAGCCTCAAGTC GAGAGTGACCATCTCCGTGGATACCTCCAAGAACCAGTTTTCCCTGCGCC TGAGCTCCGTGACCGCCGCTGACACCGCCGTGTACTACTGTGCTCGGCAT TGGCAGGAATGGCCCGATGCCTTCGACATTTGGGGCCAGGGCACTATGGT CACTGTGTCATCCGGGGGTGGAGGCAGCGGGGAGGAGGGTCCGGGGGGG GAGGTTCAGAGACAACCTTGACCCAGTCACCCGCATTCATGTCCGCCACT CCGGGAGACAAGGTCATCATCTCGTGCAAAGCGTCCCAGGATATCGACGA TGCCATGAATTGGTACCAGCAGAAGCCTGGCGAAGCGCCGCTGTTCATTA TCCAATCCGCAACCTCGCCCGTGCCTGGAATCCCACCGCGGTTCAGCGGC AGCGGTTTCGGAACGGACTTTTCCCTGACCATTAACAACATTGAGTCCGA GGACGCCGCCTACTACTTCTGCCTGCAACACGACAACTTCCCTCTCACGT TCGGCCAGGGAACCAAGCTGGAAATCAAG |
| 149362-aa VH | 371 | QVQLQESGPGLVKPSETLSLTCTVSGGSISSSYYYWGWIRQPPGKGLEWI GSIYYSGSAYYNPSLKSRVTISVDTSKNQFSLRLSSVTAADTAVYYCARH WQEWPDAFDIWGQGTMVTVSS |
| 149362-aa VL | 392 | ETTLTQSPAFMSATPGDKVIISCKASQDIDDAMNWYQQKPGEAPLFIIQS ATSPVPGIPPRFSGSGFGTDFSLTINNIESEDAAYYFCLQHDNFPLTFGQ GTKLEIK |
| 149363 | | |
| 149363-aa ScFv domain | 330 | QVNLRESGPALVKPTQTLTLTCTFSGFSLRTSGMCVSWIRQPPGKALEWL ARIDWDEDKFYSTSLKTRLTISKDTSDNQVVLRMTNMDPADTATYYCARS GAGGTSATAFDIWGPGTMVTVSSGGGGSGGGGSGGGGSDIQMTQSPSSLS ASVGDRVTITCRASQDIYNNLAWFQLKPGSAPRSLMYAANKSQSGVPSRF SGSASGTDFTLTISSLQPEDFATYYCQHYYRFPYSFGQGTKLEIK |
| 149363-nt ScFv domain | 351 | CAAGTCAATCTGCGCGAATCCGGCCCCGCCTTGGTCAAGCCTACCCAGAC CCTCACTCTGACCTGTACTTTCTCCGGCTTCTCCCTGCGGACTTCCGGGA TGTGCGTGTCCTGGATCAGACAGCCTCCGGGAAAGGCCCTGGAGTGGCTC GCTCGCATTGACTGGGATGAGGACAAGTTCTACTCCACCTCACTCAAGAC CAGGCTGACCATCAGCAAAGATACCTCTGACAACCAAGTGGTGCTCCGCA TGACCAACATGGACCCAGCCGACACTGCCACTTACTACTGCGCGAGGAGC GGAGCGGGCGGAACCTCCGCCACCGCCTTCGATATTTGGGGCCCGGGTAC CATGGTCACCGTGTCAAGCGGAGGAGGGGGTCCGGGGGCGGCGGTTCCG GGGGAGGCGGATCGGACATTCAGATGACTCAGTCACCATCGTCCCTGAGC GCTAGCGTGGGCGACAGAGTGACAATCACTTGCCGGGCATCCCAGGACAT CTATAACAACCTTGCGTGGTTCCAGCTGAAGCCTGGTTCCGCACCGCGGT CACTTATGTACGCCGCCAACAAGAGCCAGTCGGGAGTGCCGTCCCGGTTT TCCGGTTCGGCCTCGGGAACTGACTTCACCCTGACGATCTCCAGCCTGCA ACCCGAGGATTTCGCCACCTACTACTGCCAGCACTACTACCGCTTTCCCT ACTCGTTCGGACAGGGAACCAAGCTGGAAATCAAG |
| 149363-aa VH | 372 | QVNLRESGPALVKPTQTLTLICTFSGFSLRTSGMCVSWIRQPPGKALEWL ARIDWDEDKFYSTSLKTRLTISKDTSDNQVVLRMTNMDPADTATYYCARS GAGGTSATAFDIWGPGTMVTVSS |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| 149363-aa VL | 393 | DIQMTQSPSSLSASVGDRVTITCRASQDIYNNLAWFQLKPGSAPRSLMYA ANKSQSGVPSRFSGSASGTDFTLTISSLQPEDFATYYCQHYYRFPYSFGQ GTKLEIK |
| 149364 | | |
| 149364-aa ScFv domain | 331 | EVQLVESGGGLVKPGGSLRLSCAASGFTFSSYSMNWVRQAPGKGLEWVSS ISSSSSYIYYADSVKGRFTISRDNAKNSLYLQMNSLRAEDTAVYYCAKTI AAVYAFDIWGQGTTVTVSSGGGGSGGGGSGGGGSEIVLTQSPLSLPVTPE EPASISCRSSQSLLHSNGYNYLDWYLQKPGQSPQLLIYLGSNRASGVPDR FSGSGSGTDFTLKISRVEAEDVGVYYCMQALQTPYTFGQGTKLEIK |
| 149364-nt ScFv domain | 352 | GAAGTGCAGCTTGTCGAATCCGGGGGGGGACTGGTCAAGCCGGGCGGATC ACTGAGACTGTCCTGCGCCGCGAGCGGCTTCACGTTCTCCTCCTACTCCA TGAACTGGGTCCGCCAAGCCCCCGGGAAGGGACTGGAATGGGTGTCCTCT ATCTCCTCGTCGTCGTCCTACATCTACTACGCCGACTCCGTGAAGGGAAG ATTCACCATTTCCCGCGACAACGCAAAGAACTCACTGTACTTGCAAATGA ACTCACTCCGGGCCGAAGATACTGCTGTGTACTATTGCGCCAAGACTATT GCCGCCGTCTACGCTTTCGACATCTGGGGCCAGGGAACCACCGTGACTGT GTCGTCCGGTGGTGGTGGCTCGGGCGGAGGAGGAAGCGGCGGCGGGGGGT CCGAGATTGTGCTGACCCAGTCGCCACTGAGCCTCCCTGTGACCCCCGAG GAACCCGCCAGCATCAGCTGCCGGTCCAGCCAGTCCCTGCTCCACTCCAA CGGATACAATTACCTCGATTGGTACCTTCAGAAGCCTGGACAAAGCCCGC AGCTGCTCATCTACTTGGGATCAAACCGCGCGTCAGGAGTGCCTGACCGG TTCTCCGGCTCGGGCAGCGGTACCGATTTCACCCTGAAAATCTCCAGGGT GGAGGCAGAGGACGTGGGAGTGTATTACTGTATGCAGGCGCTGCAGACTC CGTACACATTTGGGCAGGGCACCAAGCTGGAGATCAAG |
| 149364-aa VH | 373 | EVQLVESGGGLVKPGGSLRLSCAASGFTFSSYSMNWVRQAPGKGLEWVSS ISSSSSYIYYADSVKGRFTISRDNAKNSLYLQMNSLRAEDTAVYYCAKTI AAVYAFDIWGQGTTVTVSS |
| 149364-aa VL | 394 | EIVLTQSPLSLPVTPEEPASISCRSSQSLLHSNGYNYLDWYLQKPGQSPQ LLIYLGSNRASGVPDRFSGSGSGTDFTLKISRVEAEDVGVYYCMQALQTP YTFGQGTKLEIK |
| 149365 | | |
| 149365-aa ScFv domain | 332 | EVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARDL RGAFDIWGQGTMVTVSSGGGGSGGGGSGGGGSSYVLTQSPSVSAAPGYTA TISCGGNNIGTKSVHWYQQKPGQAPLLVIRDDSVRPSKIPGRFSGSNSGN MATLTISGVQAGDEADFYCQVWDSDSEHVVFGGGTKLTVL |
| 149365-nt ScFv domain | 353 | GAAGTCCAGCTCGTGGAGTCCGGCGGAGGCCTTGTGAAGCCTGGAGGTTC GCTGAGACTGTCCTGCGCCGCCTCCGGCTTCACCTTCTCGGACTACTACA TGTCCTGGATCAGACAGGCCCCGGGAAAGGGCCTGGAATGGGTGTCCTAC ATCTCGTCATCGGGCAGCACTATCTACTACGCGGACTCAGTGAAGGGGCG GTTCACCATTTCCCGGGATAACGCGAAGAACTCGCTGTATCTGCAAATGA ACTCACTGAGGGCCGAGGACACCGCCGTGTACTACTGCGCCCGCGATCTC CGCGGGGCATTTGACATCTGGGGACAGGGAACCATGGTCACAGTGTCCAG CGGAGGGGGAGGATCGGGTGGCGGAGGTTCCGGGGGTGGAGGCTCCTCCT ACGTGCTGACTCAGAGCCCAAGCGTCAGCGCTGCGCCCGGTTACACGGCA ACCATCTCCTGTGGCGGAAACAACATTGGGACCAAGTCTGTGCACTGGTA TCAGCAGAAGCCGGGCCAAGCTCCCCTGTTGGTGATCCGCGATGACTCCG TGCGGCCTAGCAAAATTCCGGGACGGTTCTCCGGCTCCAACAGCGGCAAT ATGGCCACTCTCACCATCTCGGGAGTGCAGGCCGGAGATGAAGCCGACTT CTACTGCCAAGTCTGGGACTCAGACTCCGAGCATGTGGTGTTCGGGGCG GAACCAAGCTGACTGTGCTC |
| 149365-aa VH | 374 | EVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARDL RGAFDIWGQGTMVTVSS |
| 149365-aa VL | 395 | SYVLTQSPSVSAAPGYTATISCGGNNIGTKSVHWYQQKPGQAPLLVIRDD SVRPSKIPGRFSGSNSGNMATLTISGVQAGDEADFYCQVWDSDSEHVVFG GGTKLTVL |
| 149366 | | |
| 149366-aa ScFv domain | 333 | QVQLVQSGAEVKKPGASVKVSCKPSGYTVTSHYIHWVRRAPGQGLEWMGM INPSGGVTAYSQTLQGRVTMTSDTSSSTVYMELSSLRSEDTAMYYCAREG SGSGWYFDFWGRGTLVTVSSGGGGSGGGGSGGGGSSYVLTQPPSVSVSPG QTASITCSGDGLSKKYVSWYQQKAGQSPVVLISRDKERPSGIPDRFSGSN SADTATLTISGTQAMDEADYYCQAWDDTTVVFGGGTKLTVL |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| 149366-nt ScFv domain | 354 | CAAGTGCAGCTGGTGCAGAGCGGGGCCGAAGTCAAGAAGCCGGGAGCCTC CGTGAAAGTGTCCTGCAAGCCTTCGGGATACACCGTGACCTCCCACTACA TTCATTGGGTCCGCCGCGCCCCCGGCCAAGGACTCGAGTGGATGGGCATG ATCAACCCTAGCGGCGGAGTGACCGCGTACAGCCAGACGCTGCAGGGACG CGTGACTATGACCTCGGATACCTCCTCCTCCACCGTCTATATGGAACTGT CCAGCCTGCGGTCCGAGGATACCGCCATGTACTACTGCGCCCGGGAAGGA TCAGGCTCCGGGTGGTATTTCGACTTCTGGGGAAGAGGCACCCTCGTGAC TGTGTCATCTGGGGAGGGGGTTCCGGTGGTGGCGGATCGGGAGGAGGCG GTTCATCCTACGTGCTGACCCAGCCACCCTCCGTGTCCGTGAGCCCCGGC CAGACTGCATCGATTACATGTAGCGGCGACGGCCTCTCCAAGAAATACGT GTCGTGGTACCAGCAGAAGGCCGGACAGAGCCCGGTGGTGCTGATCTCAA GAGATAAGGAGCGGCCTAGCGGAATCCCGGACAGGTTCTCGGGTTCCAAC TCCGCGGACACTGCTACTCTGACCATCTCGGGGACCCAGGCTATGGACGA AGCCGATTACTACTGCCAAGCCTGGGACGACACTACTGTCGTGTTTGGAG GGGGCACCAAGTTGACCGTCCTT |
| 149366-aa VH | 375 | QVQLVQSGAEVKKPGASVKVSCKPSGYTVTSHYIHWVRRAPGQGLEWMGM INPSGGVTAYSQTLQGRVTMTSDTSSSTVYMELSSLRSEDTAMYYCAREG SGSGWYFDFWGRGTLVTVSS |
| 149366-aa VL | 396 | SYVLTQPPSVSVSPGQTASITCSGDGLSKKYVSWYQQKAGQSPVVLISRD KERPSGIPDRFSGSNSADTATLTISGTQAMDEADYYCQAWDDTTVVFGGG TKLTVL |
| 149367 | | |
| 149367-aa ScFv domain | 334 | QVQLQESGPGLVKPSQTLSLICTVSGGSISSGGYYWSWIRQHPGKGLEWI GYIYYSGSTYYNPSLKSRVTISVDTSKNQFSLKLSSVTAADTAVYYCARA GIAARLRGAFDIWGQGTMVTVSSGGGGSGGGGSGGGGSDIVMTQSPSSVS ASVGDRVIITCRASQGIRNWLAWYQQKPGKAPNLLIYAASNLQSGVPSRF SGSGSGADFTLTISSLQPEDVATYYCQKYNSAPFTFGPGTKVDIK |
| 149367-nt ScFv domain | 355 | CAAGTGCAGCTTCAGGAGAGCGGCCCGGGACTCGTGAAGCCGTCCCAGAC CCTGTCCCTGACTTGCACCGTGTCGGGAGGAAGCATCTCGAGCGGAGGCT ACTATTGGTCGTGGATTCGGCAGCACCCTGGAAAGGGCCTGGAATGGATC GGCTACATCTACTACTCCGGCTCGACCTACTACAACCCATCGCTGAAGTC CAGAGTGACAATCTCAGTGGACACGTCCAAGAATCAGTTCAGCCTGAAGC TCTCTTCCGTGACTGCGGCCGACACCGCCGTGTACTACTGCGCACGCGCT GGAATTGCCGCCCGGCTGAGGGGTGCCTTCGACATTTGGGGACAGGGCAC CATGGTCACCGTGTCCTCCGGCGGCGGAGGTTCCGGGGGTGGAGGCTCAG GAGGAGGGGGGTCCGACATCGTCATGACTCAGTCGCCCTCAAGCGTCAGC GCGTCCGTCGGGGACAGAGTGATCATCACCTGTCGGGCGTCCCAGGGAAT TCGCAACTGGCTGGCCTGGTATCAGCAGAAGCCCGGAAAGGCCCCCAACC TGTTGATCTACGCCGCCTCAAACCTCCAATCCGGGGTGCCGAGCCGCTTC AGCGGCTCCGGTTCGGGTGCCGATTTCACTCTGACCATCTCCTCCCTGCA ACCTGAAGATGTGGCTACCTACTACTGCCAAAAGTACAACTCCGCACCTT TTACTTTCGGACCGGGGACCAAAGTGGACATTAAG |
| 149367-aa VH | 376 | QVQLQESGPGLVKPSQTLSLTCTVSGGSISSGGYYWSWIRQHPGKGLEWI GYIYYSGSTYYNPSLKSRVTISVDTSKNQFSLKLSSVTAADTAVYYCARA GIAARLRGAFDIWGQGTMVTVSS |
| 149367-aa VL | 397 | DIVMTQSPSSVSASVGDRVIITCRASQGIRNWLAWYQQKPGKAPNLLIYA ASNLQSGVPSRFSGSGSGADFTLTISSLQPEDVATYYCQKYNSAPFTFGP GTKVDIK |
| 149368 | | |
| 149368-aa ScFv domain | 335 | QVQLVQSGAEVKKPGSSVKVSCKASGGTFSSYAISWVRQAPGQGLEWMGG IIPIFGTANYAQKFQGRVTITADESTSTAYMELSSLRSEDTAVYYCARRG GYQLLRWDVGLLRSAFDIWGQGTMVTVSSGGGGSGGGGSGGGGSSYVLIQ PPSVSVAPGQTARITCGGNNIGSKSVHWYQQKPGQAPVLVLYGKNNRPSG VPDRFSGSRSGTTASLTITGAQAEDEADYYCSSRDSSGDHLRVFGTGTKV TVL |
| 149368-nt ScFv domain | 356 | CAAGTGCAGCTGGTCCAGTCGGGCGCCGAGGTCAAGAAGCCCGGGAGCTC TGTGAAAGTGTCCTGCAAGGCCTCCGGGGCACCTTTAGCTCCTACGCCA TCTCCTGGGTCCGCCAAGCACCGGGTCAAGGCCTGGAGTGGATGGGGGGA ATTATCCCTATCTTCGGCACTGCCAACTACGCCCAGAAGTTCCAGGGACG CGTGACCATTACCGCGGACGAATCCACCTCCACCGCTTATATGGAGCTGT CCAGCTTGCGCTCGGAAGATACCGCCGTGTACTACTGCGCCCGGAGGGGT GGATACCAGCTGCTGAGATGGGACGTGGGCCTTCTGCGTTCGGCGTTCGA CATCTGGGGCCAGGGCACTATGGTCACTGTGTCCAGCGGAGGAGGCGGAT CGGGAGGCGGCGGATCAGGGGGAGGCGGTTCCAGCTACGTGCTTACTCAA CCCCCCTTCGGTGTCCGTGGCCCCGGGACAGACCGCCAGAATCACTTGCGG AGGAAACAACATTGGGTCCAAGAGCGTGCATTGGTACCAGCAGAAGCCAG GACAGGCCCCTGTGCTGGTGCTCTACGGGAAGAACAATCGGCCCAGCGGA |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| | | GTGCCGGACAGGTTCTCGGGTTCACGCTCCGGTACAACCGCTTCACTGAC TATCACCGGGGCCCAGGCAGAGGATGAAGCGGACTACTACTGTTCCTCCC GGGATTCATCCGGCGACCACCTCCGGGTGTTCGGAACCGGAACGAAGGTC ACCGTGCTG |
| 149368-aa VH | 377 | QVQLVQSGAEVKKPGSSVKVSCKASGGTFSSYAISWVRQAPGQGLEWMGG IIPIFGTANYAQKFQGRVTITADESTSTAYMELSSLRSEDTAVYYCARRG GYQLLRWDVGLLRSAFDIWGQGTMVTVSS |
| 149368-aa VL | 398 | SYVLTQPPSVSVAPGQTARITCGGNNIGSKSVHWYQQKPGQAPVLVLYGK NNRPSGVPDRFSGSRSGTTASLTITGAQAEDEADYYCSSRDSSGDHLRVF GTGTKVTVL |
| 149369 | | |
| 149369-aa ScFv domain | 336 | EVQLQQSGPGLVKPSQTLSLTCAISGDSVSSNSAAWNWIRQSPSRGLEWL GRTYYRSKWYSFYAISLKSRIIINPDTSKNQFSLQLKSVTPEDTAVYYCA RSSPEGLFLYWFDPWGQGTLVTVSSGGDGSGGGGSGGGGSSSELTQDPAV SVALGQTIRITCQGDSLGNYYATWYQQKPGQAPVLVIYGTNNRPSGIPDR FSASSSGNTASLTITGAQAEDEADYYCNSRDSSGHHLLFGTGTKVTVL |
| 149369-nt ScFv domain | 357 | GAAGTGCAGCTCCAACAGTCAGGACCGGGGCTCGTGAAGCCATCCCAGAC CCTGTCCCTGACTTGTGCCATCTCGGGAGATAGCGTGTCATCGAACTCCG CCGCCTGGAACTGGATTCGGCAGAGCCCGTCCCGCGGACTGGAGTGGCTT GGAAGGACCTACTACCGGTCCAAGTGGTACTCTTTCTACGCGATCTCGCT GAAGTCCCGCATTATCATTAACCCTGATACCTCCAAGAATCAGTTCTCCC TCCAACTGAAATCCGTCACCCCCGAGGACACAGCAGTGTATTACTGCGCA CGGAGCAGCCCCGAAGGACTGTTCCTGTATTGGTTTGACCCCTGGGGCCA GGGGACTCTTGTGACCGTGTCGAGCGGCGGAGATGGGTCCGGTGGCGGTG GTTCGGGGGGCGGCGGATCATCATCCGAACTGACCCAGGACCCGGCTGTG TCCGTGGCGCTGGGACAAACCATCCGCATTACGTGCCAGGGAGACTCCCT GGGCAACTACTACGCCACTTGGTACCAGCAGAAGCCGGGCCAAGCCCCTG TGTTGGTCATCTACGGGACCAACAACAGACCTTCCGGCATCCCCGACCGG TTCAGCGCTTCGTCCTCCGGCAACACTGCCAGCCTGACCATCACTGGAGC GCAGGCCGAAGATGAGGCCGACTACTACTGCAACAGCAGAGACTCCTCGG GTCATCACCTCTTGTTCGGAACTGGAACCAAGGTCACCGTGCTG |
| 149369-aa VH | 378 | EVQLQQSGPGLVKPSQTLSLTCAISGDSVSSNSAAWNWIRQSPSRGLEWL GRTYYRSKWYSFYAISLKSRIIINPDTSKNQFSLQLKSVTPEDTAVYYCA RSSPEGLFLYWFDPWGQGTLVTVSS |
| 149369-aa VL | 399 | SSELTQDPAVSVALGQTIRITCQGDSLGNYYATWYQQKPGQAPVLVIYGT NNRPSGIPDRFSASSSGNTASLTITGAQAEDEADYYCNSRDSSGHHLLFG TGTKVTVL |
| BCMA_EBB-C1978-A4 | | |
| BCMA_EBB- C1978-A4-aa ScFv domain | 337 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVE GSGSLDYWGQGTLVTVSSGGGGSGGGGSGGGGSEIVMTQSPGTLSLSPGE RATLSCRASQSVSSAYLAWYQQKPGQPPRLLISGASTRATGIPDRFGGSG SGTDFTLTISRLEPEDFAVYYCQHYGSSFNGSSLFTFGQGTRLEIK |
| BCMA_EBB- C1978-A4-nt ScFv domain | 358 | GAAGTGCAGCTCGTGGAGTCAGGAGGCGGCCTGGTCCAGCCGGGAGGGTC CCTTAGACTGTCATGCGCCGCAAGCGGATTCACTTTCTCCTCCTATGCCA TGAGCTGGGTCCGCCAAGCCCCCGGAAAGGGACTGGAATGGGTGTCCGCC ATCTCGGGGTCTGGAGGCTCAACTTACTACGCTGACTCCGTGAAGGGACG GTTCACCATTAGCCGCGACAACTCCAAGAACACCCTCTACCTCCAAATGA ACTCCCTGCGGGCCGAGGATACCGCCGTCTACTACTGCGCCAAAGTGGAA GGTTCAGGATCGCTGGACTACTGGGGACAGGGTACTCTCGTGACCGTGTC ATCGGGCGGAGGAGGTTCCGGCGGTGGCGGCTCCGGCGGCGGAGGGTCGG AGATCGTGATGACCCAGAGCCCTGGTACTCTGAGCCTTTCGCCGGGAGAA AGGGCCACCCTGTCCTGCCGCGCTTCCCAATCCGTGTCCTCCGCGTACTT GGCGTGGTACCAGCAGAAGCCGGGACAGCCCCCTCGGCTGCTGATCAGCG GGGCCAGCACCCGGGCAACCGGAATCCCAGACAGATTCGGGGGTTCCGGC AGCGGCACAGATTTCACCCTGACTATTTCGAGGTTGGAGCCCGAGGACTT TGCGGTGTATTACTGTCAGCACTACGGGTCGTCCTTTAATGGCTCCAGCC TGTTCACGTTCGGACAGGGGACCCGCCTGGAAATCAAG |
| BCMA_EBB- C1978-A4-aa VH | 379 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVE GSGSLDYWGQGTLVTVSS |
| BCMA_EBB- C1978-A4-aa VL | 400 | EIVMTQSPGTLSLSPGERATLSCRASQSVSSAYLAWYQQKPGQPPRLLIS GASTRATGIPDRFGGSGSGTDFTLTISRLEPEDFAVYYCQHYGSSFNGSS LFTFGQGTRLEIK |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| BCMA_EBB-C1978-G1 | | |
| BCMA_EBB-C1978-G1-aa ScFv domain | 338 | EVQLVETGGGLVQPGGSLRLSCAASGITFSRYPMSWVRQAPGKGLEWVSG ISDSGVSTYYADSAKGRFTISRDNSKNTLFLQMSSLRDEDTAVYYCVTRA GSEASDIWGQGTMVTVSSGGGGSGGGGSGGGGSEIVLTQSPATLSLSPGE RATLSCRASQSVSNSLAWYQQKPGQAPRLLIYDASSRATGIPDRFSGSGS GTDFTLTISRLEPEDFAIYYCQQFGTSSGLTFGGGTKLEIK |
| BCMA_EBB-C1978-G1-nt ScFv domain | 359 | GAAGTGCAACTGGTGGAAACCGGTGGCGGCCTGGTGCAGCCTGGAGGATC ATTGAGGCTGTCATGCGCGGCCAGCGGTATTACCTTCTCCCGGTACCCCA TGTCCTGGGTCAGACAGGCCCCGGGGAAAGGGCTTGAATGGGTGTCCGGG ATCTCGGACTCCGGTGTCAGCACTTACTACGCCGACTCCGCCAAGGGACG CTTCACCATTTCCCGGGACAACTCGAAGAACACCCTGTTCCTCCAAATGA GCTCCCTCCGGGACGAGGATACTGCAGTGTACTACTGCGTGACCCGCGCC GGGTCCGAGGCGTCTGACATTTGGGGACAGGGCACTATGGTCACCGTGTC GTCCGGCGGAGGGGGCTCGGGAGGCGGTGGCAGCGGAGGAGGAGGGTCCG AGATCGTGCTGACCCAATCCCCGGCCACCCTCTCGCTGAGCCCTGGAGAA AGGGCAACCTTGTCCTGTCGCGCGAGCCAGTCCGTGAGCAACTCCCTGGC CTGGTACCAGCAGAAGCCCGGACAGGCTCCGAGACTTCTGATCTACGACG CTTCGAGCCGGGCCACTGGAATCCCCGACCGCTTTTCGGGGTCCGGCTCA GGAACCGATTTCACCCTGACAATCTCACGGCTGGAGCCAGAGGATTTCGC CATCTATTACTGCCAGCAGTTCGGTACTTCCTCCGGCCTGACTTTCGGAG GCGGCACGAAGCTCGAAATCAAG |
| BCMA_EBB-C1978-G1-aa VH | 380 | EVQLVETGGGLVQPGGSLRLSCAASGITFSRYPMSWVRQAPGKGLEWVSG ISDSGVSTYYADSAKGRFTISRDNSKNTLFLQMSSLRDEDTAVYYCVTRA GSEASDIWGQGTMVTVSS |
| BCMA_EBB-C1978-G1-aa VL | 401 | EIVLTQSPATLSLSPGERATLSCRASQSVSNSLAWYQQKPGQAPRLLIYD ASSRATGIPDRFSGSGSGTDFTLTISRLEPEDFAIYYCQQFGTSSGLTFG GGTKLEIK |
| BCMA_EBB-C1979-C1 | | |
| BCMA_EBB-C1979-C1-aa ScFv domain | 339 | QVQLVESGGGLVQPGGSLRLSCAASGFTFSSYAMWVRQAPGKGLETAWSA ISGSGGSTYYADSVKGRFTISRDNAKNSLYLQMNSLRAEDTAIYYCARAT YKRELRYYYGMDVWGQGTMVTVSSGGGGSGGGGSGGGGSEIVMTQSPGTV SLSPGERATLSCRASQSVSSSFLAWYQQKPGQAPRLLIYGASSRATGIPD RFSGSGSGTDFTLTISRLEPEDSAVYYCQQYHSSPSWTFGQGTRLEIK |
| BCMA_EBB-C1979-C1-nt ScFv domain | 360 | CAAGTGCAGCTCGTGGAATCGGGTGGCGGACTGGTGCAGCCGGGGGGCTC ACTTAGACTGTCCTGCGCGGCCAGCGGATTCACTTTCTCCTCCTACGCCA TGTCCTGGGTCAGACAGGCCCCTGGAAAGGGCCTGGAATGGGTGTCCGCA ATCAGCGGCAGCGGCGGCTCGACCTATTACGCGGATTCAGGAAGGGCAG ATTCACCATTTCCCGGGACAACGCCAAGAACTCCTTGTACCTTCAAATGA ACTCCCTCCGCGCGGAAGATACCGCAATCTACTACTGCGCTCGGGCCACT TACAAGAGGGAACTGCGCTACTACTACGGGATGGACGTCTGGGGCCAGGG AACCATGGTCACCGTGTCCAGCGGAGGAGGAGGATCGGGAGGAGGCGGTA GCGGGGGTGGAGGGTCGGAGATCGTGATGACCCAGTCCCCCGGCACTGTG TCGCTGTCCCCCGGCGAACGGGCCACCCTGTCATGTCGGGCCAGCCAGTC AGTGTCGTCAAGCTTCCTCGCCTGGTACCAGCAGAAACCGGGACAAGCTC CCCGCCTGCTGATCTACGGAGCCAGCAGCCGGGCCACCGGTATTCCTGAC CGGTTCTCCGGTTCGGGGTCCGGGACCGACTTTACTCTGACTATCTCTCG CCTCGAGCCAGAGGACTCCGCCGTGTATTACTGCCAGCAGTACCACTCCT CCCCGTCCTGGACGTTCGGACAGGGCACAAGGCTGGAGATTAAG |
| BCMA_EBB-C1979-C1-aa VH | 381 | QVQLVESGGGLVQPGGSLRLSCAASGFTFSSYAMSWVRQAPGKGLEWVSA ISGSGGSTYYADSVKGRFTISRDNAKNSLYLQMNSLRAEDTAIYYCARAT YKRELRYYYGMDVWGQGTMVTVSS |
| BCMA_EBB-C1979-C1-aa VL | 402 | EIVMTQSPGTVSLSPGERATLSCRASQSVSSSFLAWYQQKPGQAPRLLIY GASSRATGIPDRFSGSGSGTDFTLTISRLEPEDSAVYYCQQYHSSPSWTF GQGTRLEIK |
| BCMA_EBB-C1978-C7 | | |
| BCMA_EBB-C1978-C7-aa ScFv domain | 340 | EVQLVETGGGLVQPGGSLRLSCAASGFTFSSYAMSWVRQAPGKGLEWVSA ISGSGGSTYYADSVKGRFTISRDNSKNTLYLQMNTLKAEDTAVYYCARAT YKRELRYYYGMDVWGQGTTVTVSSGGGGSGGGGSGGGGSEIVLTQSPSTL SLSPGESATLSCRASQSVSTTFLAWYQQKPGQAPRLLIYGSSNRATGIPD RFSGSGSGTDFTLTIRRLEPEDFAVYYCQQYHSSPSWTFGQGTKVEIK |
| BCMA_EBB-C1978-C7-nt ScFv domain | 361 | GAGGTGCAGCTTGTGGAAACCGGTGGCGGACTGGTGCAGCCCGGAGGAAG CCTCAGGCTGTCCTGCGCCGCGTCCGGCTTCACCTTCTCCTCGTACGCCA TGTCCTGGGTCCGCCAGGCCCCCGGAAAGGGCCTGGAATGGGTGTCCGCC ATCTCTGGAAGCGGAGGTTCCACGTACTACGCGGACAGCGTCAAGGGAAG GTTCACAATCTCCCGCGATAATTCGAAGAACACTCTGTACCTTCAAATGA |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| | | ACACCCTGAAGGCCGAGGACACTGCTGTGTACTACTGCGCACGGGCCACC TACAAGAGAGAGCTCCGGTACTACTACGGAATGGACGTCTGGGGCCAGGG AACTACTGTGACCGTGTCCTCGGGAGGGGGTGGCTCCGGGGGGGCGGCT CCGGCGGAGGCGGTTCCGAGATTGTGCTGACCCAGTCACCTTCAACTCTG TCGCTGTCCCCGGGAGAGAGCGCTACTCTGAGCTGCCGGGCCAGCCAGTC CGTGTCCACCACCTTCCTCGCCTGGTATCAGCAGAAGCCGGGCCAGGCAC CACGGCTCTTGATCTACGGGTCAAGCAACAGAGCGACCGGAATTCCTGAC CGCTTCTCGGGGAGCGGTTCAGGCACCGACTTCACCCTGACTATCCGGCG CCTGGAACCCGAAGATTTCGCCGTGTATTACTGTCAACAGTACCACTCCT CGCCGTCCTGGACCTTTGGCCAAGGAACCAAAGTGGAAATCAAG |
| BCMA_EBB-C1978-C7-aa VH | 382 | EVQLVETGGGLVQPGGSLRLSCAASGFTFSSYAMSWVRQAPGKGLEWVSA ISGSGGSTYYADSVKGRFTISRDNSKNTLYLQMNTLKAEDTAVYYCARAT YKRELRYYYGMDVWGQGTTVTVSS |
| BCMA_EBB-C1978-C7-aa VL | 403 | EIVLTQSPSTLSLSPGESATLSCRASQSVSTTFLAWYQQKPGQAPRLLIY GSSNRATGIPDRFSGSGSGTDFTLTIRRLEPEDFAVYYCQQYHSSPSWTF GQGTKVEIK |

BCMA_EBB-C1978-D10

| Name/ Description | SEQ ID NO: | Sequence |
|---|---|---|
| BCMA_EBB-C1978-D10-aa ScFv domain | 341 | EVQLVETGGGLVQPGRSLRLSCAASGFTFDDYAMHWVRQAPGKGLEWVSG ISWNSGSIGYADSVKGRFTISRDNAKNSLYLQMNSLRDEDTAVYYCARVG KAVPDVWGQGTTVTVSSGGGGSGGGGSGGGGSDIVMTQTPSSLSASVGDR VTITCRASQSISSYLNWYQQKPGKAPKLLIYAASSLQSGVPSRFSGSGSG TDFTLTISSLQPEDFATYYCQQSYSTPYSFGQGTRLEIK |
| BCMA_EBB-C1978-D10-nt ScFv domain | 362 | GAAGTGCAGCTCGTGGAAACTGGAGGTGGACTCGTGCAGCCTGGACGGTC GCTGCGGCTGAGCTGCGCTGCATCCGGCTTCACCTTCGACGATTATGCCA TGCACTGGGTCAGACAGGCGCCAGGGAAGGGACTTGAGTGGGTGTCCGGT ATCAGCTGGAATAGCGGCTCAATCGGATACGCGGACTCCGTGAAGGGAAG GTTCACCATTTCCCGCGACAACGCCAAGAACTCCCTGTACTTGCAAATGA ACAGCCTCCGGGATGAGGACACTGCCGTGTACTACTGCGCCCGCGTCGGA AAAGCTGTGCCCGACGTCTGGGGCCAGGGAACCACTGTGACCGTGTCCAG CGGCGGGGGTGGATCGGGCGGTGGAGGGTCCGGTGGAGGGGGCTCAGATA TTGTGATGACCCAGACCCCCTCGTCCCTGTCCGCCTCGGTCGGCGACCGC GTGACTATCACATGTAGAGCCTCGCAGAGCATCTCCAGCTACCTGAACTG GTATCAGCAGAAGCCGGGAAAGGCCCCGAAGCTCCTGATCTACGCGGCAT CATCACTGCAATCGGGAGTGCCGAGCCGGTTTTCCGGGTCCGGCTCCGGC ACCGACTTCACGCTGACCATTTCTTCCCTGCAACCCGAGGACTTCGCCAC TTACTACTGCCAGCAGTCCTACTCCACCCCTTACTCCTTCGGCCAAGGAA CCAGGCTGGAAATCAAG |
| BCMA_EBB-C1978-D10-aa VH | 383 | EVQLVETGGGLVQPGRSLRLSCAASGFTFDDYAMHWVRQAPGKGLEWVSG ISWNSGSIGYADSVKGRFTISRDNAKNSLYLQMNSLRDEDTAVYYCARVG KAVPDVWGQGTTVTVSS |
| BCMA_EBB-C1978-D10-aa VL | 404 | DIVMTQTPSSLSASVGDRVTITCRASQSISSYLNWYQQKPGKAPKLLIYA ASSLQSGVPSRFSGSGSGTDFTLTISSLQPEDFATYYCQQSYSTPYSFGQ GTRLEIK |

BCMA_EBB-C1979-C12

| Name/ Description | SEQ ID NO: | Sequence |
|---|---|---|
| BCMA_EBB-C1979-C12-aa ScFv domain | 342 | EVQLVESGGGLVQPGRSLRLSCTASGFTFDDYAMHWVRQRPGKGLEWVAS INWKGNSLAYGDSVKGRFAISRDNAKNTVFLQMNSLRTEDTAVYYCASHQ GVAYYNYAMDVWGRGTLVTVSSGGGGSGGGGSGGGGSEIVLTQSPGTLSL SPGERATLSCRATQSIGSSFLAWYQQRPGQAPRLLIYGASQRATGIPDRF SGRGSGTDFTLTISRVEPEDSAVYYCQHYESSPSWTFGQGTKVEIK |
| BCMA_EBB-C1979-C12-nt ScFv domain | 363 | GAAGTGCAGCTCGTGGAGAGCGGGGAGGATTGGTGCAGCCCGGAAGGTC CCTGCGGCTCTCCTGCACTGCGTCTGGCTTCACCTTCGACGACTACGCGA TGCACTGGGTCAGACAGCGCCCGGGAAAGGGCCTGGAATGGGTCGCCTCA ATCAACTGGAAGGGAAACTCCCTGGCCTATGGCGACAGCGTGAAGGGCCG CTTCGCCATTTCGCGCGACAACGCCAAGAACACCGTGTTTCTGCAAATGA ATTCCCTGCGGACCGAGGATACCGCTGTGTACTACTGCGCCAGCCACCAG GGCGTGGCATACTATAACTACGCCATGGACGTGTGGGGAAGAGGGACGCT CGTCACCGTGTCCTCCGGGGGCGGTGGATCGGGTGGAGGAGGAAGCGGTG GCGGGGGCAGCGAAATCGTGCTGACTCAGAGCCCGGGAACTCTTTCACTG TCCCCGGGAGAACGGGCCACTCTCTCGTGCCGGGCCACCCAGTCCATCGG CTCCTCCTTCCTTGCCTGGTACCAGCAGAGGCCAGGACAGGCGCCCCGCC TGCTGATCTACGGTGCTTCCCAACGCGCCACTGGCATTCCTGACCGGTTC AGCGGCAGAGGTCGGGAACCGATTTCACACTGACCATTTCCCGGGTGGA GCCCGAAGATTCGGCAGTCTACTACTGTCAGCATTACGAGTCCTCCCCTT CATGGACCTTCGGTCAAGGGACCAAAGTGGAGATCAAG |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| BCMA_EBB-C1979-C12-aa VH | 384 | EVQLVESGGGLVQPGRSLRLSCTASGFTFDDYAMHWVRQRPGKGLEWVAS INWKGNSLAYGDSVKGRFAISRDNAKNTVFLQMNSLRTEDTAVYYCASHQ GVAYYNYAMDVWGRGTLVTVSS |
| BCMA_EBB-C1979-C12-aa VL | 405 | EIVLTQSPGTLSLSPGERATLSCRATQSIGSSFLAWYQQRPGQAPRLLIY GASQRATGIPDRFSGRGSGTDFTLTISRVEPEDSAVYYCQHYESSPSWTF GQGTKVEIK |

BCMA_EBB-C1980-G4

| | | |
|---|---|---|
| BCMA_EBB-C1980-G4-aa ScFv domain | 343 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVV RDGMDVWGQGTTVTVSSGGGGSGGGGSGGGGSEIVLTQSPATLSLSPGER ATLSCRASQSVSSSYLAWYQQKPGQAPRLLIYGASSRATGIPDRFSGNGS GTDFTLTISRLEPEDFAVYYCQQYGSPPRFTFGPGTKVDIK |
| BCMA_EBB-C1980-G4-nt ScFv domain | 364 | GAGGTGCAGTTGGTCGAAAGCGGGGGCGGGCTTGTGCAGCCTGGCGGATC ACTGCGGCTGTCCTGCGCGGCATCAGGCTTCACGTTTTCTTCCTACGCCA TGTCCTGGGTGCGCCAGGCCCCTGGAAAGGGACTGGAATGGGTGTCCGCG ATTTCGGGGTCCGGCGGGAGCACCTACTACGCCGATTCCGTGAAGGGCCG CTTCACTATCTCGCGGGACAACTCCAAGAACACCCTCTACCTCCAAATGA ATAGCCTGCGGGCCGAGGATACCGCCGTCTACTATTGCGCTAAGGTCGTG CGCGACGGAATGGACGTGTGGGGACAGGGTACCACCGTGACAGTGTCCTC GGGGGGAGGCGGTAGCGGCGGAGGAGGAAGCGGTGGTGGAGGTTCCGAGA TTGTGCTGACTCAATCACCCGCGACCCTGAGCCTGTCCCCCGGCGAAAGG GCCACTCTGTCCTGTCGGGCCAGCCAATCAGTCTCCTCCTCGTACCTGGC CTGGTACCAGCAGAAGCCAGGACAGGCTCCGAGACTCCTTATCTATGGCG CATCCTCCCGCGCCACCGGAATCCCGGATAGGTTCTCGGGAAACGGATCG GGGACCGACTTCACTCTCACCATCTCCCGGCTGGAACCGGAGGACTTCGC CGTGTACTACTGCCAGCAGTACGGCAGCCCGCCTAGATTCACTTTCGGCC CCGGCACCAAAGTGGACATCAAG |
| BCMA_EBB-C1980-G4-aa VH | 385 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVV RDGMDVWGQGTTVTVSS |
| BCMA_EBB-C1980-G4-aa VL | 406 | EIVLTQSPATLSLSPGERATLSCRASQSVSSSYLAWYQQKPGQAPRLLIY GASSRATGIPDRFSGNGSGTDFTLTISRLEPEDFAVYYCQQYGSPPRFTF GPGTKVDIK |

BCMA_EBB-C1980-D2

| | | |
|---|---|---|
| BCMA_EBB-C1980-D2-aa ScFv domain | 344 | EVQLLESGGGLVQPGGSLRLSCAASGFTFSSYAMSWVRQAPGKGLEWVSA ISGSGGSTYYADSVKGRFTISRDNSKNTLYLQMNSLRAEDTAVYYCAKIP QTGTFDYWGQGTLVTVSSGGGGSGGGGSGGGGSEIVLTQSPGTLSLSPGE RAILSCRASQSVSSSYLAWYQQRPGQAPRLLIYGASSRATGIPDRFSGSG SGTDFTLTISRLEPEDFAVYYCQHYGSSPSWTFGQGTRLEIK |
| BCMA_EBB-C1980-D2-nt ScFv domain | 365 | GAAGTGCAGCTGCTGGAGTCCGGCGGTGGATTGGTGCAACCGGGGGGATC GCTCAGACTGTCCTGTGCGGCGTCAGGCTTCACCTTCTCGAGCTACGCCA TGTCATGGGTCAGACAGGCCCCTGGAAAGGGTCTGGAATGGGTGTCCGCC ATTTCCGGGAGCGGGGATCTACATACTACGCCGATAGCGTGAAGGGCCG CTTCACCATTTCCCGGGACAACTCCAAGAACACTCTCTATCTGCAAATGA ACTCCCTCCGCGCTGAGGACACTGCCGTGTACTACTGCGCCAAAATCCCT CAGACCGGCACCTTCGACTACTGGGGACAGGGGACTCTGGTCACCGTCAG CAGCGGTGGCGAGGTTCGGGGGGAGGAGGAAGCGGCGGCGGAGGGTCCG AGATTGTGCTGACCCAGTCACCCGGCACTTTGTCCCTGTCGCCTGGAGAA AGGGCCACCCTTTCCTGCCGGGCATCCCAATCCGTGTCCTCCTCGTACCT GGCCTGGTACCAGCAGAGGCCCGGACAGGCCCCACGGCTTCTGATCTACG GAGCAAGCAGCCGCGCGACCGGTATCCCGGACCGGTTTTCGGGCTCGGGC TCAGGAACTGACTTCACCCTCACCATCTCCCGCCTGGAACCCGAAGATTT CGCTGTGTATTACTGCCAGCACTACGGCAGCTCCCCGTCCTGGACGTTCG GCCAGGGAACTCGGCTGGAGATCAAG |
| BCMA_EBB-C1980-D2-aa VH | 386 | EVQLLESGGGLVQPGGSLRLSCAASGFTFSSYAMSWVRQAPGKGLEWVSA ISGSGGSTYYADSVKGRFTISRDNSKNTLYLQMNSLRAEDTAVYYCAKIP QTGTFDYWGQGTLVTVSS |
| BCMA_EBB-C1980-D2-aa VL | 407 | EIVLTQSPGTLSLSPGERATLSCRASQSVSSSYLAWYQQRPGQAPRLLIY GASSRATGIPDRFSGSGSGTDFTLTISRLEPEDFAVYYCQHYGSSPSWTF GQGTRLEIK |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| BCMA_EBB-C1978-A10 | | |
| BCMA_EBB-C1978-A10-aa ScFv domain | 345 | EVQLVETGGGLVQPGGSLRLSCAASGFTFSSYAMSWVRQAPGKGLEWVSA ISGSGGSTYYADSVKGRFTMSRENDKNSVFLQMNSLRVEDTGVYYCARAN YKRELRYYYGMDVWGQGTMVTVSSGGGGSGGGGSGGGGSEIVMTQSPGTL SLSPGESATLSCRASQRVASNYLAWYQHKPGQAPSLLISGASSRATGVPD RFSGSGSGTDFTLAISRLEPEDSAVYYCQHYDSSPSWTFGQGTKVEIK |
| BCMA_EBB-C1978-A10-nt ScFv domain | 366 | GAAGTGCAACTGGTGGAAACCGGTGGAGGACTCGTGCAGCCTGGCGGCAG CCTCCGGCTGAGCTGCGCCGCTTCGGGATTCACCTTTTCCTCCTACGCGA TGTCTTGGGTCAGACAGGCCCCCGGAAAGGGGCTGGAATGGGTGTCAGCC ATCTCCGGCTCCGGCGGATCAACGTACTACGCCGACTCCGTGAAAGGCCG GTTCACCATGTCGCGCGAGAATGACAAGAACTCCGTGTTCCTGCAAATGA ACTCCCTGAGGGTGGAGGACACCGGAGTGTACTATTGTGCGCGCGCCAAC TACAAGAGAGAGCTGCGGTACTACTACGGAATGGACGTCTGGGGACAGGG AACTATGGTGACCGTGTCATCCGGTGGAGGGGGAAGCGGCGGTGGAGGCA GCGGGGGCGGGGGTTCAGAAATTGTCATGACCCAGTCCCCGGGAACTCTT TCCCTCTCCCCGGGGAATCCGCGACTTTGTCCTGCGGGCCAGCCAGCG CGTGGCCTCGAACTACCTCGCATGGTACCAGCATAAGCCAGGCCAAGCCC CTTCCCTGCTGATTTCCGGGGCTAGCAGCCGCGCCACTGGCGTGCCGGAT AGGTTCTCGGGAAGCGGCTCGGGTACCGATTTCACCCTGGCAATCTCGCG GCTGGAACCGGAGGATTCGGCCGTGTACTACTGCCAGCACTATGACTCAT CCCCCTCCTGGACATTCGGACAGGGCACCAAGGTCGAGATCAAG |
| BCMA_EBB-C1978-A10-aa VH | 387 | EVQLVETGGGLVQPGGSLRLSCAASGFTFSSYAMSWVRQAPGKGLEWVSA ISGSGGSTYYADSVKGRFTMSRENDKNSVFLQMNSLRVEDTGVYYCARAN YKRELRYYYGMDVWGQGTMVTVSS |
| BCMA_EBB-C1978-A10-aa VL | 408 | EIVMTQSPGTLSLSPGESAILSCRASQRVASNYLAWYQHKPGQAPSLLIS GASSRATGVPDRFSGSGSGTDFTLAISRLEPEDSAVYYCQHYDSSPSWTF GQGTKVEIK |
| BCMA_EBB-C1978-D4 | | |
| BCMA_EBB-C1978-D4-aa ScFv domain | 346 | EVQLLETGGGLVQPGGSLRLSCAASGFSFSSYAMSWVRQAPGKGLEWVSA ISGSGGSTYYADSVKGRFTISRDNSKNTLYLQMNSLRAEDTAVYYCAKAL VGATGAFDIWGQGTLVTVSSGGGGSGGGGSGGGGSEIVLTQSPGTLSLSP GERATLSCRASQSLSSNFLAWYQQKPGQAPGLLIYGASNWATGTPDRFSG SGSGTDFTLTITRLEPEDFAVYYCQYYGTSPMYTFGQGTKVEIK |
| BCMA_EBB-C1978-D4-nt ScFv domain | 367 | GAAGTGCAGCTGCTCGAAACCGGTGGAGGGCTGGTGCAGCCAGGGGGCTC CCTGAGGCTTTCATGCGCCGCTAGCGGATTCTCCTTCTCCTCTTACGCCA TGTCGTGGGTCCGCCAAGCCCCTGGAAAAGGCCTGGAATGGGTGTCCGCG ATTTCCGGGAGCGGAGGTTCGACCTATTACGCCGACTCCGTGAAGGGCCG CTTTACCATCTCCCGGGATAACTCCAAGAACACTCTGTACCTCCAAATGA ACTCGCTGAGAGCCGAGGACACCGCCGTGTATTACTGCGCGAAGGCGCTG GTCGGCGCGACTGGGGCATTCGACATCTGGGGACAGGGAACTCTTGTGAC CGTGTCGAGCGGAGGCGGCGGCTCCGGCGAGGAGGGAGCGGGGGCGGTG GTTCCGAAATCGTGTTGACTCAGTCCCCGGGAACCCTGAGCTTGTCACCC GGGGAGCGGGCCACTCTCTCCTGTCGCGCCTCCCAATCGCTCTCATCCAA TTTCCTGGCCTGGTACCAGCAGAAGCCCGACAGGCCCCGGGCCTGCTCA TCTACGGCGCTTCAAACTGGGCAACGGGAACCCCTGATCGGTTCAGCGGA AGCGGATCGGGTACTGACTTTACCCTGACCATCACCAGACTGGAACCGGA GGACTTCGCCGTGTACTACTGCCAGTACTACGGCACCTCCCCCATGTACA CATTCGGACAGGGTACCAAGGTCGAGATTAAG |
| BCMA_EBB-C1978-D4-aa VH | 388 | EVQLLETGGGLVQPGGSLRLSCAASGFSFSSYAMSWVRQAPGKGLEWVSA ISGSGGSTYYADSVKGRFTISRDNSKNTLYLQMNSLRAEDTAVYYCAKAL VGATGAFDIWGQGTLVTVSS |
| BCMA_EBB-C1978-D4-aa VL | 409 | EIVLTQSPGTLSLSPGERATLSCRASQSLSSNFLAWYQQKPGQAPGLLIY GASNWATGTPDRFSGSGSGTDFTLTITRLEPEDFAVYYCQYYGTSPMYTF GQGTKVEIK |
| BCMA_EBB-C1980-A2 | | |
| BCMA_EBB-C1980-A2-aa ScFv domain | 347 | EVQLLESGGGLVQPGGSLRLSCAASGFTFSSYAMSWVRQAPGKGLEWVSA ISGSGGSTYYADSVKGRFTISRDNSKNTLYLQMNSLRAEDTAVYYCVLWF GEGFDPWGQGTLVTVSSGGGGSGGGGSGGGGSDIVLTQSPLSLPVTPGEP ASISCRSSQSLLHSNGYNYLDWYLQKPGQSPQLLIYLGSNRASGVPDRFS GSGSGTDFTLKISRVEAEDVGVYYCMQALQTPLTFGGGTKVDIK |
| BCMA_EBB-C1980-A2-nt ScFv domain | 368 | GAAGTGCAGCTGCTTGAGAGCGGTGGAGGTCTGGTGCAGCCCGGGGGATC ACTGCGCCTGTCCTGTGCCGCGTCCGGTTTCACTTTCTCCTCGTACGCCA TGTCGTGGGTCAGACAGGCACCGGGAAAGGGACTGGAATGGGTGTCAGCC ATTTCGGGTTCGGGGGGCAGCACCTACTACGCTGACTCCGTGAAGGGCCG GTTCACCATTTCCCGCGACAACTCCAAGAACACCTTGTACCTCCAAATGA |

TABLE 8-continued

Antigen Binding domains that bind BCMA
The amino acid sequences of variable heavy chain and variable
light chain sequences for each
scFv are also provided.

| Name/ Description | SEQ ID NO: | Sequence |
|---|---|---|
| | | ACTCCCTGCGGGCCGAAGATACCGCCGTGTATTACTGCGTGCTGTGGTTC GGAGAGGGATTCGACCCGTGGGGACAAGGAACACTCGTGACTGTGTCATC CGGCGGAGGCGGCAGCGGTGGCGGCGGTTCCGGCGGCGGCGGATCTGACA TCGTGTTGACCCAGTCCCCTCTGAGCCTGCCGGTCACTCCTGGCGAACCA GCCAGCATCTCCTGCCGGTCGAGCCAGTCCCTCCTGCACTCCAATGGGTA CAACTACCTCGATTGGTATCTGCAAAAGCCGGGCCAGAGCCCCCAGCTGC TGATCTACCTTGGGTCAAACCGCGCTTCCGGGGTGCCTGATAGATTCTCC GGGTCCGGGAGCGGAACCGACTTTACCCTGAAAATCTCGAGGGTGGAGGC CGAGGACGTCGGAGTGTACTACTGCATGCAGGCGCTCCAGACTCCCCTGA CCTTCGGAGGAGGAACGAAGGTCGACATCAAGA |
| BCMA_EBB-C1980-A2-aa VH | 389 | EVQLLESGGGLVQPGGSLRLSCAASGFTFSSYAMSWVRQAPGKGLEWVSA ISGSGGSTYYADSVKGRFTISRDNSKNTLYLQMNSLRAEDTAVYYCVLWF GEGFDPWGQGTLVTVSS |
| BCMA_EBB-C1980-A2-aa VL | 410 | DIVLTQSPLSLPVTPGEPASISCRSSQSLLHSNGYNYLDWYLQKPGQSPQ LLIYLGSNRASGVPDRFSGSGSGTDFTLKISRVEAEDVGVYYCMQALQTP LTFGGGTKVDIK |
| BCMA_EBB-C1981-C3 | | |
| BCMA_EBB-C1981-C3-aa ScFv domain | 348 | QVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVG YDSSGYYRDYYGMDVWGQGTTVTVSSGGGGSGGGGSGGGGSEIVLTQSPG TLSLSPGERATLSCRASQSVSSSYLAWYQQKPGQAPRLLIYGTSSRATGI SDRFSGSGSGTDFTLTISRLEPEDFAVYYCQHYGNSPPKFTFGPGTKLEI K |
| BCMA_EBB-C1981-C3-nt ScFv domain | 369 | CAAGTGCAGCTCGTGGAGTCAGGCGGAGGACTGGTGCAGCCCGGGGGCTC CCTGAGACTTTCCTGCGCGGCATCGGGTTTTACCTTCTCCTCCTATGCTA TGTCCTGGGTGCGCCAGGCCCCGGGAAAGGGACTGGAATGGGTGTCCGCA ATCAGCGGTAGCGGGGGCTCAACATACTACGCCGACTCCGTCAAGGGTCG CTTCACTATTTCCCGGGACAACTCCAAGAATACCCTGTACCTCCAAATGA ACAGCCTCAGGGCCGAGGATACTGCCGTGTACTACTGCGCCAAAGTCGGA TACGATAGCTCCGGTTACTACCGGGACTACTACGGAATGGACGTGTGGGG ACAGGGCACCACCGTGACCGTGTCAAGCGGCGGAGGCGGTTCAGGAGGG GAGGCTCCGGCGGTGGAGGGTCCGAAATCGTCCTGACTCAGTCGCCTGGC ACTCTGTCGTTGTCCCCGGGGGAGCGCGCTACCCTGTCGTGTCGGGCGTC GCAGTCCGTGTCGAGCTCCTACCTCGCGTGGTACCAGCAGAAGCCCGGAC AGGCCCCTAGACTTCTGATCTACGGCACTTCTTCACGCGCCACCGGGATC AGCGACAGGTTCAGCGGCTCCGGCTCCGGGACCGACTTCACCCTGACCAT TAGCCGGCTGGAGCCTGAAGATTTCGCCGTGTATTACTGCCAACACTACG GAAACTCGCCGCCAAAGTTCACGTTCGGACCCGGAACCAAGCTGGAAATC APG |
| BCMA_EBB-C1981-C3-aa VH | 390 | QVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVG YDSSGYYRDYYGMDVWGQGTTVTVSS |
| BCMA_EBB-C1981-C3-aa VL | 411 | EIVLIQSPGILSLSPGERATLSCRASQSVSSSYLAWYQQKPGQAPRLLIY GTSSRATGISDRFSGSGSGTDFTLTISRLEPEDFAVYYCQHYGNSPPKFT FGPGTKLEIK |
| BCMA_EBB-C1978-G4 | | |
| BCMA_EBB-C1978-G4-aa ScFv domain | 349 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKMG WSSGYLGAFDIWGQGTTVTVSSGGGGSGGGGSGGGGSEIVLTQSPGTLSL SPGERATLSCRASQSVASSFLAWYQQKPGQAPRLLIYGASGRATGIPDRF SGSGSGTDFTLTISRLEPEDFAVYYCQHYGGSPRLTFGGGTKVDIK |
| BCMA_EBB-C1978-G4-nt ScFv domain | 370 | GAAGTCCAACTGGTGGAGTCCGGGGAGGGCTCGTGCAGCCCGGAGGCAG CCTTCGGCTGTCGTGCGCCGCCTCCGGGTTCACGTTCTCATCCTACGCGA TGTCGTGGGTCAGACAGGCACCAGGAAAGGGACTGGAATGGGTGTCCGCC ATTAGCGGCTCCGGCGGTAGCACCTACTATGCCGACTCAGTGAAGGGAAG GTTCACTATCTCCCGCGACAACAGCAAGAACACCCTGTACCTCCAAATGA ACTCTCTGCGGGCCGAGGATACCGCGGTGTACTATTGCGCCAAGATGGGT TGGTCCAGCGGATACTTGGGAGCCTTCGACATTTGGGGACAGGGCACTAC TGTGACCGTGTCCTCCGGGGGTGGCGGATCGGGAGGCGGCGGCTCGGGTG GAGGGGGTTCCGAAATCGTGTTGACCCAGTCACCGGGAACCCTCTCGCTG TCCCCGGGAGAACGGGCTACACTGTCATGTAGAGCGTCCCAGTCCGTGGC TTCCTCGTTCCTGGCCTGGTACCAGCAGAAGCCGGGACAGGCACCCCGCC TGCTCATCTACGGAGCCAGCGGCCGGGCGACCGGCATCCCTGACCGCTTC TCCGGTTCCGGCTCGGGCACCGACTTTACTCTGACCATTAGCAGGCTTGA GCCCGAGGATTTTGCCGTGTACTACTGCCAACACTACGGGGGGAGCCCTC GCCTGACCTTCGGAGGCGGAACTAAGGTCGATATCAAAA |

TABLE 8-continued

Antigen Binding domains that bind BCMA
The amino acid sequences of variable heavy chain and variable
light chain sequences for each
scFv are also provided.

| Name/<br>Description | SEQ<br>ID<br>NO: | Sequence |
|---|---|---|
| BCMA_EBB-<br>C1978-G4-aa<br>VH | 391 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKMG<br>WSSGYLGAFDIWGQGTTVTVSS |
| BCMA_EBB-<br>C1978-G4-aa<br>VL | 412 | EIVLTQSPGTLSLSPGERATLSCRASQSVASSFLAWYQQKPGQAPRLLIY<br>GASGRATGIPDRFSGSGSGTDFTLTISRLEPEDFAVYYCQHYGGSPRLTF<br>GGGTKVDIK |

In embodiments, additional exemplary BCMA CAR constructs are generated using the CDR and/or VH and VL sequences from PCT Publication WO2012/0163805 (the contents of which are hereby incorporated by reference in its entirety). In embodiments, additional exemplary BCMA CAR constructs are generated using the CDR and/or VH and VL sequences from PCT Publication WO2016/014565 (the contents of which are hereby incorporated by reference in its entirety). In embodiments, additional exemplary BCMA CAR constructs are generated using the CDR and/or VH and VL sequences from PCT Publication WO2014/122144 (the contents of which are hereby incorporated by reference in its entirety). In embodiments, additional exemplary BCMA CAR constructs are generated using the CAR molecules, and/or the VH and VL sequences from PCT Publication WO2016/014789 (the contents of which are hereby incorporated by reference in its entirety). In embodiments, additional exemplary BCMA CAR constructs are generated using the CAR molecules, and/or the VH and VL sequences from PCT Publication WO2014/089335 (the contents of which are hereby incorporated by reference in its entirety). In embodiments, additional exemplary BCMA CAR constructs are generated using the CAR molecules, and/or the VH and VL sequences from PCT Publication WO2014/140248 (the contents of which are hereby incorporated by reference in its entirety).

In embodiments, additional exemplary BCMA CAR constructs can also be generated using the VH and VL sequences found in Table 9. The amino acid sequences of exemplary scFv domains comprising the VH and VL domains and a linker sequence, and full-length CARs, are in Table 9.

TABLE 9

Additional exemplary BCMA binding domain sequences

| Name | Sequence | SEQ ID NO: |
|---|---|---|
| A7D12.2<br>VH | QIQLVQSGPDLKKPGETVKLSCKASGYTFTNFGMNWVKQAPGKGFKWMAWINTY<br>TGESYFADDFKGRFAFSVETSATTAYLQINNLKTEDTATYFCARGEIYYGYDGG<br>FAYWGQGTLVTVSA | 455 |
| A7D12.2<br>VL | DVVMTQSHRFMSTSVGDRVSITCRASQDVNTAVSWYQQKPGQSPKLLIFSASYR<br>YTGVPDRFTGSGSGADFTLTISSVQAEDLAVYYCQQHYSTPWTFGGGTKLDIK | 459 |
| A7D12.2<br>scFv<br>domain | QIQLVQSGPDLKKPGETVKLSCKASGYTFTNFGMNWVKQAPGKGFKWMAWINTY<br>TGESYFADDFKGRFAFSVETSATTAYLQINNLKTEDTATYFCARGEIYYGYDGG<br>FAYWGQGTLVTVSAGGGGSGGGGSGGGGSDVVMTQSHRFMSTSVGDRVSITCRA<br>SQDVNTAVSWYQQKPGQSPKLLIFSASYRYTGVPDRFTGSGSGADFTLTISSVQ<br>AEDLAVYYCQQHYSTPWTFGGGTKLDIK | 463 |
| C11D5.3<br>VH | QIQLVQSGPELKKPGETVKISCKASGYTFTDYSINWVKRAPGKGLKWMGWINTE<br>TREPAYAYDFRGRFAFSLETSASTAYLQINNLKYEDTATYFCALDYSYAMDYWG<br>QGTSVTVSS | 456 |
| C11D5.3<br>VL | DIVLTQSPASLAMSLGKRATISCRASESVSVIGAHLIHWYQQKPGQPPKLLIYL<br>ASNLETGVPARFSGSGSGTDFTLTIDPVEEDDVAIYSCLQSRIFPRTFGGGTKL<br>EIK | 460 |
| C11D5.3<br>scFv<br>domain | QIQLVQSGPELKKPGETVKISCKASGYTFTDYSINWVKRAPGKGLKWMGWINTE<br>TREPAYAYDFRGRFAFSLETSASTAYLQINNLKYEDTATYFCALDYSYAMDYWG<br>QGTSVTVSSGGGGSGGGGSGGGGSQIQLVQSGPELKKPGETVKISCKASGYTFT<br>DYSINWVKRAPGKGLKWMGWINTETREPAYAYDFRGRFAFSLETSASTAYLQIN<br>NLKYEDTATYFCALDYSYAMDYWGQGTSVTVSS | 464 |
| C12A3.2<br>VH | QIQLVQSGPELKKPGETVKISCKASGYTFRHYSMNWVKQAPGKGLKWMGRINTE<br>SGVPIYADDFKGRFAFSVETSASTAYLVINNLKDEDTASYFCSNDYLYSLDFWG<br>QGTALTVSS | 457 |
| C12A3.2<br>VL | DIVLTQSPPSLAMSLGKRATISCRASESVTILGSHLIYWYQQKPGQPPTLLIQL<br>ASNVQTGVPARFSGSGSRTDFTLTIDPVEEDDVAVYYCLQSRTIPRTFGGGTKL<br>EIK | 461 |

TABLE 9-continued

Additional exemplary BCMA binding domain sequences

| Name | Sequence | SEQ ID NO: |
|------|----------|------------|
| C12A3.2 scFv domain | QIQLVQSGPELKKPGETVKISCKASGYTFRHYSMNWVKQAPGKGLKWMGRINTE SGVPIYADDFKGRFAFSVETSASTAYLVINNLKDEDTASYFCSNDYLYSLDFWG QGTALTVSSGGGGSGGGGSGGGGSDIVLTQSPPSLAMSLGKRATISCRASESVT ILGSHLIYWYQQKPGQPPTLLIQLASNVQTGVPARFSGSGSRTDFTLTIDPVEE DDVAVYYCLQSRTIPRTFGGGTKLEIK | 465 |
| C13F12.1 VH | QIQLVQSGPELKKPGETVKISCKASGYTFTHYSMNWVKQAPGKGLKWMGRINTE TGEPLYADDFKGRFAFSLETSASTAYLVINNLKNEDTATFFCSNDYLYSCDYWG QGTTLTVSS | 458 |
| C13F12.1 VL | DIVLTQSPPSLAMSLGKRATISCRASESVTILGSHLIYWYQQKPGQPPTLLIQL ASNVQTGVPARFSGSGSRTDFTLTIDPVEEDDVAVYYCLQSRTIPRTFGGGTKL EIK | 462 |
| C13F12.1 scFv domain | QIQLVQSGPELKKPGETVKISCKASGYTFTHYSMNWVKQAPGKGLKWMGRINTE TGEPLYADDFKGRFAFSLETSASTAYLVINNLKNEDTATFFCSNDYLYSCDYWG QGTTLTVSSGGGGSGGGGSGGGGSDIVLTQSPPSLAMSLGKRATISCRASESVT ILGSHLIYWYQQKPGQPPTLLIQLASNVQTGVPARFSGSGSRTDFTLTIDPVEE DDVAVYYCLQSRTIPRTFGGGTKLEIK | 466 |

The sequences of human CDR sequences of the scFv domains are shown in Table 10 for the heavy chain variable domains and in Table 11 for the light chain variable domains. "ID" stands for the respective SEQ ID NO for each CDR. The CDRs are shown according to the Kabat definition, however, the CDRs under other convention, for example, Chothia or the combined Kabat/Chothia definitions may be readily deduced based on the VH and VL sequences above.

TABLE 10

Heavy Chain Variable Domain CDRs from the sequences above according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|-----------|-------|-----|-------|-----|-------|-----|
| 139109 | NHGMS | 594 | GIVYSGSTYYAASVKG | 634 | HGGESDV | 674 |
| 139103 | NYAMS | 584 | GISRSGENTYYADSVKG | 624 | SPAHYYGGMDV | 664 |
| 139105 | DYAMH | 585 | GISWNSGSIGYADSVKG | 625 | HSFLAY | 665 |
| 139111 | NHGMS | 586 | GIVYSGSTYYAASVKG | 626 | HGGESDV | 666 |
| 139100 | NFGIN | 587 | WINPKNNNTNYAQKFQG | 627 | GPYYYQSYMDV | 667 |
| 139101 | SDAMT | 588 | VISGSGGTTYYADSVKG | 628 | LDSSGYYYARGPRY | 668 |
| 139102 | NYGIT | 589 | WISAYNGNTNYAQKFQG | 629 | GPYYYYMDV | 669 |
| 139104 | NHGMS | 590 | GIVYSGSTYYAASVKG | 630 | HGGESDV | 670 |
| 139106 | NHGMS | 591 | GIVYSGSTYYAASVKG | 631 | HGGESDV | 671 |
| 139107 | NHGMS | 592 | GIVYSGSTYYAASVKG | 632 | HGGESDV | 672 |
| 139108 | DYYMS | 593 | YISSSGSTIYYADSVKG | 633 | ESGDGMDV | 673 |
| 139110 | DYYMS | 595 | YISSSGNTIYYADSVKG | 635 | STMVREDY | 675 |

TABLE 10-continued

Heavy Chain Variable Domain CDRs from the sequences above according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| 139112 | NHGMS | 596 | GIVYSGSTYYAASVKG | 636 | HGGESDV | 676 |
| 139113 | NHGMS | 597 | GIVYSGSTYYAASVKG | 637 | HGGESDV | 677 |
| 139114 | NHGMS | 598 | GIVYSGSTYYAASVKG | 638 | HGGESDV | 678 |
| 149362 | SSYYYWG | 599 | SIYYSGSAYYNPSLKS | 639 | HWQEWPDAFDI | 679 |
| 149363 | TSGMCVS | 600 | RIDWDEDKFYSTSLKT | 640 | SGAGGTSATAFDI | 680 |
| 149364 | SYSMN | 601 | SISSSSSYIYYADSVKG | 641 | TIAAVYAFDI | 681 |
| 149365 | DYYMS | 602 | YISSSGSTIYYADSVKG | 642 | DLRGAFDI | 682 |
| 149366 | SHYIH | 603 | MNSGGVTAYSQTLQG | 643 | EGSGSGWYFDF | 683 |
| 149367 | SGGYYWS | 604 | YIYYSGSTYYNPSLKS | 644 | AGIAARLRGAFDI | 684 |
| 149368 | SYAIS | 605 | GIIPIFGTANYAQKFQG | 645 | RGGYQLLRWDVGLLRSAFDI | 685 |
| 149369 | SNSAAWN | 606 | RTYYRSKWYSFYAISLKS | 646 | SSPEGLFLYWFDP | 686 |
| BCMA_EBB-C1978-A4 | SYAMS | 607 | AISGSGGSTYYADSVKG | 647 | VEGSGSLDY | 687 |
| BCMA_EBB-C1978-G1 | RYPMS | 608 | GISDSGVSTYYADSAKG | 648 | RAGSEASDI | 688 |
| BCMA_EBB-C1979-C1 | SYAMS | 609 | AISGSGGSTYYADSVKG | 649 | ATYKRELRYYYGMDV | 689 |
| BCMA_EBB-C1978-C7 | SYAMS | 610 | AISGSGGSTYYADSVKG | 650 | ATYKRELRYYYGMDV | 690 |
| BCMA_EBB-C1978-D10 | DYAMH | 611 | GISWNSGSIGYADSVKG | 651 | VGKAVPDV | 691 |
| BCMA_EBB-C1979-C12 | DYAMH | 612 | SINWKGNSLAYGDSVKG | 652 | HQGVAYYNYAMDV | 692 |
| BCMA_EBB-C1980-G4 | SYAMS | 613 | AISGSGGSTYYADSVKG | 653 | VVRDGMDV | 693 |
| BCMA_EBB-C1980-D2 | SYAMS | 614 | AISGSGGSTYYADSVKG | 654 | IPQTGTFDY | 694 |
| BCMA_EBB-C1978-A10 | SYAMS | 615 | AISGSGGSTYYADSVKG | 655 | ANYKRELRYYYGMDV | 695 |
| BCMA_EBB-C1978-D4 | SYAMS | 616 | AISGSGGSTYYADSVKG | 656 | ALVGATGAFDI | 696 |

TABLE 10-continued

Heavy Chain Variable Domain CDRs from the sequences above according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| BCMA_EB B-C1980-A2 | SYAMS | 617 | AISGSGGSTYYADSVKG | 657 | WFGEGFDP | 697 |
| BCMA_EB B-C1981-C3 | SYAMS | 618 | AISGSGGSTYYADSVKG | 658 | VGYDSSGYYRDYYGMDV | 698 |
| BCMA_EB B-C1978-G4 | SYAMS | 619 | AISGSGGSTYYADSVKG | 659 | MGWSSGYLGAFDI | 699 |
| A7D12.2 | NFGMN | 620 | WINTYTGESYFADDFKG | 660 | GEIYYGYDGGFAY | 700 |
| C11D5.3 | DYSIN | 621 | WINTETREPAYAYDFRG | 661 | DYSYAMDY | 701 |
| C12A3.2 | HYSMN | 622 | RINTESGVPIYADDFKG | 662 | DYLYSLDF | 702 |
| C13F12.1 | HYSMN | 623 | RINTETGEPLYADDFKG | 663 | DYLYSCDY | 703 |

TABLE 11

Light Chain Variable Domain CDRs from the sequences above according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | ID | LCDR2 | ID | LCDR3 | ID |
|---|---|---|---|---|---|---|
| 139109 | RASQSISSYLN | 714 | AASSLQS | 754 | QQSYSTPYT | 794 |
| 139103 | RASQSISSSFLA | 704 | GASRRAT | 744 | QQYHSSPSWT | 784 |
| 139105 | RSSQSLLHSNGYNYLD | 705 | LGSNRAS | 745 | MQALQTPYT | 785 |
| 139111 | KSSQSLLRNDGKTPLY | 706 | EVSNRFS | 746 | MQNIQFPS | 786 |
| 139100 | RSSQSLLHSNGYNYLN | 707 | LGSKRAS | 747 | MQALQTPYT | 787 |
| 139101 | RASQSISSYLN | 708 | GASTLAS | 748 | QQSYKRAS | 788 |
| 139102 | RSSQSLLYSNGYNYVD | 709 | LGSNRAS | 749 | MQGRQFPYS | 789 |
| 139104 | RASQSVSSNLA | 710 | GASTRAS | 750 | QQYGSSLT | 790 |
| 139106 | RASQSVSSKLA | 711 | GASIRAT | 751 | QQYGSSSWT | 791 |
| 139107 | RASQSVGSTNLA | 712 | DASNRAT | 752 | QQYGSSPPWT | 792 |
| 139108 | RASQSISSYLN | 713 | AASSLQS | 753 | QQSYTLA | 793 |
| 139110 | KSSESLVHNSGKTYLN | 715 | EVSNRDS | 755 | MQGTHWPGT | 795 |
| 139112 | QASEDINKFLN | 716 | DASTLQT | 756 | QQYESLPLT | 796 |
| 139113 | RASQSVGSNLA | 717 | GASTRAT | 757 | QQYNDWLPVT | 797 |

TABLE 11-continued

Light Chain Variable Domain CDRs from the sequences above according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | ID | LCDR2 | ID | LCDR3 | ID |
|---|---|---|---|---|---|---|
| 139114 | RASQSIGSSSLA | 718 | GASSRAS | 758 | QQYAGSPPFT | 798 |
| 149362 | KASQDIDDAMN | 719 | SATSPVP | 759 | LQHDNFPLT | 799 |
| 149363 | RASQDIYNNLA | 720 | AANKSQS | 760 | QHYYRFPYS | 800 |
| 149364 | RSSQSLLHSNGYNYLD | 721 | LGSNRAS | 761 | MQALQTPYT | 801 |
| 149365 | GGNNIGTKSVH | 722 | DDSVRPS | 762 | QVWDSDSEHVV | 802 |
| 149366 | SGDGLSKKYVS | 723 | RDKERPS | 763 | QAWDDTTVV | 803 |
| 149367 | RASQGIRNWLA | 724 | AASNLQS | 764 | QKYNSAPFT | 804 |
| 149368 | GGNNIGSKSVH | 725 | GKNNRPS | 765 | SSRDSSGDHLRV | 805 |
| 149369 | QGDSLGNYYAT | 726 | GTNNRPS | 766 | NSRDSSGHHLL | 806 |
| BCMA_EBB-C1978-A4 | RASQSVSSAYLA | 727 | GASTRAT | 767 | QHYGSSFNGSSLFT | 807 |
| BCMA_EBB-C1978-G1 | RASQSVSNSLA | 728 | DASSRAT | 768 | QQFGTSSGLT | 808 |
| BCMA_EBB-C1979-C1 | RASQSVSSSFLA | 729 | GASSRAT | 769 | QQYHSSPSWT | 809 |
| BCMA_EBB-C1978-C7 | RASQSVSTTFLA | 730 | GSSNRAT | 770 | QQYHSSPSWT | 810 |
| BCMA_EBB-C1978-D10 | RASQSISSYLN | 731 | AASSLQS | 771 | QQSYSTPYS | 811 |
| BCMA_EBB-C1979-C12 | RATQSIGSSFLA | 732 | GASQRAT | 772 | QHYESSPSWT | 812 |
| BCMA_EBB-C1980-G4 | RASQSVSSSYLA | 733 | GASSRAT | 773 | QQYGSPPRFT | 813 |
| BCMA_EBB-C1980-D2 | RASQSVSSSYLA | 734 | GASSRAT | 774 | QHYGSSPSWT | 814 |
| BCMA_EBB-C1978-A10 | RASQRVASNYLA | 735 | GASSRAT | 775 | QHYDSSPSWT | 815 |
| BCMA_EBB-C1978-D4 | RASQSLSSNFLA | 736 | GASNWAT | 776 | QYYGTSPMYT | 816 |
| BCMA_EBB-C1980-A2 | RSSQSLLHSNGYNYLD | 737 | LGSNRAS | 777 | MQALQTPLT | 817 |
| BCMA_EBB-C1981-C3 | RASQSVSSSYLA | 738 | GTSSRAT | 778 | QHYGNSPPKFT | 818 |

TABLE 11-continued

Light Chain Variable Domain CDRs from the
sequences above according to the Kabat numbering
scheme (Kabat et al. (1991), "Sequences of
Proteins of Immunological Interest," 5th Ed.
Public Health Service, National Institutes of
Health, Bethesda, MD)

| Candidate | LCDR1 | ID | LCDR2 | ID | LCDR3 | ID |
|---|---|---|---|---|---|---|
| BCMA_E BB-C1978-G4 | RASQSVASSFLA | 739 | GASGRAT | 779 | QHYGGSPRLT | 819 |
| A7D12.2 | RASQDVNTAVS | 740 | SASYRYT | 780 | QQHYSTPWT | 820 |
| C11D5.3 | RASESVSVIGAHLIH | 741 | LASNLET | 781 | LQSRIFPRT | 821 |
| C12A3.2 | RASESVTILGSHLIY | 742 | LASNVQT | 782 | LQSRTIPRT | 822 |
| C13F12.1 | RASESVTILGSHLIY | 743 | LASNVQT | 783 | LQSRTIPRT | 823 |

In one embodiment, the BCMA binding domain comprises one or more (e.g., all three) light chain complementary determining region 1 (LC CDR1), light chain complementary determining region 2 (LC CDR2), and light chain complementary determining region 3 (LC CDR3) of a BCMA binding domain described herein, e.g., provided in Table 8, 9 or 11, and/or one or more (e.g., all three) heavy chain complementary determining region 1 (HC CDR1), heavy chain complementary determining region 2 (HC CDR2), and heavy chain complementary determining region 3 (HC CDR3) of a BCMA binding domain described herein, e.g., provided in Table 8, 9 or 10. In one embodiment, the BCMA binding domain comprises one, two, or all of LC CDR1, LC CDR2, and LC CDR3 of any amino acid sequences as provided in Table 8; and one, two or all of HC CDR1, HC CDR2, and HC CDR3 of any amino acid sequences as provided in Table 8.

In one embodiment, the BCMA antigen binding domain comprises:

(i) (a) a LC CDR1 amino acid sequence of SEQ ID NO: 714, a LC CDR2 amino acid sequence of SEQ ID NO: 754, and a LC CDR3 amino acid sequence of SEQ ID NO: 794; and
  (b) a HC CDR1 amino acid sequence of SEQ ID NO: 594, a HC CDR2 amino acid sequence of SEQ ID NO: 634, and a HC CDR3 amino acid sequence of SEQ ID NO: 674

(ii) (a) a LC CDR1 amino acid sequence of SEQ ID NO: 704, a LC CDR2 amino acid sequence of SEQ ID NO: 744, and a LC CDR3 amino acid sequence of SEQ ID NO: 784; and
  (b) a HC CDR1 amino acid sequence of SEQ ID NO: 584, a HC CDR2 amino acid sequence of SEQ ID NO: 624, and a HC CDR3 amino acid sequence of SEQ ID NO: 664

(iii) (a) a LC CDR1 amino acid sequence of SEQ ID NO: 705, a LC CDR2 amino acid sequence of SEQ ID NO: 745, and a LC CDR3 amino acid sequence of SEQ ID NO: 785; and
  (b) a HC CDR1 amino acid sequence of SEQ ID NO: 585, a HC CDR2 amino acid sequence of SEQ ID NO: 625, and a HC CDR3 amino acid sequence of SEQ ID NO: 665

(iv) (a) a LC CDR1 amino acid sequence of SEQ ID NO: 706, a LC CDR2 amino acid sequence of SEQ ID NO: 746, and a LC CDR3 amino acid sequence of SEQ ID NO: 786; and
  (b) a HC CDR1 amino acid sequence of SEQ ID NO: 586, a HC CDR2 amino acid sequence of SEQ ID NO: 626, and a HC CDR3 amino acid sequence of SEQ ID NO: 666

(v) (a) a LC CDR1 amino acid sequence of SEQ ID NO: 707, a LC CDR2 amino acid sequence of SEQ ID NO: 747, and a LC CDR3 amino acid sequence of SEQ ID NO: 787; and
  (b) a HC CDR1 amino acid sequence of SEQ ID NO: 587, a HC CDR2 amino acid sequence of SEQ ID NO: 627, and a HC CDR3 amino acid sequence of SEQ ID NO: 667

(vi) (a) a LC CDR1 amino acid sequence of SEQ ID NO: 708, a LC CDR2 amino acid sequence of SEQ ID NO: 748, and a LC CDR3 amino acid sequence of SEQ ID NO: 788; and
  (b) a HC CDR1 amino acid sequence of SEQ ID NO: 588, a HC CDR2 amino acid sequence of SEQ ID NO: 628, and a HC CDR3 amino acid sequence of SEQ ID NO: 668

(vii) (a) a LC CDR1 amino acid sequence of SEQ ID NO: 709, a LC CDR2 amino acid sequence of SEQ ID NO: 749, and a LC CDR3 amino acid sequence of SEQ ID NO: 789; and
  (b) a HC CDR1 amino acid sequence of SEQ ID NO: 589, a HC CDR2 amino acid sequence of SEQ ID NO: 629, and a HC CDR3 amino acid sequence of SEQ ID NO: 669

(viii) (a) a LC CDR1 amino acid sequence of SEQ ID NO: 710, a LC CDR2 amino acid sequence of SEQ ID NO: 750, and a LC CDR3 amino acid sequence of SEQ ID NO: 790; and
  (b) a HC CDR1 amino acid sequence of SEQ ID NO: 590, a HC CDR2 amino acid sequence of SEQ ID NO: 630, and a HC CDR3 amino acid sequence of SEQ ID NO: 670

(ix) (a) a LC CDR1 amino acid sequence of SEQ ID NO: 711, a LC CDR2 amino acid sequence of SEQ ID NO: 751, and a LC CDR3 amino acid sequence of SEQ ID NO: 791; and
  (b) a HC CDR1 amino acid sequence of SEQ ID NO: 591, a HC CDR2 amino acid sequence of SEQ ID NO: 631, and a HC CDR3 amino acid sequence of SEQ ID NO: 671

(x) (a) a LC CDR1 amino acid sequence of SEQ ID NO: 712, a LC CDR2 amino acid sequence of SEQ ID NO: 752, and a LC CDR3 amino acid sequence of SEQ ID NO: 792; and
(b) a HC CDR1 amino acid sequence of SEQ ID NO: 592, a HC CDR2 amino acid sequence of SEQ ID NO: 632, and a HC CDR3 amino acid sequence of SEQ ID NO: 672

(xi) (a) a LC CDR1 amino acid sequence of SEQ ID NO: 713, a LC CDR2 amino acid sequence of SEQ ID NO: 753, and a LC CDR3 amino acid sequence of SEQ ID NO: 793; and
(b) a HC CDR1 amino acid sequence of SEQ ID NO: 593, a HC CDR2 amino acid sequence of SEQ ID NO: 633, and a HC CDR3 amino acid sequence of SEQ ID NO: 673

(xii) (a) a LC CDR1 amino acid sequence of SEQ ID NO: 715, a LC CDR2 amino acid sequence of SEQ ID NO: 755, and a LC CDR3 amino acid sequence of SEQ ID NO: 795; and
(b) a HC CDR1 amino acid sequence of SEQ ID NO: 595, a HC CDR2 amino acid sequence of SEQ ID NO: 635, and a HC CDR3 amino acid sequence of SEQ ID NO: 675

(xiii) (a) a LC CDR1 amino acid sequence of SEQ ID NO: 716, a LC CDR2 amino acid sequence of SEQ ID NO: 756, and a LC CDR3 amino acid sequence of SEQ ID NO: 796; and
(b) a HC CDR1 amino acid sequence of SEQ ID NO: 596, a HC CDR2 amino acid sequence of SEQ ID NO: 636, and a HC CDR3 amino acid sequence of SEQ ID NO: 676

(xiv) (a) a LC CDR1 amino acid sequence of SEQ ID NO: 717, a LC CDR2 amino acid sequence of SEQ ID NO: 757, and a LC CDR3 amino acid sequence of SEQ ID NO: 797; and
(b) a HC CDR1 amino acid sequence of SEQ ID NO: 597, a HC CDR2 amino acid sequence of SEQ ID NO: 637, and a HC CDR3 amino acid sequence of SEQ ID NO: 677

(xv) (a) a LC CDR1 amino acid sequence of SEQ ID NO: 718, a LC CDR2 amino acid sequence of SEQ ID NO: 758, and a LC CDR3 amino acid sequence of SEQ ID NO: 798; and
(b) a HC CDR1 amino acid sequence of SEQ ID NO: 598, a HC CDR2 amino acid sequence of SEQ ID NO: 638, and a HC CDR3 amino acid sequence of SEQ ID NO: 678

(xvi) (a) a LC CDR1 amino acid sequence of SEQ ID NO: 719, a LC CDR2 amino acid sequence of SEQ ID NO: 759, and a LC CDR3 amino acid sequence of SEQ ID NO: 799; and
(b) a HC CDR1 amino acid sequence of SEQ ID NO: 599, a HC CDR2 amino acid sequence of SEQ ID NO: 639, and a HC CDR3 amino acid sequence of SEQ ID NO: 679

(xvii) (a) a LC CDR1 amino acid sequence of SEQ ID NO: 720, a LC CDR2 amino acid sequence of SEQ ID NO: 760, and a LC CDR3 amino acid sequence of SEQ ID NO: 800; and
(b) a HC CDR1 amino acid sequence of SEQ ID NO: 600, a HC CDR2 amino acid sequence of SEQ ID NO: 640, and a HC CDR3 amino acid sequence of SEQ ID NO: 680

(xviii) (a) a LC CDR1 amino acid sequence of SEQ ID NO: 721, a LC CDR2 amino acid sequence of SEQ ID NO: 761, and a LC CDR3 amino acid sequence of SEQ ID NO: 801; and
(b) a HC CDR1 amino acid sequence of SEQ ID NO: 601, a HC CDR2 amino acid sequence of SEQ ID NO: 641, and a HC CDR3 amino acid sequence of SEQ ID NO: 681

(xix) (a) a LC CDR1 amino acid sequence of SEQ ID NO: 722, a LC CDR2 amino acid sequence of SEQ ID NO: 762, and a LC CDR3 amino acid sequence of SEQ ID NO: 802; and
(b) a HC CDR1 amino acid sequence of SEQ ID NO: 602, a HC CDR2 amino acid sequence of SEQ ID NO: 642, and a HC CDR3 amino acid sequence of SEQ ID NO: 682

(xx) (a) a LC CDR1 amino acid sequence of SEQ ID NO: 723, a LC CDR2 amino acid sequence of SEQ ID NO: 763, and a LC CDR3 amino acid sequence of SEQ ID NO: 803; and
(b) a HC CDR1 amino acid sequence of SEQ ID NO: 603, a HC CDR2 amino acid sequence of SEQ ID NO: 643, and a HC CDR3 amino acid sequence of SEQ ID NO: 683

(xxi) (a) a LC CDR1 amino acid sequence of SEQ ID NO: 724, a LC CDR2 amino acid sequence of SEQ ID NO: 764, and a LC CDR3 amino acid sequence of SEQ ID NO: 804; and
(b) a HC CDR1 amino acid sequence of SEQ ID NO: 604, a HC CDR2 amino acid sequence of SEQ ID NO: 644, and a HC CDR3 amino acid sequence of SEQ ID NO: 684

(xxii) (a) a LC CDR1 amino acid sequence of SEQ ID NO: 725, a LC CDR2 amino acid sequence of SEQ ID NO: 765, and a LC CDR3 amino acid sequence of SEQ ID NO: 805; and
(b) a HC CDR1 amino acid sequence of SEQ ID NO: 605, a HC CDR2 amino acid sequence of SEQ ID NO: 645, and a HC CDR3 amino acid sequence of SEQ ID NO: 685 or (xxiii) (a) a LC CDR1 amino acid sequence of SEQ ID NO: 726, a LC CDR2 amino acid sequence of SEQ ID NO: 766, and a LC CDR3 amino acid sequence of SEQ ID NO: 806; and
(b) a HC CDR1 amino acid sequence of SEQ ID NO: 606, a HC CDR2 amino acid sequence of SEQ ID NO: 646, and a HC CDR3 amino acid sequence of SEQ ID NO: 686.

In one embodiment, the BCMA binding domain comprises a light chain variable region described herein (e.g., in Table 8 or 9) and/or a heavy chain variable region described herein (e.g., in Table 8 or 9). In one embodiment, the BCMA binding domain is a scFv comprising a light chain and a heavy chain of an amino acid sequence listed in Table 8 or 9. In an embodiment, the BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 8 or 9, or a sequence with 95-99% identity with an amino acid sequence provided in Table 8 or 9; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 8 or 9, or a sequence with 95-99% identity to an amino acid sequence provided in Table 8 or 9.

In one embodiment, the BCMA binding domain comprises an amino acid sequence selected from a group consisting of SEQ ID NO: 249; SEQ ID NO: 239, SEQ ID NO: 240; SEQ ID NO: 241; SEQ ID NO: 242; SEQ ID NO: 243; SEQ ID NO: 244, SEQ ID NO: 245, SEQ ID NO: 246, SEQ ID NO: 247, SEQ ID NO: 248, SEQ ID NO: 250, SEQ ID NO: 251, SEQ ID NO: 252, SEQ ID NO: 253, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 463, SEQ ID NO: 464, SEQ ID NO: 465 and SEQ ID NO: 466; or an amino acid sequence having at least one, two or three modifications (e.g., substitutions, e.g., conservative substitutions) but not more than 30, 20 or 10 modifications (e.g., substitutions, e.g., conservative substitutions) to any of the aforesaid sequences; or a sequence with 95-99% identity to any of the aforesaid sequences. In one embodiment, the BCMA binding domain is a scFv, and a light chain variable region comprising an amino acid sequence described herein, e.g., in Table 8 or 9, is attached to a heavy chain variable region comprising an amino acid sequence described herein, e.g., in Table 8 or 9, via a linker, e.g., a linker described herein. In one embodiment, the BCMA binding domain includes a (Gly4-Ser)n linker, wherein n is 1, 2, 3, 4, 5, or 6 (SEQ ID NO: 10561), preferably 3 (SEQ ID NO: 35). The light chain variable region and heavy chain variable region of a scFv can be, e.g., in any of the following orientations: light chain variable region-linker-heavy chain variable region or heavy chain variable region-linker-light chain variable region.

Any known BCMA CAR, e.g., the BCMA antigen binding domain of any known BCMA CAR, in the art can be used in accordance with the instant disclosure. For example, those described herein.

Exemplary CAR Molecules

In one aspect, a CAR, e.g., a CAR expressed by a cell disclosed herein, comprises a CAR molecule comprising an antigen binding domain that binds to a B cell antigen, e.g., as described herein, such as CD19 or BCMA.

In one embodiment, the CAR comprises a CAR molecule comprising a CD19 antigen binding domain (e.g., a murine, human or humanized antibody or antibody fragment that specifically binds to CD19), a transmembrane domain, and an intracellular signaling domain (e.g., an intracellular signaling domain comprising a costimulatory domain and/or a primary signaling domain).

Exemplary CAR molecules described herein are provided in Table 12. The CAR molecules in Table 12 comprise a CD19 antigen binding domain, e.g., an amino acid sequence of any CD19 antigen binding domain provided in Table 4. Any of the exemplary CAR molecules listed below, or combinations thereof, can be used with the cells and methods disclosed herein.

TABLE 12

Exemplary CD19 CAR molecules

| Antigen | Name | Amino Acid Sequence | SEQ ID NO: |
|---|---|---|---|
| CD19 | CTL019 | MALPVTALLLPLALLLHAARPDIQMTQTTSSLSASLGDRVTISCRASQ DISKYLNWYQQKPDGTVKLLIYHTSRLHSGVPSRFSGSGSGTDYSLTI SNLEQEDIATYFCQQGNTLPYTFGGGTKLEITGGGGSGGGGSGGGGSE VKLQESGPGLVAPSQSLSVTCTVSGVSLPDYGVSWIRQPPRKGLEWLG VIWGSETTYYNSALKSRLTIIKDNSKSQVFLKMNSLQTDDTAIYYCAK HYYYGGSYAMDYWGQGTSVIVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 185 |
| CD19 | CAR 1 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSQ VQLQESGPGLVKPSETLSLTCTVSGVSLPDYGVSWIRQPPGKGLEWIG VIWGSETTYYSSSLKSRVTISKDNSKNQVSLKLSSVTAADTAVYYCAK HYYYGGSYAMDYWGQGTLVTVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 186 |
| CD19 | CAR 2 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSQ VQLQESGPGLVKPSETLSLTCTVSGVSLPDYGVSWIRQPPGKGLEWIG VIWGSETTYYQSSLKSRVTISKDNSKNQVSLKLSSVTAADTAVYYCAK HYYYGGSYAMDYWGQGTLVTVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 187 |

TABLE 12-continued

Exemplary CD19 CAR molecules

| Antigen | Name | Amino Acid Sequence | SEQ ID NO: |
|---|---|---|---|
| CD19 | CAR 3 | MALPVTALLLPLALLLHAARPQVQLQESGPGLVKPSETLSLTCTVSGV SLPDYGVSWIRQPPGKGLEWIGVIWGSETTYYSSSLKSRVTISKDNSK NQVSLKLSSVTAADTAVYYCAKHYYYGGSYAMDYWGQGTLVTVSSGGG GSGGGGSGGGGSEIVMTQSPATLSLSPGERATLSCRASQDISKYLNWY QQKPGQAPRLLIYHTSRLHSGIPARFSGSGSGTDYTLTISSLQPEDFA VYFCQQGNTLPYTFGQGTKLEIKTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 188 |
| CD19 | CAR 4 | MALPVTALLLPLALLLHAARPQVQLQESGPGLVKPSETLSLTCTVSGV SLPDYGVSWIRQPPGKGLEWIGVIWGSETTYYQSSLKSRVTISKDNSK NQVSLKLSSVTAADTAVYYCAKHYYYGGSYAMDYWGQGTLVTVSSGGG GSGGGGSGGGGSEIVMTQSPATLSLSPGERATLSCRASQDISKYLNWY QQKPGQAPRLLIYHTSRLHSGIPARFSGSGSGTDYTLTISSLQPEDFA VYFCQQGNTLPYTFGQGTKLEIKTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPR | 189 |
| CD19 | CAR 5 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSG GGGSQVQLQESGPGLVKPSETLSLTCTVSGVSLPDYGVSWIRQPPGKG LEWIGVIWGSETTYYSSSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 190 |
| CD19 | CAR 6 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSG GGGSQVQLQESGPGLVKPSETLSLTCTVSGVSLPDYGVSWIRQPPGKG LEWIGVIWGSETTYYQSSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 191 |
| CD19 | CAR 7 | MALPVTALLLPLALLLHAARPQVQLQESGPGLVKPSETLSLTCTVSGV SLPDYGVSWIRQPPGKGLEWIGVIWGSETTYYSSSLKSRVTISKDNSK NQVSLKLSSVTAADTAVYYCAKHYYYGGSYAMDYWGQGTLVTVSSGGG GSGGGGSGGGGSGGGGSEIVMTQSPATLSLSPGERATLSCRASQDISK YLNWYQQKPGQAPRLLIYHTSRLHSGIPARFSGSGSGTDYTLTISSLQ PEDFAVYFCQQGNTLPYTFGQGTKLEIKTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 192 |
| CD19 | CAR 8 | MALPVTALLLPLALLLHAARPQVQLQESGPGLVKPSETLSLTCTVSGV SLPDYGVSWIRQPPGKGLEWIGVIWGSETTYYQSSLKSRVTISKDNSK NQVSLKLSSVTAADTAVYYCAKHYYYGGSYAMDYWGQGTLVTVSSGGG GSGGGGSGGGGSGGGGSEIVMTQSPAILSLSPGERATLSCRASQDISK YLNWYQQKPGQAPRLLIYHTSRLHSGIPARFSGSGSGTDYTLTISSLQ PEDFAVYFCQQGNTLPYTFGQGTKLEIKTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 193 |

TABLE 12-continued

Exemplary CD19 CAR molecules

| Antigen | Name | Amino Acid Sequence | SEQ ID NO: |
|---|---|---|---|
| CD19 | CAR 9 | MALPVTALLLPLALLLHAARPEIVMTQSPAILSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSG GGGSQVQLQESGPGLVKPSETLSLICTVSGVSLPDYGVSWIRQPPGKG LEWIGVIWGSETTYYNSSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 194 |
| CD19 | CAR 10 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSG GGGSQVQLQESGPGLVKPSETLSLTCTVSGVSLPDYGVSWIRQPPGKG LEWIGVIWGSETTYYNSSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 195 |
| CD19 | CAR 11 | MALPVTALLLPLALLLHAARPQVQLQESGPGLVKPSETLSLTCTVSGV SLPDYGVSWIRQPPGKGLEWIGVIWGSETTYYNSSLKSRVTISKDNSK NQVSLKLSSVTAADTAVYYCAKHYYYGGSYAMDYWGQGTLVTVSSGGG GSGGGGSGGGGSGGGGSEIVMTQSPATLSLSPGERATLSCRASQDISK YLNWYQQKPGQAPRLLIYHTSRLHSGIPARFSGSGSGTDYTLTISSLQ PEDFAVYFCQQGNTLPYTFGQGTKLEIKTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 196 |
| CD19 | CAR 12 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSQ VQLQESGPGLVKPSETLSLICTVSGVSLPDYGVSWIRQPPGKGLEWIG VIWGSETTYYNSSLKSRVTISKDNSKNQVSLKLSSVTAADTAVYYCAK HYYYGGSYAMDYWGQGTLVTVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 197 |

In one embodiment, the CAR molecule comprises (or consists of) an amino acid sequence as provided in Table 12, or in Table 3 of International Publication No. WO2014/153270, filed Mar. 15, 2014; incorporated herein by reference. In one embodiment, the CAR molecule comprises (or consists of) an amino acid sequence of SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, or SEQ ID NO: 197; or an amino acid sequence having at least one, two, three, four, five, 10, 15, 20 or 30 modifications (e.g., substitutions, e.g., conservative substitutions) but not more than 60, 50, or 40 modifications (e.g., substitutions, e.g., conservative substitutions) of an amino acid sequence of SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, or SEQ ID NO: 197; or an amino acid sequence having 85%, 90%, 95%, 96%, 97%, 98%, 99% identity to an amino acid sequence of SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, or SEQ ID NO: 197.

In one aspect, a CAR, e.g., a CAR expressed by a cell disclosed herein, comprises a CAR molecule comprising an antigen binding domain that binds to BCMA, e.g., comprises a BCMA antigen binding domain (e.g., a murine, human or humanized antibody or antibody fragment that specifically binds to BCMA, e.g., human BCMA), a transmembrane domain, and an intracellular signaling domain (e.g., an intracellular signaling domain comprising a costimulatory domain and/or a primary signaling domain).

Exemplary CAR molecules are provided in Table 13, or Table 1 of WO2016/014565, or as otherwise described herein. The CAR molecules in Table 13 comprise a BCMA antigen binding domain, e.g., an amino acid sequence of any BCMA antigen binding domain provided in Table 8 or 9. of the exemplary CAR molecules listed below, or combinations thereof, can be used with the cells and methods disclosed herein.

TABLE 13

Exemplary BCMA CAR molecules.
Sequences are provided with a leader sequence.

| Name/Description | SEQ ID NO: | Sequence |
| --- | --- | --- |
| 139109 | | |
| 139109-aa Full CAR | 859 | MALPVTALLLPLALLLHAARPEVQLVESGGGLVQPGGSLRLSCAVSGFALS NHGMSWVRRAPGKGLEWVSGIVYSGSTYYAASVKGRFTISRDNSRNTLYLQ MNSLRPEDTAIYYCSAHGGESDVWGQGTTVTVSSASGGGGSGGRASGGGGS DIQLTQSPSSLSASVGDRVTITCRASQSISSYLNWYQQKPGKAPKLLIYAA SSLQSGVPSRFSGSGSGTDFTLTISSLQPEDFATYYCQQSYSTPYTFGQGT KVEIKTTTPAPRPPTPAPTIASQPLSLRPEACRPAAGGAVHTRGLDFACDI YIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDG LYQGLSTATKDTYDALHMQALPPR |
| 139109-nt Full CAR | 874 | ATGGCCCTCCCTGTCACCGCCCTGCTGCTTCCGCTGGCTCTTCTGCTCCAC GCCGCTCGGCCCGAAGTGCAATTGGTGGAATCAGGGGGAGGACTTGTGCAG CCTGGAGGATCGCTGAGACTGTCATGTGCCGTGTCCGGCTTTGCCCTGTCC AACCACGGGATGTCCTGGGTCCGCCGCGCGCCTGGAAAGGGCCTCGAATGG GTGTCGGGTATTGTGTACAGCGGTAGCACCTACTATGCCGCATCCGTGAAG GGGAGATTCACCATCAGCCGGGACAACTCCAGGAACACTCTGTACCTCCAA ATGAATTCGCTGAGGCCAGAGGACACTGCCATCTACTACTGCTCCGCGCAT GGCGGAGAGTCCGACGTCTGGGGACAGGGGACCACCGTGACCGTGTCTAGC GCGTCCGGCGGAGGCGGCAGCGGGGGTCGGGCATCAGGGGGCGGCGGATCG GACATCCAGCTCACCCAGTCCCCGAGCTCGCTGTCCGCCTCCGTGGGAGAT CGGGTCACCATCACGTGCCGCGCCAGCCAGTCGATTTCCTCCTACCTGAAC TGGTACCAACAGAAGCCCGGAAAAGCCCCGAAGCTTCTCATCTACGCCGCC TCGAGCCTGCAGTCAGGAGTGCCCTCACGGTTCTCCGGCTCCGGTTCCGGT ACTGATTTCACCCTGACCATTTCCTCCCTGCAACCGGAGGACTTCGCTACT TACTACTGCCAGCAGTCGTACTCCACCCCCTACACTTTCGGACAAGGCACC AAGGTCGAAATCAAGACCACTACCCCAGCACCGAGGCCACCCACCCCGGCT CCTACCATCGCCTCCCAGCCTCTGTCCCTGCGTCCGGAGGCATGTAGACCC GCAGCTGGTGGGGCCGTGCATACCCGGGGTCTTGACTTCGCCTGCGATATC TACATTTGGGCCCCTCTGGCTGGTACTTGCGGGGTCCTGCTGCTTTCACTC GTGATCACTCTTTACTGTAAGCGCGGTCGGAAGAAGCTGCTGTACATCTTT AAGCAACCCTTCATGAGGCCTGTGCAGACTACTCAAGAGGAGGACGGCTGT TCATGCCGGTTCCCAGAGGAGGAGGAAGGCGGCTGCGAACTGCGCGTGAAA TTCAGCCGCAGCGCAGATGCTCCAGCCTACAAGCAGGGGCAGAACCAGCTC TACAACGAACTCAATCTTGGTCGGAGAGAGGAGTACGACGTGCTGGACAAG CGGAGAGGACGGGACCCAGAAATGGGCGGGAAGCCGCGCAGAAAGAATCCC CAAGAGGGCCTGTACAACGAGCTCCAAAAGGATAAGATGGCAGAAGCCTAT AGCGAGATTGGTATGAAAGGGGAACGCAGAAGAGGCAAAGGCCACGACGGA CTGTACCAGGGACTCAGCACCGCCACCAAGGACACCTATGACGCTCTTCAC ATGCAGGCCCTGCCGCCTCGG |
| 139103 | | |
| 139103-aa Full CAR | 849 | MALPVTALLLPLALLLHAARPQVQLVESGGGLVQPGRSLRLSCAASGFTFS NYAMSWVRQAPGKGLGWVSGISRSGENTYYADSVKGRFTISRDNSKNTLYL QMNSLRDEDTAVYYCARSPAHYYGGMDVWGQGTTVTVSSASGGGGSGGRAS GGGGSDIVLTQSPGTLSLSPGERATLSCRASQSISSSFLAWYQQKPGQAPR LLIYGASRRATGIPDRFSGSGSGTDFTLTISRLEPEDSAVYYCQQYHSSPS WTFGQGTKLEIKTTTPAPRPPTPAPTIASQPLSLRPEACRPAAGGAVHTRG LDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRRE EYDVLDKRRGRDPEMGGKPRRKNPQEGLYNELQKDKMAEAYSEIGMKGERR RGKGHDGLYQGLSTATKDTYDALHMQALPPR |
| 139103-nt Full CAR | 864 | ATGGCCCTCCCTGTCACCGCCCTGCTGCTTCCGCTGGCTCTTCTGCTCCAC GCCGCTCGGCCCCAAGTGCAACTCGTGGAATCTGGTGGAGGACTCGTGCAA CCCGGAAGATCGCTTAGACTGTCGTGTGCCGCCAGCGGGTTCACTTTCTCG AACTACGCGATGTCCTGGGTCCGCCAGGCACCCGGAAAGGGACTCGGTTGG GTGTCCGGCATTTCCCGGTCCGGCGAAAATACCTACTACGCCGACTCCGTG AAGGGCCGCTTCACCATCTCAAGGGACAACAGCAAAAACACCCTGTACTTG CAAATGAACTCCCTGCGGGATGAAGATACAGCCGTGTACTATTGCGCCCGG TCGCCTGCCCATTACTACGGCGGAATGGACGTCTGGGGACAGGGAACCACT GTGACTGTCAGCAGCGCGTCGGGTGGCGGCGGCTCAGGGGGTCGGGCCTCC GGGGGGGGAGGGTCCGACATCGTGCTGACCCAGTCCCCGGGAACCCTGAGC CTGAGCCCGGGAGAGCGCGCGACCCTGTCATGCCGGGCATCCCAGAGCATT AGCTCCTCCTTTCTCGCCTGGTATCAGCAGAAGCCCGGACAGGCCCCGAGG CTGCTGATCTACGGCGCTAGCAGAAGGGCTACCGGAATCCCAGACCGGTTC TCCGGCTCCGGTTCCGGGACCGATTTCACCCTTACTATCTCGCGCCTGGAA CCTGAGGACTCCGCCGTCTACTACTGCCAGCAGTACCACTCATCCCCGTCG TGGACGTTCGGACAGGGCACCAAGCTGGAGATTAAGACCACTACCCCAGCA CCGAGGCCACCCACCCCGGCTCCTACCATCGCCTCCCAGCCTCTGTCCCTG CGTCCGGAGGCATGTAGACCCGCAGCTGGTGGGGCCGTGCATACCCGGGGT CTTGACTTCGCCTGCGATATCTACATTTGGGCCCCTCTGGCTGGTACTTGC |

TABLE 13-continued

Exemplary BCMA CAR molecules.
Sequences are provided with a leader sequence.

| Name/ Description | SEQ ID NO: | Sequence |
|---|---|---|
| | | GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| 139105 | | |
| 139105-aa Full CAR | 850 | MALPVTALLLPLALLLHAARPQVQLVESGGGLVQPGRSLRLSCAASGFTFD<br>DYAMHWVRQAPGKGLEWVSGISWNSGSIGYADSVKGRFTISRDNAKNSLYL<br>QMNSLRAEDTALYYCSVHSFLAYWGQGTLVTVSSASGGGGSGGRASGGGGS<br>DIVMTQTPLSLPVTPGEPASISCRSSQSLLHSNGYNYLDWYLQKPGQSPQL<br>LIYLGSNRASGVPDRFSGSGSGTDFTLKISRVEAEDVGVYYCMQALQTPYT<br>FGQGTKVEIKTTTPAPRPPTPAPTIASQPLSLRPEACRPAAGGAVHTRGLD<br>FACDIYIWAPLAGTCGVLLLSLVITLYCKRGRKKLLYIFKQPFMRPVQTTQ<br>EEDGCSCRFPEEEEGGCELRVKFSRSADAPAYKQGQNQLYNELNLGRREEY<br>DVLDKRRGRDPEMGGKPRRKNPQEGLYNELQKDKMAEAYSEIGMKGERRRG<br>KGHDGLYQGLSTATKDTYDALHMQALPPR |
| 139105-nt Full CAR | 865 | ATGGCCCTCCCTGTCACCGCCCTGCTGCTTCCGCTGGCTCTTCTGCTCCAC<br>GCCGCTCGGCCCAAGTGCAACTCGTCGAATCCGGTGGAGGTCTGGTCCAA<br>CCTGGTAGAAGCCTGAGACTGTCGTGTGCGGCCAGCGGATTCACCTTTGAT<br>GACTATGCTATGCACTGGGTGCGGCAGGCCCCAGGAAAGGGCCTGGAATGG<br>GTGTCGGGAATTAGCTGGAACTCCGGGTCCATTGGCTACGCCGACTCCGTG<br>AAGGGCCGCTTCACCATCTCCCGCGACAACGCAAAGAACTCCCTGTACTTG<br>CAAATGAACTCGCTCAGGGCTGAGGATACCGCGCTGTACTACTGCTCCGTG<br>CATTCCTTCCTGGCCTACTGGGGACAGGGAACTCTGGTCACCGTGTCGAGC<br>GCCTCCGGCGGCGGGGGCTCGGGTGGACGGGCCTCGGGCGGAGGGGGGTCC<br>GACATCGTGATGACCCAGACCCCGCTGAGCTTGCCCGTGACTCCCGGAGAG<br>CCTGCATCCATCTCCTGCCGGTCATCCCAGTCCCTTCTCCACTCCAACGGA<br>TACAACTACCTCGACTGGTACCTCCAGAAGCCGGGACAGAGCCCTCAGCTT<br>CTGATCTACCTGGGGTCAAATAGAGCCTCAGGAGTGCCGGATCGGTTCAGC<br>GGATCTGGTTCGGGAACTGATTTCACTCTGAAGATTTCCCGCGTGGAAGCC<br>GAGGACGTGGGCGTCTACTACTGTATGCAGGCGCTGCAGACCCCCTATACC<br>TTCGGCCAAGGGACGAAAGTGGAGATCAAGACCACTACCCCAGCACCGAGG<br>CCACCCACCCCGGCTCCTACCATCGCCTCCCAGCCTCTGTCCCTGCGTCCG<br>GAGGCATGTAGACCCGCAGCTGGTGGGCCGTGCATACCCGGGGTCTTGAC<br>TTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAG<br>CTGCTGTACATCTTTAAGCAACCCTTCATGAGGCCTGTGCAGACTACTCAA<br>GAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAG<br>GGGCAGAACCAGCTCTACAACGAACTCAATCTTGGTCGGAGAGAGGAGTAC<br>GACGTGCTGGACAAGCGGAGAGGACGGGACCCAGAAATGGGCGGGAAGCCG<br>CGCAGAAAGAATCCCCAAGAGGGCCTGTACAACGAGCTCCAAAAGGATAAG<br>ATGGCAGAAGCCTATAGCGAGATTGGTATGAAAGGGGAACGCAGAAGAGGC<br>AAAGGCCACGACGGACTGTACCAGGGACTCAGCACCGCCACCAAGGACACC<br>TATGACGCTCTTCACATGCAGGCCCTGCCGCCTCGG |
| 139111 | | |
| 139111-aa Full CAR | 851 | MALPVTALLLPLALLLHAARPEVQLLESGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>DIVMTQTPLSLSVTPGQPASISCKSSQSLLRNDGKTPLYWYLQKAGQPPQL<br>LIYEVSNRFSGVPDRFSGSGSGTDFTLKISRVEAEDVGAYYCMQNIQFPSF<br>GGGTKLEIKTTTPAPRPPTPAPTIASQPLSLRPEACRPAAGGAVHTRGLDF<br>ACDIYIWAPLAGTCGVLLLSLVITLYCKRGRKKLLYIFKQPFMRPVQTTQE<br>EDGCSCRFPEEEEGGCELRVKFSRSADAPAYKQGQNQLYNELNLGRREEYD<br>VLDKRRGRDPEMGGKPRRKNPQEGLYNELQKDKMAEAYSEIGMKGERRRGK<br>GHDGLYQGLSTATKDTYDALHMQALPPR |
| 139111-nt Full CAR | 866 | ATGGCCCTCCCTGTCACCGCCCTGCTGCTTCCGCTGGCTCTTCTGCTCCAC<br>GCCGCTCGGCCCAAGTGCAATTGTTGGAATCTGGAGGAGGACTTGTGCAG<br>CCTGGAGGATCACTGAGACTTTCGTGTGCGGTGTCAGGCTTCGCCCTGAGC<br>AACCACGGCATGAGCTGGGTGCGAGAGCCCCGGGGAAGGGTCTGGAATGG<br>GTGTCCGGGATCGTCTACTCCGGTTCAACTTACTACGCCGCAAGCGTGAAG<br>GGTCGCTTCACCATTTCCCGCGATAACTCCCGGAACACCCTGTACCTCCAA<br>ATGAACTCCCTGCGGCCCGAGGACACCGCCATCTACTACTGTTCCGCGCAT<br>GGAGGAGAGTCCGATGTCTGGGGACAGGGCACTACCGTGACCGTGTCGAGC |

TABLE 13-continued

Exemplary BCMA CAR molecules.
Sequences are provided with a leader sequence.

| Name/ Description | SEQ ID NO: | Sequence |
| --- | --- | --- |
|  |  | GCCTCGGGGGAGGAGGCTCCGGCGGTCGCGCCTCCGGGGGGGTGGCAGC
GACATTGTGATGACGCAGACTCCACTCTCGCTGTCCGTGACCCCGGGACAG
CCCGCGTCCATCTCGTGCAAGAGCTCCCAGAGCCTGCTGAGGAACGACGGA
AAGACTCCTCTGTATTGGTACCTCCAGAAGGCTGGACAGCCCCCGCAACTG
CTCATCTACGAAGTGTCAAATCGCTTCTCCGGGGTGCCGGATCGGTTTTCC
GGCTCGGGATCGGGCACCGACTTCACCCTGAAAATCTCCAGGGTCGAGGCC
GAGGACGTGGGAGCCTACTACTGCATGCAAAACATCCAGTTCCCTTCCTTC
GGCGGCGGCACAAAGCTGGAGATTAAGACCACTACCCCAGCACCGAGGCCA
CCCACCCCGGCTCCTACCATCGCCTCCCAGCCTCTGTCCCTGCGTCCGGAG
GCATGTAGACCCGCAGCTGGTGGGCCGTGCATACCCGGGGTCTTGACTTC
GCCTGCGATATCTACATTTGGGCCCCTCTGGCTGGTACTTGCGGGGTCCTG
CTGCTTTCACTCGTGATCACTCTTTACTGTAAGCGCGGTCGGAAGAAGCTG
CTGTACATCTTTAAGCAACCCTTCATGAGGCCTGTGCAGACTACTCAAGAG
GAGGACGGCTGTTCATGCCGGTTCCCAGAGGAGGAGGAAGGCGGCTGCGAA
CTGCGCGTGAAATTCAGCCGCAGCGCAGATGCTCCAGCCTACAAGCAGGGG
CAGAACCAGCTCTACAACGAACTCAATCTTGGTCGGAGAGAGGAGTACGAC
GTGCTGGACAAGCGGAGAGGACGGGACCCAGAAATGGGCGGGAAGCCGCGC
AGAAAGAATCCCCAAGAGGGCCTGTACAACGAGCTCCAAAAGGATAAGATG
GCAGAAGCCTATAGCGAGATTGGTATGAAAGGGGAACGCAGAAGAGGCAAA
GGCCACGACGGACTGTACCAGGGACTCAGCACCGCCACCAAGGACACCTAT
GACGCTCTTCACATGCAGGCCCTGCCGCCTCGG |
| 139100 |  |  |
| 139100-aa Full CAR | 852 | MALPVTALLLPLALLLHAARPQVQLVQSGAEVRKTGASVKVSCKASGYIFD
NEGINWVRQAPGQGLEWMGWINPKNNNTNYAQKFQGRVTITADESTNTAYM
EVSSLRSEDTAVYYCARGPYYYQSYMDVWGQGTMVTVSSASGGGGSGGRAS
GGGGSDIVMTQTPLSLPVTPGEPASISCRSSQSLLHSNGYNYLNWYLQKPG
QSPQLLIYLGSKRASGVPDRFSGSGSGTDFTLHITRVGAEDVGVYYCMQAL
QTPYTFGQGTKLEIKTTTPAPRPPTPAPTIASQPLSLRPEACRPAAGGAVH
TRGLDFACDIYIWAPLAGTCGVLLLSLVITLYCKRGRKKLLYIFKQPFMRP
VQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKG
ERRRGKGHDGLYQGLSTATKDTYDALHMQALPPR |
| 139100-nt Full CAR | 867 | ATGGCCCTCCCTGTCACCGCCCTGCTGCTTCCGCTGCTCTTCTGCTCCAC
GCCGCTCGGCCCCAAGTCCAACTCGTCCAGTCCGGCGCAGAAGTCAGAAAA
ACCGGTGCTAGCGTGAAAGTGTCCTGCAAGGCCTCCGGCTACATTTTCGAT
AACTTCGGAATCAACTGGGTCAGACAGGCCCCGGGCCAGGGGCTGGAATGG
ATGGGATGGATCAACCCCAAGAACAACAACACCAACTACGCACAGAAGTTC
CAGGGCCGCGTGACTATCACCGCCGATGAATCGACCAATACCGCCTACATG
GAGGTGTCCTCCCTGCGGTCGGAGGACACTGCCGTGTATTACTGCGCGAGG
GGCCCATACTACTACCAAAGCTACATGGACGTCTGGGGACAGGGAACCATG
GTGACCGTGTCATCCGCCTCCGGTGGTGGAGGCTCCGGGGGGCGGGCTTCA
GGAGGCGGAGGAAGCGATATTGTGATGACCCAGACTCCGCTTAGCCTGCCC
GTGACTCCTGGAGAACCGGCCTCCATTTCCTGCCGGTCCTCGCAATCACTC
CTGCATTCCAACGGTTACAACTACCTGAATTGGTACCTCCAGAAGCCTGGC
CAGTCGCCCCAGTTGCTGATCTATCTGGGCTCGAAGCGCGCCTCCGGGGTG
CCTGACCGGTTTAGCGGATCTGGGAGCGGCACGGACTTCACTCTCCACATC
ACCCGCGTGGGAGCGGAGGACGTGGGAGTGTACTACTGTATGCAGGCGCTG
CAGACTCCGTACACATTCGGACAGGGCACCAAGCTGGAGATCAAGACCACT
ACCCCAGCACCGAGGCCACCCACCCCGGCTCCTACCATCGCCTCCCAGCCT
CTGTCCCTGCGTCCGGAGGCATGTAGACCCGCAGCTGGTGGGGCCGTGCAT
ACCCGGGGTCTTGACTTCGCCTGCGATATCTACATTTGGGCCCCTCTGGCT
GGTACTTGCGGGGTCCTGCTGCTTTCACTCGTGATCACTCTTTACTGTAAG
CGCGGTCGGAAGAAGCTGCTGTACATCTTTAAGCAACCCTTCATGAGGCCT
GTGCAGACTACTCAAGAGGAGGACGGCTGTTCATGCCGGTTCCCAGAGGAG
GAGGAAGGCGGCTGCGAACTGCGCGTGAAATTCAGCCGCAGCGCAGATGCT
CCAGCCTACAAGCAGGGGCAGAACCAGCTCTACAACGAACTCAATCTTGGT
CGGAGAGAGGAGTACGACGTGCTGGACAAGCGGAGAGGACGGGACCCAGAA
ATGGGCGGGAAGCCGCGCAGAAAGAATCCCCAAGAGGGCCTGTACAACGAG
CTCCAAAAGGATAAGATGGCAGAAGCCTATAGCGAGATTGGTATGAAAGGG
GAACGCAGAAGAGGCAAAGGCCACGACGGACTGTACCAGGGACTCAGCACC
GCCACCAAGGACACCTATGACGCTCTTCACATGCAGGCCCTGCCGCCTCGG |
| 139101 |  |  |
| 139101-aa Full CAR | 853 | MALPVTALLLPLALLLHAARPQVQLQESGGGLVQPGGSLRLSCAASGFTFS
SDAMTWVRQAPGKGLEWVSISGSGGTTYYADSVKGRFTISRDNSKNTLYL
QMNSLRAEDTAVYYCAKLDSSGYYYARGPRYWGQGTLVTVSSASGGGGSGG
RASGGGGSDIQLTQSPSSLSASVGDRVTITCRASQSISSYLNWYQQKPGKA
PKLLIYGASTLASGVPARFSGSGSGTHFTLTINSLQSEDSATYYCQQSYKR
ASFGQGTKVEIKTTTPAPRPPTPAPTIASQPLSLRPEACRPAAGGAVHTRG
LDFACDIYIWAPLAGTCGVLLLSLVITLYCKRGRKKLLYIFKQPFMRPVQT |

TABLE 13-continued

Exemplary BCMA CAR molecules.
Sequences are provided with a leader sequence.

| Name/<br>Description | SEQ<br>ID<br>NO: | Sequence |
|---|---|---|
| | | TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| 139101-nt<br>Full CAR | 868 | ATGGCCCTCCCTGTCACCGCCCTGCTGCTTCCGCTGGCTCTTCTGCTCCAC<br>GCCGCTCGGCCCCAAGTGCAACTTCAAGAATCAGGCGGAGGACTCGTGCAG<br>CCCGGAGGATCATTGCGGCTCTCGTGCGCCGCCTCGGGCTTCACCTTCTCG<br>AGCGACGCCATGACCTGGGTCCGCCAGGCCCCGGGGAAGGGGCTGGAATGG<br>GTGTCTGTGATTTCCGGCTCCGGGGGAACTACGTACTACGCCGATTCCGTG<br>AAAGGTCGCTTCACTATCTCCCGGGACAACAGCAAGAACACCCTTTATCTG<br>CAAATGAATTCCCTCCGCGCCGAGGACACCGCCGTGTACTACTGCGCCAAG<br>CTGGACTCCTCGGGCTACTACTATGCCCGGGGTCCGAGATACTGGGGACAG<br>GGAACCCTCGTGACCGTGTCCTCCGCGTCCGGCGGAGGAGGTCGGGAGGG<br>CGGGCCTCCGGCGGCGGCGGTTCGGACATCCAGCTGACCCAGTCCCCATCC<br>TCACTGAGCGCAAGCGTGGGCGACAGAGTCACCATTACATGCAGGGCGTCC<br>CAGAGCATCAGCTCCTACCTGAACTGGTACCAACAGAAGCCTGGAAAGGCT<br>CCTAAGCTGTTGATCTACGGGGCTTCGACCCTGGCATCCGGGGTGCCCGCG<br>AGGTTTAGCGGAAGCGGTAGCGGCACTCACTTCACTCTGACCATTAACAGC<br>CTCCAGTCCGAGGATTCAGCCACTTACTACTGTCAGCAGTCCTACAAGCGG<br>GCCAGCTTCGACAGGGCACTAAGGTCGAGATCAAGACCACTACCCCAGCA<br>CCGAGGCCACCCACCCCGGCTCCTACCATCGCCTCCCAGCCTCTGTCCCTG<br>CGTCCGGAGGCATGTAGACCCGCAGCTGGTGGGGCCGTGCATACCCGGGGT<br>CTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| 139102 | | |
| 139102-aa<br>Full CAR | 854 | MALPVTALLLPLALLLHAARPQVQLVQSGAEVKKPGASVKVSCKASGYTFS<br>NYGITWVRQAPGQGLEWMGWISAYNGNTNYAQKFQGRVTMTRNTSISTAYM<br>ELSSLRSEDTAVYYCARGPYYYYMDVWGKGTMVTVSSASGGGGSGGRASGG<br>GGSEIVMTQSPLSLPVTPGEPASISCRSSQSLLYSNGYNYVDWYLQKPGQS<br>PQLLIYLGSNRASGVPDRFSGSGSGTDFKLQISRVEAEDVGIYYCMQGRQF<br>PYSFGQGTKVEIKTTTPAPRPPTPAPTIASQPLSLRPEACRPAAGGAVHTR<br>GLDFACDIYIWAPLAGTCGVLLLSLVITLYCKRGRKKLLYIFKQPFMRPVQ<br>TTQEEDGCSCRFPEEEEGGCELRVKFSRSADAPAYKQGQNQLYNELNLGRR<br>EEYDVLDKRRGRDPEMGGKPRRKNPQEGLYNELQKDKMAEAYSEIGMKGER<br>RRGKGHDGLYQGLSTATKDTYDALHMQALPPR |
| 139102-nt<br>Full CAR | 869 | ATGGCCCTCCCTGTCACCGCCCTGCTGCTTCCGCTGGCTCTTCTGCTCCAC<br>GCCGCTCGGCCCCAAGTCCAACTGGTCCAGAGCGGTGCAGAAGTGAAGAAG<br>CCCGGAGCGAGCGTGAAAGTGTCCTGCAAGGCTTCCGGGTACACCTTCTCC<br>AACTACGGCATCACTTGGGTGCGCCAGGCCCCGGGACAGGGCCTGGAATGG<br>ATGGGGTGGATTTCCGCGTACAACGGCAATACGAACTACGCTCAGAAGTTC<br>CAGGGTAGAGTGACCATGACTAGGAACACCTCCATTTCCACCGCCTACATG<br>GAACTGTCCTCCCTGCGGAGCGAGGACACCGCCGTGTACTATTGCGCCCGG<br>GGACCATACTACTACTACATGGATGTCTGGGGGAAGGGGACTATGGTCACC<br>GTGTCATCCGCCTCGGGAGGCGGCGGATCAGGAGGACGCGCCTCTGGTGGT<br>GGAGGATCGGAGATCGTGATGACCCAGAGCCCTCTCTCCTTGCCCGTGACT<br>CCTGGGGAGCCCGCATCCATTTCATGCCGGAGCTCCCAGTCACTTCTCTAC<br>TCCAACGGCTATAACTACGTGGATTGGTACCTCCAAAAGCCGGGCCAGAGC<br>CCGCAGCTGCTGATCTACCTGGGCTCGAACAGGGCCAGCGGAGTGCCTGAC<br>CGGTTCTCCGGGTCGGGAAGCGGGACCGACTTCAAGCTGCAAATCTCGAGA<br>GTGGAGGCCGAGGACGTGGGAATCTACTACTGTATGCAGGGCCGCCAGTTT<br>CCGTACTCGTTCGGACAGGGCACCAAAGTGGAAATCAAGACCACTACCCCA<br>GCACCGAGGCCACCCACCCCGGCTCCTACCATCGCCTCCCAGCCTCTGTCC<br>CTGCGTCCGGAGGCATGTAGACCCGCAGCTGGTGGGGCCGTGCATACCCGG<br>GGTCTTGACTTCGCCTGCGATATCTACATTTGGGCCCCTCTGGCTGGTACT<br>TGCGGGGTCCTGCTGCTTTCACTCGTGATCACTCTTTACTGTAAGCGCGGT<br>CGGAAGAAGCTGCTGTACATCTTTAAGCAACCCTTCATGAGGCCTGTGCAG<br>ACTACTCAAGAGGAGGACGGCTGTTCATGCCGGTTCCCAGAGGAGGAGGAA<br>GGCGGCTGCGAACTGCGCGTGAAATTCAGCCGCAGCGCAGATGCTCCAGCC<br>TACAAGCAGGGGCAGAACCAGCTCTACAACGAACTCAATCTTGGTCGGAGA<br>GAGGAGTACGACGTGCTGGACAAGCGGAGAGGACGGGACCCAGAAATGGGC<br>GGGAAGCCGCGCAGAAAGAATCCCCAAGAGGGCCTGTACAACGAGCTCCAA |

TABLE 13-continued

Exemplary BCMA CAR molecules.
Sequences are provided with a leader sequence.

| Name/ Description | SEQ ID NO: | Sequence |
|---|---|---|
| | | AAGGATAAGATGGCAGAAGCCTATAGCGAGATTGGTATGAAAGGGGAACGC AGAAGAGGCAAAGGCCACGACGGACTGTACCAGGGACTCAGCACCGCCACC AAGGACACCTATGACGCTCTTCACATGCAGGCCCTGCCGCCTCGG |

139104

| | | |
|---|---|---|
| 139104-aa Full CAR | 855 | MALPVTALLLPLALLLHAARPEVQLLETGGGLVQPGGSLRLSCAVSGFALS NHGMSWVRRAPGKGLEWVSGIVYSGSTYYAASVKGRFTISRDNSRNTLYLQ MNSLRPEDTAIYYCSAHGGESDVWGQGTTVTVSSASGGGGSGGRASGGGGS EIVLTQSPATLSVSPGESATLSCRASQSVSSNLAWYQQKPGQAPRLLIYGA STRASGIPDRFSGSGSGTDFTLTISSLQAEDVAVYYCQQYGSSLTFGGGTK VEIKTTTPAPRPPTPAPTIASQPLSLRPEACRPAAGGAVHTRGLDFACDIY IWAPLAGTCGVLLLSLVITLYCKRGRKKLLYIFKQPFMRPVQTTQEEDGCS CRFPEEEEGGCELRVKFSRSADAPAYKQGQNQLYNELNLGRREEYDVLDKR RGRDPEMGGKPRRKNPQEGLYNELQKDKMAEAYSEIGMKGERRRGKGHDGL YQGLSTATKDTYDALHMQALPPR |
| 139104-nt Full CAR | 870 | ATGGCCCTCCCTGTCACCGCCCTGCTGCTTCCGCTGGCTCTTCTGCTCCAC GCCGCTCGGCCCGAAGTGCAATTGCTCGAAACTGGAGGAGGTCTGGTGCAA CCTGGAGGATCACTTCGCCTGTCCTGCGCCGTGTCGGGCTTTGCCCTGTCC AACCATGGAATGAGCTGGGTCCGCCGCGCGCCGGGGAAGGGCCTCGAATGG GTGTCCGGCATCGTCTACTCCGGCTCCACCTACTACGCCGCGTCCGTGAAG GGCCGGTTCACGATTTCACGGGACAACTCGCGGAACACCCTGTACCTCCAA ATGAATTCCCTTCGGCCGGAGGATACTGCCATCTACTACTGCTCCGCCCAC GGTGGCGAATCCGACGTCTGGGGCCAGGGAACCACCGTGACCGTGTCCAGC GCGTCCGGGGGAGGAGGAAGCGGGGGTAGAGCATCGGGTGGAGGCGGATCA GAGATCGTGCTGACCCAGTCCCCCGCCACCTTGAGCGTGTCACCAGGAGAG TCCGCCACCCTGTCATGCCGCGCCAGCCAGTCCGTGTCCTCCAACCTGGCT TGGTACCAGCAGAAGCCGGGGCAGGCCCCTAGACTCCTGATCTATGGGGCG TCGACCCGGGCATCTGGAATTCCCGATAGGTTCAGCGGATCGGGCTCGGGC ACTGACTTCACTCTGACCATCTCCTCGCTGCAAGCCGAGGACGTGGCTGTG TACTACTGTCAGCAGTACGGAAGCTCCCTGACTTTCGGTGGCGGGACCAAA GTCGAGATTAAGACCACTACCCCAGCACCGAGGCCACCCACCCCGGCTCCT ACCATCGCCTCCCAGCCTCTGTCCCTGCGTCCGGAGGCATGTAGACCCGCA GCTGGTGGGCCGTGCATACCCGGGGTCTTGACTTCGCCTGCGATATCTAC ATTTGGGCCCCTCTGGCTGGTACTTGCGGGGTCCTGCTGCTTTCACTCGTG ATCACTCTTTACTGTAAGCGCGGTCGGAAGAAGCTGCTGTACATCTTTAAG CAACCCTTCATGAGGCCTGTGCAGACTACTCAAGAGGAGGACGGCTGTTCA TGCCGGTTCCCAGAGGAGGAGGAAGGCGGCTGCGAACTGCGCGTGAAATTC AGCCGCAGCGCAGATGCTCCAGCCTACAAGCAGGGGCAGAACCAGCTCTAC AACGAACTCAATCTTGGTCGGAGAGAGGAGTACGACGTGCTGGACAAGCGG AGAGGACGGGACCCAGAAATGGGCGGGAAGCCGCGCAGAAAGAATCCCCAA GAGGGCCTGTACAACGAGCTCCAAAAGGATAAGATGGCAGAAGCCTATAGC GAGATTGGTATGAAAGGGGAACGCAGAAGAGGCAAAGGCCACGACGGACTG TACCAGGGACTCAGCACCGCCACCAAGGACACCTATGACGCTCTTCACATG CAGGCCCTGCCGCCTCGG |

139106

| | | |
|---|---|---|
| 139106-aa Full CAR | 856 | MALPVTALLLPLALLLHAARPEVQLVETGGGLVQPGGSLRLSCAVSGFALS NHGMSWVRRAPGKGLEWVSGIVYSGSTYYAASVKGRFTISRDNSRNTLYLQ MNSLRPEDTAIYYCSAHGGESDVWGQGTTVTVSSASGGGGSGGGGSGGGGS EIVMTQSPATLSVSPGERATLSCRASQSVSSKLAWYQQKPGQAPRLLMYGA SIRATGIPDRFSGSGSGTEFTLTISSLEPEDFAVYYCQQYGSSSWIFGQGT KVEIKTTTPAPRPPTPAPTIASQPLSLRPEACRPAAGGAVHTRGLDFACDI YIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDG LYQGLSTATKDTYDALHMQALPPR |
| 139106-nt Full CAR | 871 | ATGGCCCTCCCTGTCACCGCCCTGCTGCTTCCGCTGGCTCTTCTGCTCCAC GCCGCTCGGCCCGAAGTGCAATTGGTGGAAACTGGAGGAGGTCTGGTGCAA CCTGGAGGATCATTGAGACTGAGCTGCGCAGTGTCGGGATTCGCCCTGAGC AACCATGGAATGTCCTGGGTCAGAAGGGCCCCTGGAAAAGGCCTCGAATGG GTGTCAGGGATCGTGTACTCCGGTTCCACTTACTACGCCGCCTCCGTGAAG GGGCGCTTCACTATCTCACGGGATAACTCCCGCAATACCCTGTACCTCCAA ATGAACAGCCTGCGGCCGGAGGATACCGCCATCTACTACTGTTCCGCCCAC GGTGGAGAGTCTGACGTCTGGGGCCAGGGAACTACCGTGACCGTGTCCTCC GCGTCCGGCGGTGGAGGGAGCGGCGGCCGCGCCAGCGGCGGCGGAGGCTCC GAGATCGTGATGACCCAGAGCCCCGCTACTCTGTCGGTGTCGCCCGGAGAA AGGGCGACCCTGTCCTGCCGGGCGTCGCAGTCCGTGAGCAGCAAGCTGGCT TGGTACCAGCAGAAGCCGGGCCAGGCACCACGCCTGCTTATGTACGGTGCC TCCATTCGGGCCACCGGAATCCCGGACCGGTTCTCGGGGTCGGGGTCCGGT ACCGAGTTCACACTGACCATTTCCTGCTCGAGCCCGAGGACTTTGCCGTC TATTACTGCCAGCAGTACGGCTCCTCCTCATGGACGTTCGGCCAGGGGACC |

TABLE 13-continued

Exemplary BCMA CAR molecules.
Sequences are provided with a leader sequence.

| Name/<br>Description | SEQ<br>ID<br>NO: | Sequence |
|---|---|---|
| | | AAGGTCGAAATCAAGACCACTACCCCAGCACCGAGGCCACCCACCCCGGCT<br>CCTACCATCGCCTCCCAGCCTCTGTCCCTGCGTCCGGAGGCATGTAGACCC<br>GCAGCTGGTGGGGCCGTGCATACCCGGGGTCTTGACTTCGCCTGCGATATC<br>TACATTTGGGCCCCTCTGGCTGGTACTTGCGGGGTCCTGCTGCTTTCACTC<br>GTGATCACTCTTTACTGTAAGCGCGGTCGGAAGAAGCTGCTGTACATCTTT<br>AAGCAACCCTTCATGAGGCCTGTGCAGACTACTCAAGAGGAGGACGGCTGT<br>TCATGCCGGTTCCCAGAGGAGGAGGAAGGCGGCTGCGAACTGCGCGTGAAA<br>TTCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAAG<br>CGGAGAGGACGGGACCCAGAAATGGGCGGGAAGCCGCGCAGAAAGAATCCC<br>CAAGAGGGCCTGTACAACGAGCTCCAAAAGGATAAGATGGCAGAAGCCTAT<br>AGCGAGATTGGTATGAAAGGGGAACGCAGAAGAGGCAAAGGCCACGACGGA<br>CTGTACCAGGGACTCAGCACCGCCACCAAGGACACCTATGACGCTCTTCAC<br>ATGCAGGCCCTGCCGCCTCGG |
| 139107 | | |
| 139107-aa<br>Full CAR | 857 | MALPVTALLLPLALLLHAARPEVQLVETGGGVVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>EIVLTQSPGTLSLSPGERATLSCRASQSVGSTNLAWYQQKPGQAPRLLIYD<br>ASNRATGIPDRFSGGGSGTDFTLTISRLEPEDFAVYYCQQYGSSPPWTFGQ<br>GTKVEIKTTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGH<br>DGLYQGLSTATKDTYDALHMQALPPR |
| 139107-nt<br>Full CAR | 872 | ATGGCCCTCCCTGTCACCGCCCTGCTGCTTCCGCTGGCTCTTCTGCTCCAC<br>GCCGCTCGGCCCGAAGTGCAATTGGTGGAGACTGGAGGAGGAGTGGTGCAA<br>CCTGGAGGAAGCCTGAGACTGTCATGCGCGGTGTCGGGCTTCGCCCTCTCC<br>AACCACGGAATGTCCTGGGTCCGCCGGGCCCCTGGGAAAGGACTTGAATGG<br>GTGTCCGGCATCGTGTACTCGGGTTCCACCTACTACGCGGCCTCAGTGAAG<br>GGCCGGTTTACTATTAGCCGCGACAACTCCAGAAACACACTGTACCTCCAA<br>ATGAACTCGCTGCGGCCGGAAGATACCGCTATCTACTACTGCTCCGCCCAT<br>GGGGGAGAGTCGGACGTCTGGGGACAGGGCACCACTGTCACTGTGTCCAGC<br>GCTTCCGGCGGTGGTGGAAGCGGGGGACGGGCCTCAGGAGGCGGTGGCAGC<br>GAGATTGTGCTGACCCAGTCCCCCGGGACCCTGAGCCTGTCCCCGGGAGAA<br>AGGGCCACCCTCTCCTGTCGGGCATCCCAGTCCGTGGGGTCTACTAACCTT<br>GCATGGTACCAGCAGAAGCCCGGCCAGGCCCCTCGCCTGCTGATCTACGAC<br>GCGTCCAATAGAGCCACCGGCATCCCGGATCGCTTCAGCGGAGGCGGATCG<br>GGCACCGACTTCACCCTCACCATTTCAAGGCTGGAACCGGAGGACTTCGCC<br>GTGTACTACTGCCAGCAGTATGGTTCGTCCCACCCTGGACGTTCGGCCAG<br>GGGACTAAGGTCGAGATCAAGACCACTACCCCAGCACCGAGGCCACCCACC<br>CCGGCTCCTACCATCGCCTCCCAGCCTCTGTCCCTGCGTCCGGAGGCATGT<br>AGACCCGCAGCTGGTGGGGCCGTGCATACCCGGGGTCTTGACTTCGCCTGC<br>GATATCTACATTTGGGCCCCTCTGGCTGGTACTTGCGGGGTCCTGCTGCTT<br>TCACTCGTGATCACTCTTTACTGTAAGCGCGGTCGGAAGAAGCTGCTGTAC<br>ATCTTTAAGCAACCCTTCATGAGGCCTGTGCAGACTACTCAAGAGGAGGAC<br>GGCTGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAGAAC<br>CAGCTCTACAACGAACTCAATCTTGGTCGGAGAGAGGAGTACGACGTGCTG<br>GACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAA<br>GCCTATAGCGAGATTGGTATGAAAGGGGAACGCAGAAGAGGCAAAGGCCAC<br>GACGGACTGTACCAGGGACTCAGCACCGCCACCAAGGACACCTATGACGCT<br>CTTCACATGCAGGCCCTGCCGCCTCGG |
| 139108 | | |
| 139108-aa<br>Full CAR | 858 | MALPVTALLLPLALLLHAARPQVQLVESGGGLVKPGGSLRLSCAASGFTFS<br>DYYMSWIRQAPGKGLEWVSYISSSGSTIYYADSVKGRFTISRDNAKNSLYL<br>QMNSLRAEDTAVYYCARESGDGMDVWGQGTTVTVSSASGGGGSGGRASGGG<br>GSDIQMTQSPSSLSASVGDRVTITCRASQSISSYLNWYQQKPGKAPKLLIY<br>AASSLQSGVPSRFSGSGSGTDFTLTISSLQPEDFATYYCQQSYTLAFGQGT<br>KVDIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDK<br>RRGRDPEMGGKPRRKNPQEGLYNELQKDKMAEAYSEIGMKGERRRGKGHDG<br>LYQGLSTATKDTYDALHMQALPPR |
| 139108-nt<br>Full CAR | 873 | ATGGCCCTCCCTGTCACCGCCCTGCTGCTTCCGCTGGCTCTTCTGCTCCAC<br>GCCGCTCGGCCCCAAGTGCAACTCGTGGAATCTGGTGGAGGACTCGTGAAA<br>CCTGGAGGATCATTGAGACTGTCATGCGCGGCCTCGGGATTCACGTTCTCC<br>GATTACTACATGAGCTGGATTCGCCAGGCTCCGGGGAAGGGACTGGAATGG |

TABLE 13-continued

Exemplary BCMA CAR molecules.
Sequences are provided with a leader sequence.

| Name/ Description | SEQ ID NO: | Sequence |
|---|---|---|
| | | GTGTCCTACATTTCCTCATCCGGCTCCACCATCTACTACGCGGACTCCGTG AAGGGGAGATTCACCATTAGCCGCGATAACGCCAAGAACAGCCTGTACCTT CAGATGAACTCCCTGCGGGCTGAAGATACTGCCGTCTACTACTGCGCAAGG GAGAGCGGAGATGGGATGGACGTCTGGGGACAGGGTACCACTGTGACCGTG TCGTCGGCCTCCGGCGGAGGGGGTTCGGGTGGAAGGGCCAGCGGCGGCGGA GGCAGCGACATCCAGATGACCCAGTCCCCCTCATCGCTGTCCGCTCCGTG GGCGACCGCGTCACCATCACATGCCGGGCCTCACAGTCGATCTCCTCCTAC CTCAATTGGTATCAGCAGAAGCCCGGAAAGGCCCCTAAGCTTCTGATCTAC GCAGCGTCCTCCCTGCAATCCGGGGTCCCATCTCGGTTCTCCGGCTCGGGC AGCGGTACCGACTTCACTCTGACCATCTCGAGCCTGCAGCCGGAGGACTTC GCCACTTACTACTGTCAGCAAAGCTACACCCTCGCGTTTGGCCAGGGCACC AAAGTGGACATCAAGACCACTACCCCAGCACCGAGGCCACCCACCCCGGCT CCTACCATCGCCTCCCAGCCTCTGTCCCTGCGTCCGGAGGCATGTAGACCC GCAGCTGGTGGGGCCGTGCATACCCGGGGTCTTGACTTCGCCTGCGATATC TACATTTGGGCCCCTCTGGCTGGTACTTGCGGGGTCCTGCTGCTTTCACTC GTGATCACTCTTTACTGTAAGCGCGGTCGGAAGAAGCTGCTGTACATCTTT AAGCAACCCTTCATGAGGCCTGTGCAGACTACTCAAGAGGAGGACGGCTGT TCATGCCGGTTCCCAGAGGAGGAGGAAGGCGGCTGCGAACTGCGCGTGAAA TTCAGCCGCAGCGCAGATGCTCCAGCCTACAAGCAGGGGCAGAACCAGCTC TACAACGAACTCAATCTTGGTCGGAGAGAGGAGTACGACGTGCTGGACAAG CGGAGAGGACGGGACCCAGAAATGGGCGGGAAGCCGCGCAGAAAGAATCCC CAAGAGGGCCTGTACAACGAGCTCCAAAAGGATAAGATGGCAGAAGCCTAT AGCGAGATTGGTATGAAAGGGGAACGCAGAAGAGGCAAAGGCCACGACGGA CTGTACCAGGGACTCAGCACCGCCACCAAGGACACCTATGACGCTCTTCAC ATGCAGGCCCTGCCGCCTCGG |

139110

| 139110-aa Full CAR | 860 | MALPVTALLLPLALLLHAARPQVQLVQSGGGLVKPGGSLRLSCAASGFTFS DYYMSWIRQAPGKGLEWVSYISSSGNTIYYADSVKGRFTISRDNAKNSLYL QMNSLRAEDTAVYYCARSTMVREDYWGQGTLVTVSSASGGGGSGGRASGGG GSDIVLTQSPLSLPVTLGQPASISCKSSESLVHNSGKTYLNWFHQRPGQSP RRLIYEVSNRDSGVPDRFTGSGSGTDFTLKISRVEAEDVGVYYCMQGTHWP GTFGQGTKLEIKTTTPAPRPPTPAPTIASQPLSLRPEACRPAAGGAVHTRG LDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRRE EYDVLDKRRGRDPEMGGKPRRKNPQEGLYNELQKDKMAEAYSEIGMKGERR RGKGHDGLYQGLSTATKDTYDALHMQALPPR |
| 139110-nt Full CAR | 875 | ATGGCCCTCCCTGTCACCGCCCTGCTGCTTCCGCTGGCTCTTCTGCTCCAC GCCGCTCGGCCCCAAGTGCAACTGGTGCAAAGCGGAGGAGGATTGGTCAAA CCCGGAGGAAGCCTGAGACTGTCATGCGCGGCCTCTGGATTCACCTTCTCC GATTACTACATGTCATGGATCAGACAGGCCCCGGGGAAGGGCCTCGAATGG GTGTCCTACATCTCGTCCTCCGGGAACACCATCTACTACGCCGACAGCGTG AAGGGCCGCTTTACCATTTCCCGCGACAACGCAAAGAACTCGCTGTACCTT CAGATGAATTCCCTGCGGGCTGAAGATACCGCGGTGTACTATTGCGCCCGG TCCACTATGGTCCGGGAGGACTACTGGGGACAGGGCACACTCGTGACCGTG TCCAGCGCGAGCGGGGGTGGAGGCAGCGGTGGACGCGCCTCCGGCGGCGGC GGTTCAGACATCGTGCTGACTCAGTCGCCCCTGTCGCTGCCGGTCACCCTG GGCCAACCGGCCTCAATTAGCTGCAAGTCCTCGGAGAGCCTGGTGCACAAC TCAGGAAAGACTTACCTGAACTGGTTCCATCAGCGGCCTGGACAGTCCCCA CGGAGGCTCATCTATGAAGTGTCAACAGGGATTCGGGGGTGCCCGACCGC TTCACTGGCTCCGGGTCCGGCACCGACTTCACCTTGAAAATCTCCAGAGTG GAAGCCGAGGACGTGGGCGTGTACTACTGTATGCAGGGTACCCACTGGCCT GGAACCTTTGGACAAGGAACTAAGCTCGAGATTAAGACCACTACCCCAGCA CCGAGGCCACCCACCCCGGCTCCTACCATCGCCTCCCAGCCTCTGTCCCTG CGTCCGGAGGCATGTAGACCCGCAGCTGGTGGGGCCGTGCATACCCGGGGT CTTGACTTCGCCTGCGATATCTACATTTGGGCCCCTCTGGCTGGTACTTGC GGGGTCCTGCTGCTTTCACTCGTGATCACTCTTTACTGTAAGCGCGGTCGG AAGAAGCTGCTGTACATCTTTAAGCAACCCTTCATGAGGCCTGTGCAGACT ACTCAAGAGGAGGACGGCTGTTCATGCCGGTTCCCAGAGGAGGAGGAAGGC GGCTGCGAACTGCGCGTGAAATTCAGCCGCAGCGCAGATGCTCCAGCCTAC AAGCAGGGGCAGAACCAGCTCTACAACGAACTCAATCTTGGTCGGAGAGAG GAGTACGACGTGCTGGACAAGCGGAGAGGACGGGACCCAGAAATGGGCGGG AAGCCGCGCAGAAAGAATCCCCAAGAGGGCCTGTACAACGAGCTCCAAAAG GATAAGATGGCAGAAGCCTATAGCGAGATTGGTATGAAAGGGGAACGCAGA AGAGGCAAAGGCCACGACGGACTGTACCAGGGACTCAGCACCGCCACCAAG GACACCTATGACGCTCTTCACATGCAGGCCCTGCCGCCTCGG |

139112

| 139112-aa Full CAR | 861 | MALPVTALLLPLALLLHAARPQVQLVESGGGLVQPGGSLRLSCAVSGFALS NHGMSWVRRAPGKGLEWVSGIVYSGSTYYAASVKGRFTISRDNSRNTLYLQ MNSLRPEDTAIYYCSAHGGESDVWGQGTTVTVSSASGGGGSGGRASGGGGS |

TABLE 13-continued

Exemplary BCMA CAR molecules.
Sequences are provided with a leader sequence.

| Name/Description | SEQ ID NO: | Sequence |
|---|---|---|
| | | DIRLTQSPSPLSASVGDRVTITCQASEDINKFLNWYHQTPGKAPKLLIYDA STLQTGVPSRFSGSGSGTDFTLTINSLQPEDIGTYYCQQYESLPLTFGGGT KVEIKTTTPAPRPPTPAPTIASQPLSLRPEACRPAAGGAVHTRGLDFACDI YIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDG LYQGLSTATKDTYDALHMQALPPR |
| 139112-nt Full CAR | 876 | ATGGCCCTCCCTGTCACCGCCCTGCTGCTTCCGCTGGCTCTTCTGCTCCAC GCCGCTCGGCCCCAAGTGCAACTCGTGGAATCTGGTGGAGGACTCGTGCAA CCCGGTGGAAGCCTTAGGCTGTCGTGCGCCGTCAGCGGGTTTGCTCTGAGC AACCATGGAATGTCCTGGGTCCGCCGGGCACCGGGAAAAGGGCTGGAATGG GTGTCCGGCATCGTGTACAGCGGGTCAACCTATTACGCCGCGTCCGTGAAG GGCAGATTCACTATCTCAAGAGACAACAGCCGGAACACCCTGTACTTGCAA ATGAATTCCCTGCGCCCCGAGGACACCGCCATCTACTACTGCTCCGCCCAC GGAGGAGAGTCGGACGTGTGGGGCCAGGGAACGACTGTGACTGTGTCCAGC GCATCAGGAGGGGTGGTTCGGCGGCCGGGCCTCGGGGGGAGGAGGTTCC GACATTCGGCTGACCCAGTCCCCGTCCCCACTGTCGGCCTCCGTCGGCGAC CGCGTGACCATCACTTGTCAGGCGTCCGAGGACATTAACAAGTTCCTGAAC TGGTACCACCAGACCCCTGGAAAGGCCCCCAAGCTGCTGATCTACGATGCC TCGACCCTTCAAACTGGAGTGCCTAGCCGGTTCTCCGGGTCCGGCTCCGGC ACTGATTTCACTCTGACCATCAACTCATTGCAGCCGGAAGATATCGGGACC TACTATTGCCAGCAGTACGAATCCCTCCCGCTCACATTCGGCGGGGGAACC AAGGTCGAGATTAAGACCACTACCCCAGCACCGAGGCCACCCACCCCGGCT CCTACCATCGCCTCCCAGCCTCTGTCCCTGCGTCCGGAGGCATGTAGACCC GCAGCTGGTGGGGCCGTGCATACCCGGGGTCTTGACTTCGCCTGCGATATC TACATTTGGGCCCCTCTGGCTGGTACTTGCGGGGTCCTGCTGCTTTCACTC GTGATCACTCTTTACTGTAAGCGCGGTCGGAAGAAGCTGCTGTACATCTTT AAGCAACCCTTCATGAGGCCTGTGCAGACTACTCAAGAGGAGGACGGCTGT TCATGCCGGTTCCCAGAGGAGGAGGAAGGCGGCTGCGAACTGCGCGTGAAA TTCAGCCGCAGCGCAGATGCTCCAGCCTACAAGCAGGGGCAGAACCAGCTC TACAACGAACTCAATCTTGGTCGGAGAGAGGAGTACGACGTGCTGGACAAG CGGAGAGGACGGGACCCAGAAATGGGCGGGAAGCCGCGCAGAAAGAATCCC CAAGAGGGCCTGTACAACGAGCTCCAAAAGGATAAGATGGCAGAAGCCTAT AGCGAGATTGGTATGAAAGGGGAACGCAGAAGAGGCAAAGGCCACGACGGA CTGTACCAGGGACTCAGCACCGCCACCAAGGACACCTATGACGCTCTTCAC ATGCAGGCCCTGCCGCCTCGG |

139113

| 139113-aa Full CAR | 862 | MALPVTALLLPLALLLHAARPEVQLVETGGGLVQPGGSLRLSCAVSGFALS NHGMSWVRRAPGKGLEWVSGIVYSGSTYYAASVKGRFTISRDNSRNTLYLQ MNSLRPEDTAIYYCSAHGGESDVWGQGTTVTVSSASGGGGSGGRASGGGGS ETTLTQSPATLSVSPGERATLSCRASQSVGSNLAWYQQKPGQGPRLLIYGA STRATGIPARFSGSGSGTEFTLTISSLQPEDFAVYYCQQYNDWLPVTFGQG TKVEIKTTTPAPRPPTPAPTIASQPLSLRPEACRPAAGGAVHTRGLDFACD IYIWAPLAGTCGVLLLSLVITLYCKRGRKKLLYIFKQPFMRPVQTTQEEDG CSCRFPEEEEGGCELRVKFSRSADAPAYKQGQNQLYNELNLGRREEYDVLD KRRGRDPEMGGKPRRKNPQEGLYNELQKDKMAEAYSEIGMKGERRRGKGHD GLYQGLSTATKDTYDALHMQALPPR |
| 139113-nt Full CAR | 877 | ATGGCCCTCCCTGTCACCGCCCTGCTGCTTCCGCTGGCTCTTCTGCTCCAC GCCGCTCGGCCCGAAGTGCAATTGGTGGAAACTGGAGGAGGACTTGTGCAA CCTGGAGGATCATTGCGGCTCTCATGCGCTGTCTCCGGCTTCGCCCTGTCA AATCACGGGATGTCGTGGGTCAGACGGGCCCCGGGAAAGGGTCTGGAATGG GTGTCGGGGATTGTGTACAGCGGCTCCACCTACTACGCCGCTTCGGTCAAG GGCCGCTTCACTATTTCACGGGACAACAGCCGCAACACCCTCTATCTGCAA ATGAACTCTCTCCCGCCCGGAGGATACCGCCATCTACTACTGCTCCGCACAC GGCGGCGAATCCGACGTGTGGGGACAGGGAACCACTGTCACCGTGTCGTCC GCATCCGGTGGCGGAGGATCGGGTGGCCGGGCCTCCGGGGGCGGCGGCAGC GAGACTACCCTGACCCAGTCCCCTGCCACTCTGTCCGTGAGCCCGGGAGAG AGAGCCACCCTTAGCTGCCGGGCCAGCCAGAGCGTGGGCTCCAACCTGGCC TGGTACCAGCAGAAGCCAGGACAGGGTCCCAGGCTGCTGATCTACGGAGCC TCCACTCGCGCGACCGGCATCCCCGCGAGGTTCTCCGGGTCGGGTTCCGGG ACCGAGTTCACCCTGACCATCTCCTCCCTCCAACCGGAGGACTTCGCGGTG TACTACTGTCAGCAGTACAACGATTGGCTGCCCGTGACATTTGGACAGGGG ACGAAGGTGGAAATCAAAACCACTACCCCAGCACCGAGGCCACCCACCCCG GCTCCTACCATCGCCTCCCAGCCTCTGTCCCTGCGTCCGGAGGCATGTAGA CCCGCAGCTGGTGGGGCCGTGCATACCCGGGGTCTTGACTTCGCCTGCGAT ATCTACATTTGGGCCCCTCTGGCTGGTACTTGCGGGGTCCTGCTGCTTTCA CTCGTGATCACTCTTTACTGTAAGCGCGGTCGGAAGAAGCTGCTGTACATC TTTAAGCAACCCTTCATGAGGCCTGTGCAGACTACTCAAGAGGAGGACGGC TGTTCATGCCGGTTCCCAGAGGAGGAGGAAGGCGGCTGCGAACTGCGCGTG AAATTCAGCCGCAGCGCAGATGCTCCAGCCTACAAGCAGGGGCAGAACCAG CTCTACAACGAACTCAATCTTGGTCGGAGAGAGGAGTACGACGTGCTGGAC |

TABLE 13-continued

Exemplary BCMA CAR molecules.
Sequences are provided with a leader sequence.

| Name/<br>Description | SEQ<br>ID<br>NO: | Sequence |
|---|---|---|
| | | AAGCGGAGAGGACGGGACCCAGAAATGGGCGGGAAGCCGCGCAGAAAGAAT<br>CCCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGAC<br>GGACTGTACCAGGGACTCAGCACCGCCACCAAGGACACCTATGACGCTCTT<br>CACATGCAGGCCCTGCCGCCTCGG |
| 139114 | | |
| 139114-aa<br>Full CAR | 863 | MALPVTALLLPLALLLHAARPEVQLVESGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>EIVLTQSPGTLSLSPGERATLSCRASQSIGSSSLAWYQQKPGQAPRLLMYG<br>ASSRASGIPDRFSGSGSGTDFTLTISRLEPEDFAVYYCQQYAGSPPFTFGQ<br>GTKVEIKTTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGH<br>DGLYQGLSTATKDTYDALHMQALPPR |
| 139114-nt<br>Full CAR | 878 | ATGGCCCTCCCTGTCACCGCCCTGCTGCTTCCGCTGGCTCTTCTGCTCCAC<br>GCCGCTCGGCCCGAAGTGCAATTGGTGGAATCTGGTGGAGGACTTGTGCAA<br>CCTGGAGGATCACTGAGACTGTCATGCGCGGTGTCCGGTTTTGCCCTGAGC<br>AATCATGGGATGTCGTGGGTCCGGCGCGCCCCCGGAAAGGGTCTGGAATGG<br>GTGTCGGGTATCGTCTACTCCGGGAGCACTTACTACGCCGCGAGCGTGAAG<br>GGCCGCTTCACCATTTCCCGCGATAACTCCCGCAACACCCTGTACTTGCAA<br>ATGAACTCGCTCCGGCCTGAGGACACTGCCATCTACTACTGCTCCGCACAC<br>GGAGGAGAATCCGACGTGTGGGGCCAGGGAACTACCGTGACCGTCAGCAGC<br>GCCTCCGGCGGCGGGGGCTCAGGCGGACGGGCTAGCGGCGGCGGTGGCTCC<br>GAGATCGTGCTGACCCAGTCGCCTGGCACTCTCTCGCTGAGCCCCGGGGAA<br>AGGGCAACCCTGTCCTGTCGGGCCAGCCAGTCCATTGGATCATCCTCCCTC<br>GCCTGGTATCAGCAGAAACCGGGACAGGCTCCGCGGCTGCTTATGTATGGG<br>GCCAGCTCAAGAGCCTCCGGCATTCCCGACCGGTTCTCCGGGTCCGGTTCC<br>GGCACCGATTTCACCCTGACTATCTCGAGGCTGGAGCCAGAGGACTTCGCC<br>GTGTACTACTGCCAGCAGTACGCGGGTCCCCGCCGTTCACGTTCGGACAG<br>GGAACCAAGGTCGAGATCAAGACCACTACCCCAGCACCGAGGCCACCCACC<br>CCGGCTCCTACCATCGCCTCCCAGCCTCTGTCCCTGCGTCCGGAGGCATGT<br>AGACCCGCAGCTGGTGGGGCCGTGCATACCCGGGGTCTTGACTTCGCCTGC<br>GATATCTACATTTGGGCCCCTCTGGCTGGTACTTGCGGGGTCCTGCTGCTT<br>TCACTCGTGATCACTCTTTACTGTAAGCGCGGTCGGAAGAAGCTGCTGTAC<br>ATCTTTAAGCAACCCTTCATGAGGCCTGTGCAGACTACTCAAGAGGAGGAC<br>GGCTGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAGAAC<br>CAGCTCTACAACGAACTCAATCTTGGTCGGAGAGAGGAGTACGACGTGCTG<br>GACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAA<br>GCCTATAGCGAGATTGGTATGAAAGGGGAACGCAGAAGAGGCAAAGGCCAC<br>GACGGACTGTACCAGGGACTCAGCACCGCCACCAAGGACACCTATGACGCT<br>CTTCACATGCAGGCCCTGCCGCCTCGG |
| 149362 | | |
| 149362-aa<br>Full CAR | 879 | MALPVTALLLPLALLLHAARPQVQLQESGPGLVKPSETLSLTCTVSGGSIS<br>SSYYYWGWIRQPPGKGLEWIGSIYYSGSAYYNPSLKSRVTISVDTSKNQFS<br>LRLSSVTAADTAVYYCARHWQEWPDAFDIWGQGTMVTVSSGGGGSGGGGSG<br>GGGSETTLTQSPAFMSATPGDKVIISCKASQDIDDAMNWYQQKPGEAPLFI<br>IQSATSPVPGIPPRFSGSGFGTDFSLTINNIESEDAAYYFCLQHDNFPLTF<br>GQGTKLEIKTTTPAPRPPTPAPTIASQPLSLRPEACRPAAGGAVHTRGLDF<br>ACDIYIWAPLAGTCGVLLLSLVITLYCKRGRKKLLYIFKQPFMRPVQTTQE<br>EDGCSCRFPEEEEGGCELRVKFSRSADAPAYKQGQNQLYNELNLGRREEYD<br>VLDKRRGRDPEMGGKPRRKNPQEGLYNELQKDKMAEAYSEIGMKGERRRGK<br>GHDGLYQGLSTATKDTYDALHMQALPPR |
| 149362-nt<br>Full CAR | 901 | ATGGCCCTCCCTGTCACCGCCCTGCTGCTTCCGCTGGCTCTTCTGCTCCAC<br>GCCGCTCGGCCCCAAGTGCAGCTTCAGGAAAGCGGACCGGGCCTGGTCAAG<br>CCATCCGAAACTCTCTCCCTGACTTGCACTGTGTCTGGCGGTTCCATCTCA<br>TCGTCGTACTACTACTGGGGCTGGATTAGGCAGCCGCCCGGAAAGGGACTG<br>GAGTGGATCGGAAGCATCTACTATTCCGGCTCGGCTACTACAACCCTAGC<br>CTCAAGTCGAGAGTGACCATCTCCGTGGATACCTCCAAGAACCAGTTTTCC<br>CTGCGCCTGAGCTCCGTGACCGCCGCTGACACCGCCGTGTACTACTGTGCT<br>CGGCATTGGCAGGAATGGCCCGATGCCTTCGACATTTGGGGCCAGGGCACT<br>ATGGTCACTGTGTCATCCGGGGGTGGAGGCAGCGGGGGAGGAGGGTCCGGG<br>GGGGGAGGTTCAGAGACAACCTTGACCCAGTCACCCGCATTCATGTCCGCC<br>ACTCCGGGAGACAAGGTCATCATCTCGTGCAAAGCGTCCCAGGATATCGAC<br>GATGCCATGAATTGGTACCAGCAGAAGCCTGGCGAAGCGCCGCTGTTCATT<br>ATCCAATCCGCAACCTCGCCCGTGCCTGGAATCCCACCGCGGTTCAGCGGC |

TABLE 13-continued

Exemplary BCMA CAR molecules.
Sequences are provided with a leader sequence.

| Name/Description | SEQ ID NO: | Sequence |
|---|---|---|
| | | AGCGGTTTCGGAACCGACTTTTCCCTGACCATTAACAACATTGAGTCCGAG<br>GACGCCGCCTACTACTTCTGCCTGCAACACGACAACTTCCCTCTCACGTTC<br>GGCCAGGGAACCAAGCTGGAAATCAAGACCACTACCCCAGCACCGAGGCCA<br>CCCACCCCGGCTCCTACCATCGCCTCCCAGCCTCTGTCCCTGCGTCCGGAG<br>GCATGTAGACCCGCAGCTGGTGGGGCCGTGCATACCCGGGGTCTTGACTTC<br>GCCTGCGATATCTACATTTGGGCCCCTCTGGCTGGTACTTGCGGGGTCCTG<br>CTGCTTTCACTCGTGATCACTCTTTACTGTAAGCGCGGTCGGAAGAAGCTG<br>CTGTACATCTTTAAGCAACCCTTCATGAGGCCTGTGCAGACTACTCAAGAG<br>GAGGACGGCTGTTCATGCCGGTTCCCAGAGGAGGAGGAAGGCGGCTGCGAA<br>CTGCGCGTGAAATTCAGCCGCAGCGCAGATGCTCCAGCCTACAAGCAGGGG<br>CAGAACCAGCTCTACAACGAACTCAATCTTGGTCGGAGAGAGGAGTACGAC<br>GTGCTGGACAAGCGGAGAGGACGGGACCCAGAAATGGGCGGGAAGCCGCGC<br>AGAAAGAATCCCCAAGAGGGCCTGTACAACGAGCTCCAAAAGGATAAGATG<br>GCAGAAGCCTATAGCGAGATTGGTATGAAAGGGGAACGCAGAAGAGGCAAA<br>GGCCACGACGGACTGTACCAGGGACTCAGCACCGCCACCAAGGACACCTAT<br>GACGCTCTTCACATGCAGGCCCTGCCGCCTCGG |
| 149363 | | |
| 149363-aa<br>Full CAR | 880 | MALPVTALLLPLALLLHAARPQVNLRESGPALVKPTQTLTLTCTFSGFSLR<br>TSGMCVSWIRQPPGKALEWLARIDWDEDKFYSTSLKTRLTISKDTSDNQVV<br>LRMTNMDPADTATYYCARSGAGGTSTATAFDIWGPGTMVTVSSGGGGSGGGG<br>SGGGGGSDIQMTQSPSSLSASVGDRVTITCRASQDIYNNLAWFQLKPGSAPR<br>SLMYAANKSQSGVPSRFSGSASGTDFTLTISSLQPEDFATYYCQHYYRFPY<br>SFGQGTKLEIKTTTPAPRPPTPAPTIASQPLSLRPEACRPAAGGAVHTRGL<br>DFACDIYIWAPLAGTCGVLLLSLVITLYCKRGRKKLLYIFKQPFMRPVQTT<br>QEEDGCSCRFPEEEEGGCELRVKFSRSADAPAYKQGQNQLYNELNLGRREE<br>YDVLDKRRGRDPEMGGKPRRKNPQEGLYNELQKDKMAEAYSEIGMKGERRR<br>GKGHDGLYQGLSTATKDTYDALHMQALPPR |
| 149363-nt<br>Full CAR | 902 | ATGGCCCTCCCTGTCACCGCCCTGCTGCTTCCGCTGGCTCTTCTGCTCCAC<br>GCCGCTCGGCCCCAAGTCAATCTGCGCGAATCCGGCCCCGCCTTGGTCAAG<br>CCTACCCAGACCCTCACTCTGACCTGTACTTTCTCCGGCTTCTCCCTGCGG<br>ACTTCCGGGATGTGCGTGTCCTGGATCAGACAGCCTCCGGGAAAGGCCCTG<br>GAGTGGCTCGCTCGCATTGACTGGGATGAGGACAAGTTCTACTCCACCTCA<br>CTCAAGACCAGGCTGACCATCAGCAAAGATACCTCTGACAACAAGTGGTG<br>CTCCGCATGACCAACATGGACCCAGCCGACACTGCCACTTACTACTGCGCG<br>AGGAGCGGAGCGGGCGGAACCTCCGCCACCGCCTTCGATATTTGGGGCCCG<br>GGTACCATGGTCACCGTGTCAAGCGGAGGAGGGGGGTCCGGGGCGGCGGT<br>TCCGGGGGAGGCGGATCGGACATTCAGATGACTCAGTCACCATCGTCCCTG<br>AGCGCTAGCGTGGGCGACAGAGTGACAATCACTTGCCGGGCATCCCAGGAC<br>ATCTATAACAACCTTGCGTGGTTCCAGCTGAAGCCTGGTTCCGCACCGCGG<br>TCACTTATGTACGCCGCCAACAAGAGCCAGTCGGGAGTGCCGTCCCGGTTT<br>TCCGGTTCGGCCTCGGGAACTGACTTCACCCTGACGATCTCCAGCCTGCAA<br>CCCGAGGATTTCGCCACCTACTACTGCCAGCACTACTACCGCTTTCCCTAC<br>TCGTTCGGACAGGGAACCAAGCTGGAAATCAAGACCACTACCCCAGCACCG<br>AGGCCACCCACCCCGGCTCCTACCATCGCCTCCCAGCCTCTGTCCCTGCGT<br>CCGGAGGCATGTAGACCCGCAGCTGGTGGGGCCGTGCATACCCGGGGTCTT<br>GACTTCGCCTGCGATATCTACATTTGGGCCCCTCTGGCTGGTACTTGCGGG<br>GTCCTGCTGCTTTCACTCGTGATCACTCTTTACTGTAAGCGCGGTCGGAAG<br>AAGCTGCTGTACATCTTTAAGCAACCCTTCATGAGGCCTGTGCAGACTACT<br>CAAGAGGAGGACGGCTGTTCATGCCGGTTCCCAGAGGAGGAGGAAGGCGGC<br>TGCGAACTGCGCGTGAAATTCAGCCGCAGCGCAGATGCTCCAGCCTACAAG<br>CAGGGGCAGAACCAGCTCTACAACGAACTCAATCTTGGTCGGAGAGAGGAG<br>TACGACGTGCTGGACAAGCGGAGAGGACGGGACCCAGAAATGGGCGGGAAG<br>CCGCGCAGAAAGAATCCCCAAGAGGGCCTGTACAACGAGCTCCAAAAGGAT<br>AAGATGGCAGAAGCCTATAGCGAGATTGGTATGAAAGGGGAACGCAGAAGA<br>GGCAAAGGCCACGACGGACTGTACCAGGGACTCAGCACCGCCACCAAGGAC<br>ACCTATGACGCTCTTCACATGCAGGCCCTGCCGCCTCGG |
| 149364 | | |
| 149364-aa<br>Full CAR | 881 | MALPVTALLLPLALLLHAARPEVQLVESGGGLVKPGGSLRLSCAASGFTFS<br>SYSMNWVRQAPGKGLEWVSSISSSSSYIYYADSVKGRFTISRDNAKNSLYL<br>QMNSLRAEDTAVYYCAKTIAAVYAFDIWGQGTTVTVSSGGGGSGGGGSGGG<br>GSEIVLTQSPLSLPVTPEEPASISCRSSQSLLHSNGYNYLDWYLQKPGQSP<br>QLLIYLGSNRASGVPDRFSGSGSGTDFTLKISRVEAEDVGVYYCMQALQTP<br>YTFGQGTKLEIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |

TABLE 13-continued

Exemplary BCMA CAR molecules.
Sequences are provided with a leader sequence.

| Name/Description | SEQ ID NO: | Sequence |
|---|---|---|
| 149364-nt Full CAR | 903 | ATGGCCCTCCCTGTCACCGCCCTGCTGCTTCCGCTGGCTCTTCTGCTCCAC
GCCGCTCGGCCCGAAGTGCAGCTTGTCGAATCCGGGGGGGGACTGGTCAAG
CCGGGCGGATCACTGAGACTGTCCTGCGCCGCGAGCGGCTTCACGTTCTCC
TCCTACTCCATGAACTGGGTCCGCCAAGCCCCCGGGAAGGGACTGGAATGG
GTGTCCTCTATCTCCTCGTCGTCGTCCTACATCTACTACGCCGACTCCGTG
AAGGGAAGATTCACCATTTCCCGCGACAACGCAAAGAACTCACTGTACTTG
CAAATGAACTCACTCCGGGCCGAAGATACTGCTGTGTACTATTGCGCCAAG
ACTATTGCCGCCGTCTACGCTTTCGACATCTGGGGCCAGGGAACCACCGTG
ACTGTGTCGTCCGGTGGTGGTGGCTCGGGCGGAGGAGGAAGCGGCGGCGGG
GGGTCCGAGATTGTGCTGACCCAGTCGCCACTGAGCCTCCCTGTGACCCCC
GAGGAACCCGCCAGCATCAGCTGCCGGTCCAGCCAGTCCCTGCTCCACTCC
AACGGATACAATTACCTCGATTGGTACCTTCAGAAGCCTGGACAAAGCCCG
CAGCTGCTCATCTACTTGGGATCAAACCGCGCGTCAGGAGTGCCTGACCGG
TTCTCCGGCTCGGGCAGCGGTACCGATTTCACCCTGAAAATCTCCAGGGTG
GAGGCAGAGGACGTGGGAGTGTATTACTGTATGCAGGCGCTGCAGACTCCG
TACACATTTGGGCAGGGCACCAAGCTGGAGATCAAGACCACTACCCCAGCA
CCGAGGCCACCCACCCCGGCTCCTACCATCGCCTCCCAGCCTCTGTCCCTG
CGTCCGGAGGCATGTAGACCCGCAGCTGGTGGGGCCGTGCATACCCGGGGT
CTTGACTTCGCCTGCGATATCTACATTTGGGCCCCTCTGGCTGGTACTTGC
GGGGTCCTGCTGCTTTCACTCGTGATCACTCTTTACTGTAAGCGCGGTCGG
AAGAAGCTGCTGTACATCTTTAAGCAACCCTTCATGAGGCCTGTGCAGACT
ACTCAAGAGGAGGACGGCTGTTCATGCCGGTTCCCAGAGGAGGAGGAAGGC
GGCTGCGAACTGCGCGTGAAATTCAGCCGCAGCGCAGATGCTCCAGCCTAC
AAGCAGGGGCAGAACCAGCTCTACAACGAACTCAATCTTGGTCGGAGAGAG
GAGTACGACGTGCTGGACAAGCGGAGAGGACGGGACCCAGAAATGGGCGGG
AAGCCGCGCAGAAAGAATCCCCAAGAGGGCCTGTACAACGAGCTCCAAAAG
GATAAGATGGCAGAAGCCTATAGCGAGATTGGTATGAAAGGGGAACGCAGA
AGAGGCAAAGGCCACGACGGACTGTACCAGGGACTCAGCACCGCCACCAAG
GACACCTATGACGCTCTTCACATGCAGGCCCTGCCGCCTCGG |
| 149365 | | |
| 149365-aa Full CAR | 882 | MALPVTALLLPLALLLHAARPEVQLVESGGGLVKPGGSLRLSCAASGFTFS
DYYMSWIRQAPGKGLEWVSYISSSGSTIYYADSVKGRFTISRDNAKNSLYL
QMNSLRAEDTAVYYCARDLRGAFDIWGQGTMVTVSSGGGGSGGGGSGGGGS
SYVLTQSPSVSAAPGYTATISCGGNNIGTKSVHWYQQKPGQAPLLVIRDDS
VRPSKIPGRFSGSNSGNMATLTISGVQAGDEADFYCQVWDSDSEHVVEGGG
TKLTVLTTTPAPRPPTPAPTIASQPLSLRPEACRPAAGGAVHTRGLDFACD
IYIWAPLAGTCGVLLLSLVITLYCKRGRKKLLYIFKQPFMRPVQTTQEEDG
CSCRFPEEEEGGCELRVKFSRSADAPAYKQGQNQLYNELNLGRREEYDVLD
KRRGRDPEMGGKPRRKNPQEGLYNELQKDKMAEAYSEIGMKGERRRGKGHD
GLYQGLSTATKDTYDALHMQALPPR |
| 149365-nt Full CAR | 904 | ATGGCCCTCCCTGTCACCGCCCTGCTGCTTCCGCTGGCTCTTCTGCTCCAC
GCCGCTCGGCCCGAAGTCCAGCTCGTGGAGTCCGGCGGAGGCCTTGTGAAG
CCTGGAGGTTCGCTGAGACTGTCCTGCGCCGCCTCCGGCTTCACCTTCTCC
GACTACTACATGTCCTGGATCAGACAGGCCCCGGGAAAGGGCCTGGAATGG
GTGTCCTACATCTCGTCATCGGGCAGCACTATCTACTACGCGGACTCAGTG
AAGGGGCGGTTCACCATTTCCCGGGATAACGCGAAGAACTCGCTGTATCTG
CAAATGAACTCACTGAGGGCCGAGGACACCGCCGTGTACTACTGCGCCCGC
GATCTCCGCGGGGCATTTGACATCTGGGGACAGGGAACCATGGTCACAGTG
TCCAGCGGAGGGGGAGGATCGGGTGGCGGAGGTTCCGGGGGTGGAGGCTCC
TCCTACGTGCTGACTCAGAGCCCAAGCGTCAGCGCTGCGCCCGGTTACACG
GCAACCATCTCCTGTGGCGGAAACAACATTGGGACCAAGTCTGTGCACTGG
TATCAGCAGAAGCCGGGCCAAGCTCCCCTGTTGGTGATCCGCGATGACTCC
GTGCGGCCTAGCAAAATTCCGGGACGGTTCTCCGGCTCCAACAGCGGCAAT
ATGGCCACTCTCACCATCTCGGGAGTGCAGGCCGGAGATGAAGCCGACTTC
TACTGCCAAGTCTGGGACTCAGACTCCGAGCATGTGGTGTTCGGGGCGGA
ACCAAGCTGACTGTGCTCACCACTACCCCAGCACCGAGGCCACCCACCCCG
GCTCCTACCATCGCCTCCCAGCCTCTGTCCCTGCGTCCGGAGGCATGTAGA
CCCGCAGCTGGTGGGGCCGTGCATACCCGGGGTCTTGACTTCGCCTGCGAT
ATCTACATTTGGGCCCCTCTGGCTGGTACTTGCGGGGTCCTGCTGCTTTCA
CTCGTGATCACTCTTTACTGTAAGCGCGGTCGGAAGAAGCTGCTGTACATC
TTTAAGCAACCCTTCATGAGGCCTGTGCAGACTACTCAAGAGGAGGACGGC
TGTTCATGCCGGTTCCCAGAGGAGGAGGAAGGCGGCTGCGAACTGCGCGTG
AAATTCAGCCGCAGCGCAGATGCTCCAGCCTACAAGCAGGGGCAGAACCAG
CTCTACAACGAACTCAATCTTGGTCGGAGAGAGGAGTACGACGTGCTGGAC
AAGCGGAGAGGACGGGACCCAGAAATGGGCGGGAAGCCGCGCAGAAAGAAT
CCCCAAGAGGGCCTGTACAACGAGCTCCAAAAGGATAAGATGGCAGAAGCC
TATAGCGAGATTGGTATGAAAGGGGAACGCAGAAGAGGCAAAGGCCACGAC
GGACTGTACCAGGGACTCAGCACCGCCACCAAGGACACCTATGACGCTCTT
CACATGCAGGCCCTGCCGCCTCGG |

TABLE 13-continued

Exemplary BCMA CAR molecules.
Sequences are provided with a leader sequence.

| Name/Description | SEQ ID NO: | Sequence |
|---|---|---|
| 149366 | | |
| 149366-aa Full CAR | 883 | MALPVTALLLPLALLLHAARPQVQLVQSGAEVKKPGASVKVSCKPSGYTVT<br>SHYTHWVRRAPGQGLEWMGMINPSGGVTAYSQTLQGRVTMTSDTSSSTVYM<br>ELSSLRSEDTAMYYCAREGSGSGWYFDFWGRGTLVTVSSGGGGSGGGGSGG<br>GGSSYVLTQPPSVSVSPGQTASITCSGDGLSKKYVSWYQQKAGQSPVVLIS<br>RDKERPSGIPDRFSGSNSADTATLTISGTQAMDEADYYCQAWDDTTVVEGG<br>GTKLTVLTTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGH<br>DGLYQGLSTATKDTYDALHMQALPPR |
| 149366-nt Full CAR | 905 | ATGGCCCTCCCTGTCACCGCCCTGCTGCTTCCGCTGGCTCTTCTGCTCCAC<br>GCCGCTCGGCCCCAAGTGCAGCTGGTGCAGAGCGGGGCCGAAGTCAAGAAG<br>CCGGGAGCCTCCGTGAAAGTGTCCTGCAAGCCTTCGGGATACACCGTGACC<br>TCCCACTACATTCATTGGGTCCGCCGCGCCCCCGGCCAAGGACTCGAGTGG<br>ATGGGCATGATCAACCCTAGCGGCGGAGTGACCGCGTACAGCCAGACGCTG<br>CAGGGACGCGTGACTATGACCTCGGATACCTCCTCCTCCACCGTCTATATG<br>GAACTGTCCAGCCTGCGGTCCGAGGATACCGCCATGTACTACTGCGCCCGG<br>GAAGGATCAGGCTCCGGGTGGTATTTCGACTTCTGGGGAAGAGGCACCCTC<br>GTGACTGTGTCATCTGGGGGAGGGGGTTCCGGTGGTGGCGGATCGGGAGGA<br>GGCGGTTCATCCTACGTGCTGACCCAGCCACCCTCCGTGTCCGTGAGCCCC<br>GGCCAGACTGCATCGATTACATGTAGCGGCGACGGCCTCTCCAAGAAATAC<br>GTGTCGTGGTACCAGCAGAAGGCCGGACAGAGCCCGGTGGTGCTGATCTCA<br>AGAGATAAGGAGCGGCCTAGCGGAATCCCGGACAGGTTCTCGGGTTCCAAC<br>TCCGCGGACACTGCTACTCTGACCATCTCGGGGACCCAGGCTATGGACGAA<br>GCCGATTACTACTGCCAAGCCTGGGACGACACTACTGTCGTGTTTGGAGGG<br>GGCACCAAGTTGACCGTCCTTACCACTACCCCAGCACCGAGGCCACCCACC<br>CCGGCTCCTACCATCGCCTCCCAGCCTCTGTCCCTGCGTCCGGAGGCATGT<br>AGACCCGCAGCTGGTGGGGCCGTGCATACCCGGGGTCTTGACTTCGCCTGC<br>GATATCTACATTTGGGCCCCTCTGGCTGGTACTTGCGGGGTCCTGCTGCTT<br>TCACTCGTGATCACTCTTTACTGTAAGCGCGGTCGGAAGAAGCTGCTGTAC<br>ATCTTTAAGCAACCCTTCATGAGGCCTGTGCAGACTACTCAAGAGGAGGAC<br>GGCTGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAGAAC<br>CAGCTCTACAACGAACTCAATCTTGGTCGGAGAGAGGAGTACGACGTGCTG<br>GACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAA<br>GCCTATAGCGAGATTGGTATGAAAGGGGAACGCAGAAGAGGCAAAGGCCAC<br>GACGGACTGTACCAGGGACTCAGCACCGCCACCAAGGACACCTATGACGCT<br>CTTCACATGCAGGCCCTGCCGCCTCGG |
| 149367 | | |
| 149367-aa Full CAR | 884 | MALPVTALLLPLALLLHAARPQVQLQESGPGLVKPSQTLSLTCTVSGGSIS<br>SGGYYWSWIRQHPGKGLEWIGYIYYSGSTYYNPSLKSRVTISVDTSKNQFS<br>LKLSSVTAADTAVYYCARAGIAARLRGAFDIWGQGTMVTVSSGGGGSGGGG<br>SGGGGSDIVMTQSPSSVSASVGDRVIITCRASQGIRNWLAWYQQKPGKAPN<br>LLIYAASNLQSGVPSRFSGSGSGADFTLTISSLQPEDVATYYCQKYNSAPF<br>TFGPGTKVDIKTTTPAPRPPTPAPTIASQPLSLRPEACRPAAGGAVHTRGL<br>DFACDIYIWAPLAGTCGVLLLSLVITLYCKRGRKKLLYIFKQPFMRPVQTT<br>QEEDGCSCRFPEEEEGGCELRVKFSRSADAPAYKQGQNQLYNELNLGRREE<br>YDVLDKRRGRDPEMGGKPRRKNPQEGLYNELQKDKMAEAYSEIGMKGERRR<br>GKGHDGLYQGLSTATKDTYDALHMQALPPR |
| 149367-nt Full CAR | 906 | ATGGCCCTCCCTGTCACCGCCCTGCTGCTTCCGCTGGCTCTTCTGCTCCAC<br>GCCGCTCGGCCCCAAGTGCAGCTTCAGGAGAGCGGCCCGGGACTCGTGAAG<br>CCGTCCCAGACCCTGTCCCTGACTTGCACCGTGTCGGGAGGAAGCATCTCG<br>AGCGGAGGCTACTATTGGTCGTGGATTCGGCAGCACCCTGGAAAGGGCCTG<br>GAATGGATCGGCTACATCTACTACTCCGGCTCGACCTACTACAACCCATCG<br>CTGAAGTCCAGAGTGACAATCTCAGTGGACACGTCCAAGAATCAGTTCAGC<br>CTGAAGCTCTCTTCCGTGACTGCGGCCGACACCGCCGTGTACTACTGCGCA<br>CGCGCTGGAATTGCCGCCCGGCTGAGGGGTGCCTTCGACATTTGGGGACAG<br>GGCACCATGGTCACCGTGTCCTCCGGCGGCGGAGGTTCCGGGGGTGGAGGC<br>TCAGGAGGAGGGGGTCCGACATCGTCATGACTCAGTCGCCCTCAAGCGTC<br>AGCGCGTCCGTCGGGACAGAGTGATCATCACCTGTCGGGCGTCCCAGGGA<br>ATTCGCAACTGGCTGGCCTGGTATCAGCAGAAGCCCGGAAAGGCCCCCAAC<br>CTGTTGATCTACGCCGCCTCAAACCTCCAATCCGGGGTGCCGAGCCGCTTC<br>AGCGGCTCCGGTTCGGGTGCCGATTTCACTCTGACCATCTCCTCCCTGCAA<br>CCTGAAGATGTGGCTACCTACTACTGCCAAAAGTACAACTCCGCACCTTTT<br>ACTTTCGGACCGGGGACCAAAGTGGACATTAAGACCACTACCCCAGCACCG<br>AGGCCACCCACCCCGGCTCCTACCATCGCCTCCCAGCCTCTGTCCCTGCGT<br>CCGGAGGCATGTAGACCCGCAGCTGGTGGGGCCGTGCATACCCGGGGTCTT |

TABLE 13-continued

Exemplary BCMA CAR molecules.
Sequences are provided with a leader sequence.

| Name/Description | SEQ ID NO: | Sequence |
|---|---|---|
| | | GACTTCGCCTGCGATATCTACATTTGGGCCCCTCTGGCTGGTACTTGCGGG GTCCTGCTGCTTTCACTCGTGATCACTCTTTACTGTAAGCGCGGTCGGAAG AAGCTGCTGTACATCTTTAAGCAACCCTTCATGAGGCCTGTGCAGACTACT CAAGAGGAGGACGGCTGTTCATGCCGGTTCCCAGAGGAGGAGGAAGGCGGC TGCGAACTGCGCGTGAAATTCAGCCGCAGCGCAGATGCTCCAGCCTACAAG CAGGGGCAGAACCAGCTCTACAACGAACTCAATCTTGGTCGGAGAGAGGAG TACGACGTGCTGGACAAGCGGAGAGGACGGGACCCAGAAATGGGCGGGAAG CCGCGCAGAAAGAATCCCCAAGAGGGCCTGTACAACGAGCTCCAAAAGGAT AAGATGGCAGAAGCCTATAGCGAGATTGGTATGAAAGGGGAACGCAGAAGA GGCAAAGGCCACGACGGACTGTACCAGGGACTCAGCACCGCCACCAAGGAC ACCTATGACGCTCTTCACATGCAGGCCCTGCCGCCTCGG |
| 149368 | | |
| 149368-aa Full CAR | 885 | MALPVTALLLPLALLLHAARPQVQLVQSGAEVKKPGSSVKVSCKASGGTFS SYAISWVRQAPGQGLEWMGGIIPIFGTANYAQKFQGRVTITADESTSTAYM ELSSLRSEDTAVYYCARRGGYQLLRWDVGLLRSAFDIWGQGTMVTVSSGGG GSGGGGSGGGGSSYVLTQPPSVSVAPGQTARITCGGNNIGSKSVHWYQQKP GQAPVLVLYGKNNRPSGVPDRFSGSRSGTTASLTITGAQAEDEADYYCSSR DSSGDHLRVFGTGTKVTVLTTTPAPRPPTPAPTIASQPLSLRPEACRPAAG GAVHTRGLDFACDIYIWAPLAGTCGVLLLSLVITLYCKRGRKKLLYIFKQP FMRPVQTTQEEDGCSCRFPEEEEGGCELRVKFSRSADAPAYKQGQNQLYNE LNLGRREEYDVLDKRRGRDPEMGGKPRRKNPQEGLYNELQKDKMAEAYSEI GMKGERRRGKGHDGLYQGLSTATKDTYDALHMQALPPR |
| 149368-nt Full CAR | 907 | ATGGCCCTCCCTGTCACCGCCCTGCTGCTTCCGCTGGCTCTTCTGCTCCAC GCCGCTCGGCCCCAAGTGCAGCTGGTCCAGTCGGGCGCCGAGGTCAAGAAG CCCGGGAGCTCTGTGAAAGTGTCCTGCAAGGCCTCCGGGGGCACCTTTAGC TCCTACGCCATCTCCTGGGTCCGCCAAGCACCGGGTCAAGGCCTGGAGTGG ATGGGGGGAATTATCCCTATCTTCGGCACTGCCAACTACGCCCAGAAGTTC CAGGGACGCGTGACCATTACCGCGGACGAATCCACCTCCACCGCTTATATG GAGCTGTCCAGCTTGCGCTCGGAAGATACCGCCGTGTACTACTGCGCCCGG AGGGGTGGATACCAGCTGCTGAGATGGGACGTGGGCCTCCTGCGGTCGGCG TTCGACATCTGGGGCCAGGGCACTATGGTCACTGTGTCCAGCGGAGGAGGC GGATCGGGAGGCGGCGGATCAGGGGGAGGCGGTTCCAGCTACGTGCTTACT CAACCCCCTTCGGTGTCCGTGGCCCCGGGACAGACCGCCAGAATCACTTGC GGAGGAAACAACATTGGGTCCAAGAGCGTGCATTGGTACCAGCAGAAGCCA GGACAGGCCCCTGTGCTGGTGCTCTACGGGAAGAACAATCGGCCCAGCGGA GTGCCGGACAGGTTCTCGGGTTCACGCTCCGGTACAACCGCTTCACTGACT ATCACCGGGGCCCAGGCAGAGGATGAAGCGGACTACTACTGTTCCTCCCGG GATTCATCCGGCGACCACCTCCGGGTGTTCGGAACCGGAACGAAGGTCACC GTGCTGACCACTACCCCAGCACCGAGGCCACCCACCCCGGCTCCTACCATC GCCTCCCAGCCTCTGTCCCTGCGTCCGGAGGCATGTAGACCCGCAGCTGGT GGGGCCGTGCATACCCGGGGTCTTGACTTCGCCTGCGATATCTACATTTGG GCCCCTCTGGCTGGTACTTGCGGGGTCCTGCTGCTTTCACTCGTGATCACT CTTTACTGTAAGCGCGGTCGGAAGAAGCTGCTGTACATCTTTAAGCAACCC TTCATGAGGCCTGTGCAGACTACTCAAGAGGAGGACGGCTGTTCATGCCGG TTCCCAGAGGAGGAGGAAGGCGGCTGCGAACTGCGCGTGAAATTCAGCCGC AGCGCAGATGCTCCAGCCTACAAGCAGGGGCAGAACCAGCTCTACAACGAA CTCAATCTTGGTCGGAGAGAGGAGTACGACGTGCTGGACAAGCGGAGAGGA CGGGACCCAGAAATGGGCGGGAAGCCGCGCAGAAAGAATCCCCAAGAGGGC CTGTACAACGAGCTCCAAAAGGATAAGATGGCAGAAGCCTATAGCGAGATT GGTATGAAAGGGGAACGCAGAAGAGGCAAAGGCCACGACGGACTGTACCAG GGACTCAGCACCGCCACCAAGGACACCTATGACGCTCTTCACATGCAGGCC CTGCCGCCTCGG |
| 149369 | | |
| 149369-aa Full CAR | 886 | MALPVTALLLPLALLLHAARPEVQLQQSGPGLVKPSQTLSLTCAISGDSVS SNSAAWNWIRQSPSRGLEWLGRTYYRSKWYSFYAISLKSRIIINPDTSKNQ FSLQLKSVTPEDTAVYYCARSSPEGLFLYWFDPWGQGTLVTVSSGGDSGG GGSGGGGSSSELTQDPAVSVALGQTIRITCQGDSLGNYYATWYQQKPGQAP VLVIYGTNNRPSGIPDRFSASSSGNTASLTITGAQAEDEADYYCNSRDSSG HHLLFGTGTKVTVLTTTPAPRPPTPAPTIASQPLSLRPEACRPAAGGAVHT RGLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNLGR REEYDVLDKRRGRDPEMGGKPRRKNPQEGLYNELQKDKMAEAYSEIGMKGE RRRGKGHDGLYQGLSTATKDTYDALHMQALPPR |
| 149369-nt Full CAR | 908 | ATGGCCCTCCCTGTCACCGCCCTGCTGCTTCCGCTGGCTCTTCTGCTCCAC GCCGCTCGGCCCGAAGTGCAGCTCCAACAGTCAGGACCGGGGCTCGTGAAG CCATCCCAGACCCTGTCCCTGACTTGTGCCATCTCGGGAGATAGCGTGTCA TCGAACTCCGCCGCCTGGAACTGGATTCGGCAGAGCCCGTCCCGCGGACTG GAGTGGCTTGGAAGGACCTACTACCGGTCCAAGTGGTACTCTTTCTACGCG ATCTCGCTGAAGTCCCGCATTATCATTAACCCTGATACCTCCAAGAATCAG |

TABLE 13-continued

Exemplary BCMA CAR molecules.
Sequences are provided with a leader sequence.

| Name/ Description | SEQ ID NO: | Sequence |
|---|---|---|
| | | TTCTCCCTCCAACTGAAATCCGTCACCCCCGAGGACACAGCAGTGTATTAC TGCGCACGGAGCAGCCCCGAAGGACTGTTCCTGTATTGGTTTGACCCCTGG GGCCAGGGGACTCTTGTGACCGTGTCGAGCGGCGGAGATGGGTCCGGTGGC GGTGGTTCGGGGGGCGGCGGATCATCATCCGAACTGACCCAGGACCCGGCT GTGTCCGTGGCGCTGGGACAAACCATCCGCATTACGTGCCAGGGAGACTCC CTGGGCAACTACTACGCCACTTGGTACCAGCAGAAGCCGGGCCAAGCCCCT GTGTTGGTCATCTACGGGACCAACAACAGACCTTCCGGCATCCCCGACCGG TTCAGCGCTTCGTCCTCCGGCAACACTGCCAGCCTGACCATCACTGGAGCG CAGGCCGAAGATGAGGCCGACTACTACTGCAACAGCAGAGACTCCTCGGGT CATCACCTCTTGTTCGGAACTGGAACCAAGGTCACCGTGCTGACCACTACC CCAGCACCGAGGCCACCCACCCCGGCTCCTACCATCGCCTCCCAGCCTCTG TCCCTGCGTCCGGAGGCATGTAGACCCGCAGCTGGTGGGGCCGTGCATACC CGGGGTCTTGACTTCGCCTGCGATATCTACATTTGGGCCCCTCTGGCTGGT ACTTGCGGGGTCCTGCTGCTTTCACTCGTGATCACTCTTTACTGTAAGCGC GGTCGGAAGAAGCTGCTGTACATCTTTAAGCAACCCTTCATGAGGCCTGTG CAGACTACTCAAGAGGAGGACGGCTGTTCATGCCGGTTCCCAGAGGAGGAG GAAGGCGGCTGCGAACTGCGCGTGAAATTCAGCCGCAGCGCAGATGCTCCA GCCTACAAGCAGGGGCAGAACCAGCTCTACAACGAACTCAATCTTGGTCGG AGAGAGGAGTACGACGTGCTGGACAAGCGGAGAGGACGGGACCCAGAAATG GGCGGGAAGCCGCGCAGAAAGAATCCCCAAGAGGGCCTGTACAACGAGCTC CAAAAGGATAAGATGGCAGAAGCCTATAGCGAGATTGGTATGAAAGGGGAA CGCAGAAGAGGCAAAGGCCACGACGGACTGTACCAGGGACTCAGCACCGCC ACCAAGGACACCTATGACGCTCTTCACATGCAGGCCCTGCCGCCTCGG |
| BCMA_EBB-C1978-A4 | | |
| BCMA_EBB-C1978-A4-aa Full CAR | 887 | MALPVTALLLPLALLLHAARPEVQLVESGGGLVQPGGSLRLSCAASGFTFS SYAMSWVRQAPGKGLEWVSAISGSGGSTYYADSVKGRFTISRDNSKNTLYL QMNSLRAEDTAVYYCAKVEGSGSLDYWGQGTLVTVSSGGGGSGGGGSGGGG SEIVMTQSPGTLSLSPGERATLSCRASQSVSSAYLAWYQQKPGQPPRLLIS GASTRATGIPDRFGGSGSGTDFTLTISRLEPEDFAVYYCQHYGSSFNGSSL FTFGQGTRLEIKTTTPAPRPPTPAPTIASQPLSLRPEACRPAAGGAVHTRG LDFACDTYIWAPLAGTCGVLLLSLVITLYCKRGRKKLLYIFKQPFMRPVQT TQEEDGCSCRFPEEEEGGCELRVKFSRSADAPAYKQGQNQLYNELNLGRRE EYDVLDKRRGRDPEMGGKPRRKNPQEGLYNELQKDKMAEAYSEIGMKGERR RGKGHDGLYQGLSTATKDTYDALHMQALPPR |
| BCMA_EBB-C1978-A4-nt Full CAR | 909 | ATGGCCCTCCCTGTCACCGCCCTGCTGCTTCCGCTGGCTCTTCTGCTCCAC GCCGCTCGGCCCGAAGTGCAGCTCGTGGAGTCAGGAGGCGGCCTGGTCCAG CCGGGAGGGTCCCTTAGACTGTCATGCGCCGCAAGCGGATTCACTTTCTCC TCCTATGCCATGAGCTGGGTCCGCCAAGCCCCCGGAAAGGGACTGGAATGG GTGTCCGCCATCTCGGGGTCTGGAGGCTCAACTTACTACGCTGACTCCGTG AAGGGACGGTTCACCATTAGCCGCGACAACTCCAAGAACACCCTCTACCTC CAAATGAACTCCCTGCGGGCCGAGGATACCGCCGTCTACTACTGCGCCAAA GTGGAAGGTTCAGGATCGCTGGACTACTGGGGACAGGGTACTCTCGTGACC GTGTCATCGGGCGGAGGAGGTTCCGGCGGTGGCGGCTCCGGCGGCGGAGGG TCGGAGATCGTGATGACCCAGAGCCCTGGTACTCTGAGCCTTTCGCCGGGA GAAAGGGCCACCCTGTCCTGCCGCGCTTCCCAATCCGTGTCCTCCGCGTAC TTGGCGTGGTACCAGCAGAAGCCGGGACAGCCCCCTCGGCTGCTGATCAGC GGGGCCAGCACCCGGGCAACCGGAATCCCAGACAGATTCGGGGGTTCCGGC AGCGGCACAGATTTCACCCTGACTATTTCGAGGTTGGAGCCCGAGGACTTT GCGGTGTATTACTGTCAGCACTACGGGTCGTCCTTTAATGGCTCCAGCCTG TTCACGTTCGGACAGGGGACCCGCCTGGAAATCAAGACCACTACCCCAGCA CCGAGGCCACCCACCCCGGCTCCTACCATCGCCTCCCAGCCTCTGTCCCTG CGTCCGGAGGCATGTAGACCCGCAGCTGGTGGGGCCGTGCATACCCGGGGT CTTGACTTCGCCTGCGATATCTACATTTGGGCCCCTCTGGCTGGTACTTGC GGGGTCCTGCTGCTTTCACTCGTGATCACTCTTTACTGTAAGCGCGGTCGG AAGAAGCTGCTGTACATCTTTAAGCAACCCTTCATGAGGCCTGTGCAGACT ACTCAAGAGGAGGACGGCTGTTCATGCCGGTTCCCAGAGGAGGAGGAAGGC GGCTGCGAACTGCGCGTGAAATTCAGCCGCAGCGCAGATGCTCCAGCCTAC AAGCAGGGGCAGAACCAGCTCTACAACGAACTCAATCTTGGTCGGAGAGAG GAGTACGACGTGCTGGACAAGCGGAGAGGACGGGACCCAGAAATGGGCGGG AAGCCGCGCAGAAAGAATCCCCAAGAGGGCCTGTACAACGAGCTCCAAAAG GATAAGATGGCAGAAGCCTATAGCGAGATTGGTATGAAAGGGGAACGCAGA AGAGGCAAAGGCCACGACGGACTGTACCAGGGACTCAGCACCGCCACCAAG GACACCTATGACGCTCTTCACATGCAGGCCCTGCCGCCTCGG |
| BCMA_EBB-C1978-G1 | | |
| BCMA_EBB-C1978-G1-aa Full CAR | 888 | MALPVTALLLPLALLLHAARPEVQLVETGGGLVQPGGSLRLSCAASGITFS RYPMSWVRQAPGKGLEWVSGISDSGVSTYYADSAKGRFTISRDNSKNTLFL QMSSLRDEDTAVYYCVTRAGSEASDIWGQGTMVTVSSGGGGSGGGGSGGGG SEIVLTQSPATLSLSPGERATLSCRASQSVSNSLAWYQQKPGQAPRLLIYD ASSRATGIPDRFSGSGSGTDFTLTISRLEPEDFAIYYCQQFGTSSGLTEGG |

TABLE 13-continued

Exemplary BCMA CAR molecules.
Sequences are provided with a leader sequence.

| Name/ Description | SEQ ID NO: | Sequence |
|---|---|---|
| | | GTKLEIKITTTPAPRPPTPAPTIASQPLSLRPEACRPAAGGAVHTRGLDFAC DIYIWAPLAGTCGVLLLSLVITLYCKRGRKKLLYIFKQPFMRPVQTTQEED GCSCRFPEEEEGGCELRVKFSRSADAPAYKQGQNQLYNELNLGRREEYDVL DKRRGRDPEMGGKPRRKNPQEGLYNELQKDKMAEAYSEIGMKGERRRGKGH DGLYQGLSTATKDTYDALHMQALPPR |
| BCMA_EBB- C1978-G1- nt Full CAR | 910 | ATGGCCCTCCCTGTCACCGCCCTGCTGCTTCCGCTGGCTCTTCTGCTCCAC GCCGCTCGGCCCAAGTGCAACTGGTGGAAACCGGTGGCGGCCTGGTGCAG CCTGGAGGATCATTGAGGCTGTCATGCGCGGCCAGCGGTATTACCTTCTCC CGGTACCCCATGTCCTGGGTCAGACAGGCCCCGGGGAAAGGGCTTGAATGG GTGTCCGGGATCTCGGACTCCGGTGTCAGCACTTACTACGCCGACTCCGCC AAGGGACGCTTCACCATTTCCCGGGACAACTCGAAGAACACCCTGTTCCTC CAAATGAGCTCCCTCCGGGACGAGGATACTGCAGTGTACTACTGCGTGACC CGCGCCGGGTCCGAGGCGTCTGACATTTGGGGACAGGGCACTATGGTCACC GTGTCGTCCGGCGGAGGGGGCTCGGGAGGCGGTGGCAGCGGAGGAGGAGGG TCCGAGATCGTGCTGACCCAATCCCCGGCCACCCTCTCGCTGAGCCCTGGA GAAAGGGCAACCTTGTCCTGTCGCGCGAGCCAGTCCGTGAGCAACTCCCTG GCCTGGTACCAGCAGAAGCCCGGACAGGCTCCGAGACTTCTGATCTACGAC GCTTCGAGCCGGGCCACTGGAATCCCCGACCGCTTTTCGGGGTCCGGCTCA GGAACCGATTTCACCCTGACAATCTCACGGCTGGAGCCAGAGGATTTCGCC ATCTATTACTGCCAGCAGTTCGGTACTTCCTCCGGCCTGACTTTCGGAGGC GGCACGAAGCTCGAAATCAAGACCACTACCCCAGCACCGAGGCCACCCACC CCGGCTCCTACCATCGCCTCCCAGCCTCTGTCCCTGCGTCCGGAGGCATGT AGACCCGCAGCTGGTGGGGCCGTGCATACCCGGGGTCTTGACTTCGCCTGC GATATCTACATTTGGGCCCCTCTGGCTGGTACTTGCGGGGTCCTGCTGCTT TCACTCGTGATCACTCTTTACTGTAAGCGCGGTCGGAAGAAGCTGCTGTAC ATCTTTAAGCAACCCTTCATGAGGCCTGTGCAGACTACTCAAGAGGAGGAC GGCTGTTCATGCCGGTTCCCAGAGGAGGAGGAAGGCGGCTGCGAACTGCGC GTGAAATTCAGCCGCAGCGCAGATGCTCCAGCCTACAAGCAGGGGCAGAAC CAGCTCTACAACGAACTCAATCTTGGTCGGAGAGAGGAGTACGACGTGCTG GACAAGCGGAGAGGACGGGACCCAGAAATGGGCGGGAAGCCGCGCAGAAAG AATCCCCAAGAGGGCCTGTACAACGAGCTCCAAAAGGATAAGATGGCAGAA GCCTATAGCGAGATTGGTATGAAAGGGGAACGCAGAAGAGGCAAAGGCCAC GACGGACTGTACCAGGGACTCAGCACCGCCACCAAGGACACCTATGACGCT CTTCACATGCAGGCCCTGCCGCCTCGG |

BCMA_EBB-C1979-C1

| BCMA_EBB- C1979-C1- aa Full CAR | 889 | MALPVTALLLPLALLLHAARPQVQLVESGGGLVQPGGSLRLSCAASGFTFS SYAMSWVRQAPGKGLEWVSAISGSGGSTYYADSVKGRFTISRDNAKNSLYL QMNSLRAEDTAIYYCARATYKRELRYYYGMDVWGQGTMVTVSSGGGGSGGG GSGGGGSEIVMTQSPGTVSLSPGERATLSCRASQSVSSSFLAWYQQKPGQA PRLLIYGASSRATGIPDRFSGSGSGTDFTLTISRLEPEDSAVYYCQQYHSS PSWTFGQGTRLEIKTTTPAPRPPTPAPTIASQPLSLRPEACRPAAGGAVHT RGLDFACDTYIWAPLAGTCGVLLLSLVITLYCKRGRKKLLYIFKQPFMRPV QTTQEEDGCSCRFPEEEEGGCELRVKFSRSADAPAYKQGQNQLYNELNLGR REEYDVLDKRRGRDPEMGGKPRRKNPQEGLYNELQKDKMAEAYSEIGMKGE RRRGKGHDGLYQGLSTATKDTYDALHMQALPPR |
| BCMA_EBB- C1979-C1- nt Full CAR | 911 | ATGGCCCTCCCTGTCACCGCCCTGCTGCTTCCGCTGGCTCTTCTGCTCCAC GCCGCTCGGCCCAAGTGCAGCTCGTGGAATCGGGTGGCGGACTGGTGCAG CCGGGGGGCTCACTTAGACTGTCCTGCGCGGCCAGCGGATTCACTTTCTCC TCCTACGCCATGTCCTGGGTCAGACAGGCCCCTGGAAAGGGCCTGGAATGG GTGTCCGCAATCAGCGGCAGCGGCGGCTCGACCTATTACGCGGATTCAGTG AAGGGCAGATTCACCATTTCCCGGGACAACGCCAAGAACTCCTTGTACCTT CAAATGAACTCCCTCCGCGCGGAAGATACCGCAATCTACTACTGCGCTCGG GCCACTTACAAGAGGGAACTGCGCTACTACTACGGGATGGACGTCTGGGGC CAGGGAACCATGGTCACCGTGTCCAGCGGAGGAGGAGGATCGGGAGGAGGC GGTAGCGGGGGTGGAGGGTCGGAGATCGTGATGACCCAGTCCCCCGGCACT GTGTCGCTGTCCCCGGCGAACGGGCACCCTGTCATGTCGGGCCAGCCAG TCAGTGTCGTCAAGCTTCCTGCCTGGTACCAGCAGAAACCGGGACAAGCT CCCCGCCTGCTGATCTACGGAGCCAGCAGCCGGGCCACCGGTATTCCTGAC CGGTTCTCCGGTTCGGGGTCCGGGACCGACTTTACTCTGACTATCTCTCGC CTCGAGCCAGAGGACTCCGCCGTGTATTACTGCCAGCAGTACCACTCCTCC CCGTCCTGGACGTTCGGACAGGGCACAAGGCTGGAGATTAAGACCACTACC CCAGCACCGAGGCCACCCACCCCCGGCTCCTACCATCGCCTCCCAGCCTCTG TCCCTGCGTCCGGAGGCATGTAGACCCGCAGCTGGTGGGGCCGTGCATACC CGGGGTCTTGACTTCGCCTGCGATATCTACATTTGGGCCCCTCTGGCTGGT ACTTGCGGGGTCCTGCTGCTTTCACTCGTGATCACTCTTTACTGTAAGCGC GGTCGGAAGAAGCTGCTGTACATCTTTAAGCAACCCTTCATGAGGCCTGTG CAGACTACTCAAGAGGAGGACGGCTGTTCATGCCGGTTCCCAGAGGAGGAG GAAGGCGGCTGCGAACTGCGCGTGAAATTCAGCCGCAGCGCAGATGCTCCA GCCTACAAGCAGGGGCAGAACCAGCTCTACAACGAACTCAATCTTGGTCGG AGAGAGGAGTACGACGTGCTGGACAAGCGGAGAGGACGGGACCCAGAAATG GGCGGGAAGCCGCGCAGAAAGAATCCCCAAGAGGGCCTGTACAACGAGCTC |

TABLE 13-continued

Exemplary BCMA CAR molecules.
Sequences are provided with a leader sequence.

| Name/ Description | SEQ ID NO: | Sequence |
|---|---|---|
| | | CAAAAGGATAAGATGGCAGAAGCCTATAGCGAGATTGGTATGAAAGGGGAA CGCAGAAGAGGCAAAGGCCACGACGGACTGTACCAGGGACTCAGCACCGCC ACCAAGGACACCTATGACGCTCTTCACATGCAGGCCCTGCCGCCTCGG |

BCMA_EBB-C1978-C7

| BCMA_EBB-C1978-C7-aa Full CAR | 890 | MALPVTALLLPLALLLHAARPEVQLVETGGGLVQPGGSLRLSCAASGFTFS SYAMSWVRQAPGKGLEWVSAISGSGGSTYYADSVKGRFTISRDNSKNTLYL QMNTLKAEDTAVYYCARATYKRELRYYYGMDVWGQGTTVTVSSGGGGSGGG GSGGGGSEIVLTQSPSTLSLSPGESAILSCRASQSVSTTFLAWYQQKPGQA PRLLIYGSSNRATGIPDRFSGSGSGTDFTLTIRRLEPEDFAVYYCQQYHSS PSWTFGQGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNLGR REEYDVLDKRRGRDPEMGGKPRRKNPQEGLYNELQKDKMAEAYSEIGMKGE RRRGKGHDGLYQGLSTATKDTYDALHMQALPPR |
| BCMA_EBB-C1978-C7-nt Full CAR | 912 | ATGGCCCTCCCTGTCACCGCCCTGCTGCTTCCGCTGGCTCTTCTGCTCCAC GCCGCTCGGCCCGAGGTGCAGCTTGTGGAAACCGGTGGCGGACTTGTGCAG CCCGGAGGAAGCCTCAGGCTGTCCTGCGCCGCGTCCGGCTTCACCTTCTCC TCGTACGCCATGTCCTGGGTCCGCCAGGCCCCCGGAAAGGGCCTGGAATGG GTGTCCGCCATCTCTGGAAGCGGAGGTTCCACGTACTACGCGGACAGCGTC AAGGGGAAGGTTCACAATCTCCCGCGATAATTCGAAGAACACTCTGTACCTT CAAATGAACACCCTGAAGGCCGAGGACACTGCTGTGTACTACTGCGCACGG GCCACCTACAAGAGAGAGCTCCGGTACTACTACGGAATGGACGTCGGGGGC CAGGGAACTACTGTGACCGTGTCCTCGGGAGGGGGTGGCTCCGGGGGGGGC GGCTCCGGCGGAGGCGGTTCCGAGATTGTGCTGACCCAGTCACCTTCAACT CTGTCGCTGTCCCCGGGAGAGAGCGCTACTCTGAGCTGCCGGGCCAGCCAG TCCGTGTCCACCACCTTCCTCGCCTGGTATCAGCAGAAGCCGGGGCAGGCA CCACGGCTCTTGATCTACGGGTCAAGCAACAGAGCGACCGGAATTCCTGAC CGCTTCTCGGGGAGCGGTTCAGGCACCGACTTCACCCTGACTATCCGGCGC CTGGAACCCGAAGATTTCGCCGTGTATTACTGTCAACAGTACCACTCCTCG CCGTCCTGGACCTTTGGCCAAGGAACCAAAGTGGAAATCAAGACCACTACC CCAGCACCGAGGCCACCCACCCCGGCTCCTACCATCGCCTCCCAGCCTCTG TCCCTGCGTCCGGAGGCATGTAGACCCGCAGCTGGTGGGCCGTGCATACC CGGGGTCTTGACTTCGCCTGCGATATCTACATTTGGGCCCCTCTGGCTGGT ACTTGCGGGGTCCTGCTGCTTTCACTCGTGATCACTCTTTACTGTAAGCGC GGTCGGAAGAAGCTGCTGTACATCTTTAAGCAACCCTTCATGAGGCCTGTG CAGACTACTCAAGAGGAGGACGGCTGTTCATGCCGGTTCCCAGAGGAGGAG GAAGGCGGCTGCGAACTGCGCGTGAAATTCAGCCGCAGCGCAGATGCTCCA GCCTACAAGCAGGGGCAGAACCAGCTCTACAACGAACTCAATCTTGGTCGG AGAGAGGAGTACGACGTGCTGGACAAGCGGAGAGGACGGGACCCAGAAATG GGCGGGAAGCCGCGCAGAAAGAATCCCCAAGAGGGCCTGTACAACGAGCTC CAAAAGGATAAGATGGCAGAAGCCTATAGCGAGATTGGTATGAAAGGGGAA CGCAGAAGAGGCAAAGGCCACGACGGACTGTACCAGGGACTCAGCACCGCC ACCAAGGACACCTATGACGCTCTTCACATGCAGGCCCTGCCGCCTCGG |

BCMA_EBB-C1978-D10

| BCMA_EBB-C1978-D10-aa Full CAR | 891 | MALPVTALLLPLALLLHAARPEVQLVETGGGLVQPGRSLRLSCAASGFTFD DYAMHWVRQAPGKGLEWVSGISWNSGSIGYADSVKGRFTISRDNAKNSLYL QMNSLRDEDTAVYYCARVGKAVPDVWGQGTTVTVSSGGGGSGGGGSGGGGS DIVMTQTPSSLSASVGDRVTITCRASQSISSYLNWYQQKPGKAPKLLIYAA SSLQSGVPSRFSGSGSGTDFTLTISSLQPEDFATYYCQQSYSTPYSFGQGT RLEIKITTTPAPRPPTPAPTIASQPLSLRPEACRPAAGGAVHTRGLDFACDI YIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDG LYQGLSTATKDTYDALHMQALPPR |
| BCMA_EBB-C1978-D10-nt Full CAR | 913 | ATGGCCCTCCCTGTCACCGCCCTGCTGCTTCCGCTGGCTCTTCTGCTCCAC GCCGCTCGGCCCGAGGTGCAGCTGGTCGTGGAAACTGGAGGTGGACTCGTG CAGCCTGGACGGTCGCTGCGGCTGAGCTGCGCTGCATCCGGCTTCACCTTCGAC GATTATGCCATGCACTGGGTCAGACAGGCGCCAGGGAAGGGACTTGAGTGG GTGTCCGGTATCAGCTGGAATAGCGGCTCAATCGGATACGCGGACTCCGTG AAGGGAAGGTTCACCATTTCCCGCGACAACGCCAAGAACTCCCTGTACTTG CAAATGAACAGCCTCCGGGATGAGGACACTGCCGTGTACTACTGCGCCCGC GTCGGAAAAGCTGTGCCCGACGTCTGGGGCCAGGGAACCACTGTGACCGTG TCCAGCGGCGGGGGTGGATCGGGCGGTGGAGGGTCCGGTGGAGGGGCTCA GATATTGTGATGACCCAGACCCCCTCGTCCCTGTCCGCCTCGGTCGGCGAC CGCGTGACTATCACATGTAGAGCCTCGCAGAGCATCTCCAGCTACCTGAAC TGGTATCAGCAGAAGCCGGGGAAGGCCCCGAAGCTCCTGATCTACGCGGCA TCATCACTGCAATCGGAGTGCCGAGCCGGTTTTCCGGGTCCGGCTCCGGC ACCGACTTCACGCTGACCATTTCTTCCCTGCAACCCGAGGACTTCGCCACT TACTACTGCCAGCAGTCCTACTCCACCCCTTACTCCTTCGGCCAAGGAACC |

TABLE 13-continued

Exemplary BCMA CAR molecules.
Sequences are provided with a leader sequence.

| Name/Description | SEQ ID NO: | Sequence |
|---|---|---|
| | | AGGCTGGAAATCAAGACCACTACCCCAGCACCGAGGCCACCCACCCCGGCT<br>CCTACCATCGCCTCCCAGCCTCTGTCCCTGCGTCCGGAGGCATGTAGACCC<br>GCAGCTGGTGGGGCCGTGCATACCCGGGGTCTTGACTTCGCCTGCGATATC<br>TACATTTGGGCCCCTCTGGCTGGTACTTGCGGGGTCCTGCTGCTTTCACTC<br>GTGATCACTCTTTACTGTAAGCGCGGTCGGAAGAAGCTGCTGTACATCTTT<br>AAGCAACCCTTCATGAGGCCTGTGCAGACTACTCAAGAGGAGGACGGCTGT<br>TCATGCCGGTTCCCAGAGGAGGAGGAAGGCGGCTGCGAACTGCGCGTGAAA<br>TTCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAAG<br>CGGAGAGGACGGGACCCAGAAATGGGCGGGAAGCCGCGCAGAAAGAATCCC<br>CAAGAGGGCCTGTACAACGAGCTCCAAAAGGATAAGATGGCAGAAGCCTAT<br>AGCGAGATTGGTATGAAAGGGGAACGCAGAAGAGGCAAAGGCCACGACGGA<br>CTGTACCAGGGACTCAGCACCGCCACCAAGGACACCTATGACGCTCTTCAC<br>ATGCAGGCCCTGCCGCCTCGG |
| BCMA_EBB-C1979-C12 | | |
| BCMA_EBB-<br>C1979-C12-<br>aa<br>Full CAR | 892 | MALPVTALLLPLALLLHAARPEVQLVESGGGLVQPGRSLRLSCTASGFTFD<br>DYAMHWVRQRPGKGLEWVASINWKGNSLAYGDSVKGRFAISRDNAKNTVEL<br>QMNSLRTEDTAVYYCASHQGVAYYNYAMDVWGRGTLVTVSSGGGGSGGGGS<br>GGGGSEIVLTQSPGTLSLSPGERATLSCRATQSIGSSFLAWYQQRPGQAPR<br>LLIYGASQRATGIPDRFSGRGSGTDFTLTISRVEPEDSAVYYCQHYESSPS<br>WTFGQGTKVEIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| BCMA_EBB-<br>C1979-C12-<br>nt<br>Full CAR | 914 | ATGGCCCTCCCTGTCACCGCCCTGCTGCTTCCGCTGGCTCTTCTGCTCCAC<br>GCCGCTCGGCCCGAAGTGCAGCTCGTGGAGAGCGGGGGAGGATTGGTGCAG<br>CCCCGGAAGGTCCCTGCGGCTCTCCTGCACTGCGTCTGGCTTCACCTTCGAC<br>GACTACGCGATGCACTGGGTCAGACAGCGCCCGGGAAAGGGCCTGGAATGG<br>GTCGCCTCAATCAACTGGAAGGGAAACTCCCTGGCCTATGGCGACAGCGTG<br>AAGGGCCGCTTCGCCATTTCGCGCGACAACGCCAAGAACACCGTGTTTCTG<br>CAAATGAATTCCCTGCGGACCGAGGATACCGCTGTGTACTACTGCGCCAGC<br>CACCAGGGCGTGGCATACTATAACTACGCCATGGACGTGTGGGGAAGAGGG<br>ACGCTCGTCACCGTGTCCTCCGGGGGCGGTGGATCGGGTGGAGGAGGAAGC<br>GGTGGCGGGGGCAGCGAAATCGTGCTGACTCAGAGCCCGGGAACTCTTTCA<br>CTGTCCCCGGGAGAACGGGCCACTCTCTCGTGCCGGGCCCACCCAGTCCATC<br>GGCTCCTCCTTCCTTGCCTGGTACCAGCAGAGGCCAGGACAGGCGCCCCGC<br>CTGCTGATCTACGGTGCTTCCCAACGCGCCACTGGCATTCCTGACCGGTTC<br>AGCGGCAGAGGGTCGGGAACCGATTTCACACTGACCATTTCCCGGGTGGAG<br>CCCGAAGATTCGGCAGTCTACTACTGTCAGCATTACGAGTCCTCCCCTTCA<br>TGGACCTTCGGTCAAGGGACCAAAGTGGAGATCAAGACCACTACCCCAGCA<br>CCGAGGCCACCCACCCCGGCTCCTACCATCGCCTCCCAGCCTCTGTCCCTG<br>CGTCCGGAGGCATGTAGACCCGCAGCTGGTGGGGCCGTGCATACCCGGGGT<br>CTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| BCMA_EBB-C1980-G4 | | |
| BCMA_EBB-<br>C1980-G4-<br>aa<br>Full CAR | 893 | MALPVTALLLPLALLLHAARPEVQLVESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKVVRDGMDVWGQTTVTVSSGGGGSGGGGSGGGGS<br>EIVLTQSPATLSLSPGERATLSCRASQSVSSSYLAWYQQKPGQAPRLLIYG<br>ASSRATGIPDRFSGNGSGTDFTLTISRLEPEDFAVYYCQQYGSPPRFTFGP<br>GTKVDIKITTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGH<br>DGLYQGLSTATKDTYDALHMQALPPR |

TABLE 13-continued

Exemplary BCMA CAR molecules.
Sequences are provided with a leader sequence.

| Name/<br>Description | SEQ<br>ID<br>NO: | Sequence |
|---|---|---|
| BCMA_EBB-<br>C1980-G4-<br>nt<br>Full CAR | 915 | ATGGCCCTCCCTGTCACCGCCCTGCTGCTTCCGCTGGCTCTTCTGCTCCAC<br>GCCGCTCGGCCCGAGGTGCAGTTGGTCGAAAGCGGGGGCGGGCTTGTGCAG<br>CCTGGCGGATCACTGCGGCTGTCCTGCGCGGCATCAGGCTTCACGTTTTCT<br>TCCTACGCCATGTCCTGGGTGCGCCAGGCCCCTGGAAAGGGACTGGAATGG<br>GTGTCCGCGATTTCGGGGTCCGGCGGGAGCACCTACTACGCCGATTCCGTG<br>AAGGGCCGCTTCACTATCTCGCGGGACAACTCCAAGAACACCCTCTACCTC<br>CAAATGAATAGCCTGCGGGCCGAGGATACCGCCGTCTACTATTGCGCTAAG<br>GTCGTGCGCGACGGAATGGACGTGTGGGACAGGGTACCACCGTGACAGTG<br>TCCTCGGGGGGAGGCGGTAGCGGCGGAGGAGGAAGCGGTGGTGGAGGTTCC<br>GAGATTGTGCTGACTCAATCACCCGCGACCCTGAGCCTGTCCCCCGGCGAA<br>AGGGCCACTCTGTCCTGTCGGGCCAGCCAATCAGTCTCCTCCTCGTACCTG<br>GCCTGGTACCAGCAGAAGCCAGGACAGGCTCCGAGACTCCTTATCTATGGC<br>GCATCCTCCCGCGCCACCGGAATCCCGGATAGGTTCTCGGGAAACGGATCG<br>GGGACCGACTTCACTCTCACCATCTCCCGGCTGGAACCGGAGGACTTCGCC<br>GTGTACTACTGCCAGCAGTACGGCAGCCCGCCTAGATTCACTTTCGGCCCC<br>GGCACCAAAGTGGACATCAAGACCACTACCCCAGCACCGAGGCCACCCACC<br>CCGGCTCCTACCATCGCCTCCCAGCCTCTGTCCCTGCGTCCGGAGGCATGT<br>AGACCCGCAGCTGGTGGGGCCGTGCATACCCGGGGTCTTGACTTCGCCTGC<br>GATATCTACATTTGGGCCCCTCTGGCTGGTACTTGCGGGGTCCTGCTGCTT<br>TCACTCGTGATCACTCTTTACTGTAAGCGCGGTCGGAAGAAGCTGCTGTAC<br>ATCTTTAAGCAACCCTTCATGAGGCCTGTGCAGACTACTCAAGAGGAGGAC<br>GGCTGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAGAAC<br>CAGCTCTACAACGAACTCAATCTTGGTCGGAGAGAGGAGTACGACGTGCTG<br>GACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAA<br>GCCTATAGCGAGATTGGTATGAAAGGGGAACGCAGAAGAGGCAAAGGCCAC<br>GACGGACTGTACCAGGGACTCAGCACCGCCACCAAGGACACCTATGACGCT<br>CTTCACATGCAGGCCCTGCCGCCTCGG |

BCMA_EBB-C1980-D2

| Name/<br>Description | SEQ<br>ID<br>NO: | Sequence |
|---|---|---|
| BCMA_EBB-<br>C1980-D2-<br>aa<br>Full CAR | 894 | MALPVTALLLPLALLLHAARPEVQLLESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKIPQTGTFDYWGQGTLVTVSSGGGGSGGGGSGGGG<br>SEIVLTQSPGILSLSPGERATLSCRASQSVSSSYLAWYQQRPGQAPRLLIY<br>GASSRATGIPDRFSGSGSGTDFTLTISRLEPEDFAVYYCQHYGSSPSWTFG<br>QGTRLEIKTTTPAPRPPTPAPTIASQPLSLRPEACRPAAGGAVHTRGLDFA<br>CDIYIWAPLAGTCGVLLLSLVITLYCKRGRKKLLYIFKQPFMRPVQTTQEE<br>DGCSCRFPEEEEGGCELRVKFSRSADAPAYKQGQNQLYNELNLGRREEYDV<br>LDKRRGRDPEMGGKPRRKNPQEGLYNELQKDKMAEAYSEIGMKGERRRGKG<br>HDGLYQGLSTATKDTYDALHMQALPPR |
| BCMA_EBB-<br>C1980-D2-<br>nt<br>Full CAR | 916 | ATGGCCCTCCCTGTCACCGCCCTGCTGCTTCCGCTGGCTCTTCTGCTCCAC<br>GCCGCTCGGCCCGAAGTGCAGCTGCTGGAGTCCGGCGGTGGATTGGTGCAA<br>CCGGGGGGATCGCTCAGACTGTCCTGTGCGGCGTCAGGCTTCACCTTCTCG<br>AGCTACGCCATGTCATGGGTCAGACAGGCCCCTGGAAAGGGTCTGGAATGG<br>GTGTCCGCATTTCCGGGAGCGGGGATCTACATACTACGCCGATAGCGTG<br>AAGGGCCGCTTCACCATTTCCGGGACAACTCCAAGAACACTCTCTATCTG<br>CAAATGAACTCCCTCCGCGCTGAGGACACTGCCGTGTACTACTGCGCCAAA<br>ATCCCTCAGACCGGCACCTTCGACTACTGGGGACAGGGGACTCTGGTCACC<br>GTCAGCAGCGGTGGCGGAGGTTCGGGGGGAGGAGGAAGCGGCGGCGGAGGG<br>TCCGAGATTGTGCTGACCCAGTCACCCGGCACTTTGTCCCTGTCGCCTGGA<br>GAAAGGGCCACCCTTTCCTGCCGGGCATCCCAATCCGTGTCCTCCTCGTAC<br>CTGGCCTGGTACCAGCAGAGGCCCGGACAGGCCCCACGGCTTCTGATCTAC<br>GGAGCAAGCAGCCGCGCGACCGGTATCCCGGACCGGTTTTCGGGCTCGGGC<br>TCAGGAACTGACTTCACCCTCACCATCTCCCGCCTGGAACCCGAAGATTTC<br>GCTGTGTATTACTGCCAGCACTACGGCAGCTCCCGTCCTGGACGTTCGGC<br>CAGGGAACTCGGCTGGAGATCAAGACCACTACCCCAGCACCGAGGCCACCC<br>ACCCCGGCTCCTACCATCGCCTCCCAGCCTCTGTCCCTGCGTCCGGAGGCA<br>TGTAGACCCGCAGCTGGTGGGGCCGTGCATACCCGGGGTCTTGACTTCGCC<br>TGCGATATCTACATTTGGGCCCCTCTGGCTGGTACTTGCGGGGTCCTGCTG<br>CTTTCACTCGTGATCACTCTTTACTGTAAGCGCGGTCGGAAGAAGCTGCTG<br>TACATCTTTAAGCAACCCTTCATGAGGCCTGTGCAGACTACTCAAGAGGAG<br>GACGGCTGTTCATGCCGGTTCCCAGAGGAGGAGGAAGGCGGCTGCGAACTG<br>CGCGTGAAATTCAGCCGCAGCGCAGATGCTCCAGCCTACAAGCAGGGGCAG<br>AACCAGCTCTACAACGAACTCAATCTTGGTCGGAGAGAGGAGTACGACGTG<br>CTGGACAAGCGGAGAGGACGGGACCCAGAAATGGGCGGGAAGCCGCGCAGA<br>AAGAATCCCCAAGAGGGCCTGTACAACGAGCTCCAAAAGGATAAGATGGCA<br>GAAGCCTATAGCGAGATTGGTATGAAAGGGGAACGCAGAAGAGGCAAAGGC<br>CACGACGGACTGTACCAGGGACTCAGCACCGCCACCAAGGACACCTATGAC<br>GCTCTTCACATGCAGGCCCTGCCGCCTCGG |

TABLE 13-continued

Exemplary BCMA CAR molecules.
Sequences are provided with a leader sequence.

| Name/ Description | SEQ ID NO: | Sequence |
|---|---|---|
| BCMA_EBB-C1978-A10 | | |
| BCMA_EBB-C1978-A10-aa Full CAR | 895 | MALPVTALLLPLALLLHAARPEVQLVETGGGLVQPGGSLRLSCAASGFTFS SYAMSWVRQAPGKGLEWVSAISGSGGSTYYADSVKGRFTMSRENDKNSVFL QMNSLRVEDTGVYYCARANYKRELRYYYGMDVWGQGTMVTVSSGGGGSGGG GSGGGGSEIVMTQSPGTLSLSPGESATLSCRASQRVASNYLAWYQHKPGQA PSLLISGASSRATGVPDRFSGSGSGTDFTLAISRLEPEDSAVYYCQHYDSS PSWTFGQGTKVEIKTTTPAPRPPTPAPTIASQPLSLRPEACRPAAGGAVHT RGLDFACDTYIWAPLAGTCGVLLLSLVITLYCKRGRKKLLYIFKQPFMRPV QTTQEEDGCSCRFPEEEEGGCELRVKFSRSADAPAYKQGQNQLYNELNLGR REEYDVLDKRRGRDPEMGGKPRRKNPQEGLYNELQKDKMAEAYSEIGMKGE RRRGKGHDGLYQGLSTATKDTYDALHMQALPPR |
| BCMA_EBB-C1978-A10-nt Full CAR | 917 | ATGGCCCTCCCTGTCACCGCCCTGCTGCTTCCGCTGGCTCTTCTGCTCCAC GCCGCTCGGCCCGAAGTGCAACTGGTGGAAACCGGTGGAGGACTCGTGCAG CCTGGCGGCAGCCTCCGGCTGAGCTGCGCCGCTTCGGGATTCACCTTTTCC TCCTACGCGATGTCTTGGGTCAGACAGGCCCCCGGAAAGGGGCTGGAATGG GTGTCAGCCATCTCCGGCTCCGGCGGATCAACGTACTACGCCGACTCCGTG AAAGGCCGGTTCACCATGTCGCGCGAGAATGACAAGAACTCCGTGTTCCTG CAAATGAACTCCCTGAGGGTGGAGGACACCGGAGTGTACTATTGTGCGCGC GCCAACTACAAGAGAGAGCTGCGGTACTACTACGGAATGGACGTCTGGGGA CAGGGAACTATGGTGACCGTGTCATCCGGTGGAGGGGGAAGCGGCGGTGGA GGCAGCGGGGGCGGGGGTTCAGAAATTGTCATGACCCAGTCCCCGGGAACT CTTTCCCTCTCCCCCGGGGAATCCGCGACTTTGTCCTGCCGGGCCAGCCAG CGCGTGGCCTCGAACTACCTCGCATGGTACCAGCATAAGCCAGGCCAAGCC CCTTCCCTGCTGATTTCCGGGGCTAGCAGCCGCGCCACTGGCGTGCCGGAT AGGTTCTCGGGAAGCGGCTCGGGTACCGATTTCACCCTGGCAATCTCGCGG CTGGAACCGGAGGATTCGGCCGTGTACTACTGCCAGCACTATGACTCATCC CCCTCCTGGACATTCGGACAGGGCACCAAGGTCGAGATCAAGACCACTACC CCAGCACCGAGGCCACCCACCCCGGCTCCTACCATCGCCTCCCAGCCTCTG TCCCTGCGTCCGGAGGCATGTAGACCCGCAGCTGGTGGGGCCGTGCATACC CGGGGTCTTGACTTCGCCTGCGATATCTACATTTGGGCCCCTCTGGCTGGT ACTTGCGGGGTCCTGCTGCTTTCACTCGTGATCACTCTTTACTGTAAGCGC GGTCGGAAGAAGCTGCTGTACATCTTTAAGCAACCCTTCATGAGGCCTGTG CAGACTACTCAAGAGGAGGACGGCTGTTCATGCCGGTTCCCAGAGGAGGAG GAAGGCGGCTGCGAACTGCGCGTGAAATTCAGCCGCAGCGCAGATGCTCCA GCCTACAAGCAGGGGCAGAACCAGCTCTACAACGAACTCAATCTTGGTCGG AGAGAGGAGTACGACGTGCTGGACAAGCGGAGAGGACGGGACCCAGAAATG GGCGGGAAGCCGCGCAGAAAGAATCCCCAAGAGGGCCTGTACAACGAGCTC CAAAAGGATAAGATGGCAGAAGCCTATAGCGAGATTGGTATGAAAGGGGAA CGCAGAAGAGGCAAAGGCCACGACGGACTGTACCAGGGACTCAGCACCGCC ACCAAGGACACCTATGACGCTCTTCACATGCAGGCCCTGCCGCCTCGG |
| BCMA_EBB-C1978-D4 | | |
| BCMA_EBB-C1978-D4-aa Full CAR | 896 | MALPVTALLLPLALLLHAARPEVQLLETGGGLVQPGGSLRLSCAASGFSFS SYAMSWVRQAPGKGLEWVSAISGSGGSTYYADSVKGRFTISRDNSKNTYL QMNSLRAEDTAVYYCAKALVGATGAFDIWGQGTLVTVSSGGGGSGGGGSGG GGSEIVLTQSPGTLSLSPGERATLSCRASQSLSSNFLAWYQQKPGQAPGLL IYGASNWATGTPDRFSGSGSGTDFTLTITRLEPEDFAVYYCQYYGTSPMYT FGQGTKVEIKTTTPAPRPPTPAPTIASQPLSLRPEACRPAAGGAVHTRGLD FACDIYIWAPLAGTCGVLLLSLVITLYCKRGRKKLLYIFKQPFMRPVQTTQ EEDGCSCRFPEEEEGGCELRVKFSRSADAPAYKQGQNQLYNELNLGRREEY DVLDKRRGRDPEMGGKPRRKNPQEGLYNELQKDKMAEAYSEIGMKGERRRG KGHDGLYQGLSTATKDTYDALHMQALPPR |
| BCMA_EBB-C1978-D4-nt Full CAR | 918 | ATGGCCCTCCCTGTCACCGCCCTGCTGCTTCCGCTGGCTCTTCTGCTCCAC GCCGCTCGGCCCGAAGTGCAGCTGCTCGAAACCGGTGGAGGGCTGGTGCAG CCAGGGGGCTCCCTGAGGCTTTCATGCGCCGCTAGCGGATTCTCCTTCTCC TCTTACGCCATGTCGTGGGTCCGCCAAGCCCTGGAAAAGGCCTGGAATGG GTGTCCGCGATTTCCGGGAGCGGAGGTTCGACCTATTACGCCGACTCCGTG AAGGGCCGCTTTACCATCTCCCGGGATAACTCCAAGAACACTCTGTACCTC CAAATGAACTCGCTGAGAGCCGAGGACACCGCCGTGTATTACTGCGCGAAG GCGCTGGTCGGCGCGACTGGGGCATTCGACATCTGGGGACAGGGAACTCTT GTGACCGTGTCGAGCGGAGGCGGCGGCTCCGGCGGAGGAGGGAGCGGGGGC GGTGGTTCCGAAATCGTGTTGACTCAGTCCCCGGGAACCCTGAGCTTGTCA CCCGGGGAGCGGGCCACTCTCTCCTGTCGCGCCTCCCAATGCTCTCATCC AATTTCCTGGCCTGGTACCAGCAGAAGCCCGGACAGGCCCCGGGCCTGCTC ATCTACGGCGCTTCAAACTGGGCAACGGGAACCCCTGATCGGTTCAGCGGA AGCGGATCGGGTACTGACTTTACCCTGACCATCACCAGACTGGAACCGGAG GACTTCGCCGTGTACTACTGCCAGTACTACGGCACCTCCCCCATGTACACA TTCGGACAGGGTACCAAGGTCGAGATTAAGACCACTACCCCAGCACCGAGG CCACCCACCCCGGCTCCTACCATCGCCTCCCAGCCTCTGTCCCTGCGTCCG GAGGCATGTAGACCCGCAGCTGGTGGGGCCGTGCATACCCGGGGTTTGAC |

TABLE 13-continued

Exemplary BCMA CAR molecules.
Sequences are provided with a leader sequence.

| Name/ Description | SEQ ID NO: | Sequence |
|---|---|---|
| | | TTCGCCTGCGATATCTACATTTGGGCCCCTCTGGCTGGTACTTGCGGGGTC CTGCTGCTTTCACTCGTGATCACTCTTTACTGTAAGCGCGGTCGGAAGAAG CTGCTGTACATCTTTAAGCAACCCTTCATGAGGCCTGTGCAGACTACTCAA GAGGAGGACGGCTGTTCATGCCGGTTCCCAGAGGAGGAGGAAGGCGGCTGC GAACTGCGCGTGAAATTCAGCCGCAGCGCAGATGCTCCAGCCTACAAGCAG GGGCAGAACCAGCTCTACAACGAACTCAATCTTGGTCGGAGAGAGGAGTAC GACGTGCTGGACAAGCGGAGAGGACGGGACCCAGAAATGGGCGGGAAGCCG CGCAGAAAGAATCCCAAGAGGGCCTGTACAACGAGCTCCAAAAGGATAAG ATGGCAGAAGCCTATAGCGAGATTGGTATGAAAGGGGAACGCAGAAGAGGC AAAGGCCACGACGGACTGTACCAGGGACTCAGCACCGCCACCAAGGACACC TATGACGCTCTTCACATGCAGGCCCTGCCGCCTCGG |

BCMA_EBB-C1980-A2

| BCMA_EBB- C1980-A2- aa Full CAR | 897 | MALPVTALLLPLALLLHAARPEVQLLESGGGLVQPGGSLRLSCAASGFTFS SYAMSWVRQAPGKGLEWVSAISGSGGSTYYADSVKGRFTISRDNSKNTLYL QMNSLRAEDTAVYYCVLWFGEGFDPWGQGTLVTVSSGGGGSGGGGSGGGGS DIVLTQSPLSLPVTPGEPASISCRSSQSLLHSNGYNYLDWYLQKPGQSPQL LIYLGSNRASGVPDRFSGSGSGTDFTLKISRVEAEDVGVYYCMQALQTPLT FGGGTKVDIKTTTPAPRPPTPAPTIASQPLSLRPEACRPAAGGAVHTRGLD FACDTYIWAPLAGTCGVLLLSLVITLYCKRGRKKLLYIFKQPFMRPVQTTQ EEDGCSCRFPEEEEGGCELRVKFSRSADAPAYKQGQNQLYNELNLGRREEY DVLDKRRGRDPEMGGKPRRKNPQEGLYNELQKDKMAEAYSEIGMKGERRRG KGHDGLYQGLSTATKDTYDALHMQALPPR |
| BCMA_EBB- C1980-A2- nt Full CAR | 919 | ATGGCCCTCCCTGTCACCGCCCTGCTGCTTCCGCTGGCTCTTCTGCTCCAC GCCGCTCGGCCCGAAGTGCAGCTGCTTGAGAGCGGTGGAGGTCTGGTGCAG CCCGGGGGGATCACTGCGCCTGTCCTGTGCCGCGTCCGGTTCACTTTCTCC TCGTACGCCATGTCGTGGGTCAGACAGGCACCGGGAAAGGGACTGGAATGG GTGTCAGCCATTTCGGGTTCGGGGGGCAGCACCTACTACGCTGACTCCGTG AAGGGCCGGTTCACCATTTCCCGCGACAACTCCAAGAACACCTTGTACCTC CAAATGAACTCCCTGCGGGCCGAAGATACCGCCGTGTATTACTGCGTCTG TGGTTCGGAGAGGGATTCGACCCGTGGGGACAAGGAACACTCGTGACTGTG TCATCCGGCGGAGGCGGCAGCGGTGGCGGCGGTTCCGGCGGCGGCGGATCT GACATCGTGTTGACCCAGTCCCCTCTGAGCCTGCCGGTCACTCCTGGCGAA CCAGCCAGCATCTCCTGCCGGTCGAGCCAGTCCCTCCTGCACTCCAATGGG TACAACTACCTCGATTGGTATCTGCAAAAGCCGGGCCAGAGCCCCCAGCTG CTGATCTACCTTGGGTCAAACCGCGCTTCCGGGGTGCCTGATAGATTCTCC GGGTCCGGGAGCGGAACCGACTTTACCCTGAAAATCTCGAGGGTGGAGGCC GAGGACGTCGGAGTGTACTACTGCATGCAGGCGCTCCAGACTCCCCTGACC TTCGGAGGAGGAACGAAGGTCGACATCAAGACCACTACCCCAGCACCGAGG CCACCCACCCCGGCTCCTACCATCGCCTCCCAGCCTCTGTCCCTGCGTCCG GAGGCATGTAGACCCGCAGCTGGTGGGCCGTGCATACCCGGGGTCTTGAC TTCGCCTGCGATATCTACATTTGGGCCCCTCTGGCTGGTACTTGCGGGGTC CTGCTGCTTTCACTCGTGATCACTCTTTACTGTAAGCGCGGTCGGAAGAAG CTGCTGTACATCTTTAAGCAACCCTTCATGAGGCCTGTGCAGACTACTCAA GAGGAGGACGGCTGTTCATGCCGGTTCCCAGAGGAGGAGGAAGGCGGCTGC GAACTGCGCGTGAAATTCAGCCGCAGCGCAGATGCTCCAGCCTACAAGCAG GGGCAGAACCAGCTCTACAACGAACTCAATCTTGGTCGGAGAGAGGAGTAC GACGTGCTGGACAAGCGGAGAGGACGGGACCCAGAAATGGGCGGGAAGCCG CGCAGAAAGAATCCCAAGAGGGCCTGTACAACGAGCTCCAAAAGGATAAG ATGGCAGAAGCCTATAGCGAGATTGGTATGAAAGGGGAACGCAGAAGAGGC AAAGGCCACGACGGACTGTACCAGGGACTCAGCACCGCCACCAAGGACACC TATGACGCTCTTCACATGCAGGCCCTGCCGCCTCGG |

BCMA_EBB-C1981-C3

| BCMA_EBB- C1981-C3- aa Full CAR | 898 | MALPVTALLLPLALLLHAARPQVQLVESGGGLVQPGGSLRLSCAASGFTFS SYAMSWVRQAPGKGLEWVSAISGSGGSTYYADSVKGRFTISRDNSKNTLYL QMNSLRAEDTAVYYCAKVGYDSSGYYRDYYGMDVWGQGTTVTVSSGGGGSG GGGSGGGGSEIVLTQSPGTLSLSPGERATLSCRASQSVSSSYLAWYQQKPG QAPRLLIYGTSSRATGISDRFSGSGSGTDFTLTISRLEPEDFAVYYCQHYG NSPPKFTFGPGTKLEIKTTTPAPRPPTPAPTIASQPLSLRPEACRPAAGGA VHTRGLDFACDIYIWAPLAGTCGVLLLSLVITLYCKRGRKKLLYIFKQPFM RPVQTTQEEDGCSCRFPEEEEGGCELRVKFSRSADAPAYKQGQNQLYNELN LGRREEYDVLDKRRGRDPEMGGKPRRKNPQEGLYNELQKDKMAEAYSEIGM KGERRRGKGHDGLYQGLSTATKDTYDALHMQALPPR |
| BCMA_EBB- C1981-C3- nt Full CAR | 920 | ATGGCCCTCCCTGTCACCGCCCTGCTGCTTCCGCTGGCTCTTCTGCTCCAC GCCGCTCGGCCCCAAGTGCAGCTCGTCGAGTCAGGCGGAGGACTGGTGCAG CCCGGGGGGCTCCTGAGACTTTCCTGCGCGGCATCGGGTTTTACCTTCTCC TCCTATGCTATGTCCTGGGTGCGCCAGGCCCCGGGAAAGGGACTGGAATGG GTGTCCGCAATCAGCGGTAGCGGGGGCTCAACATACTACGCCGACTCCGTC AAGGGTCGCTTCACTATTTCCCGGGACAACTCCAAGAATACCCTGTACCTC CAAATGAACAGCCTCAGGGCCGAGGATACTGCCGTGTACTACTGCGCCAAA |

TABLE 13-continued

Exemplary BCMA CAR molecules.
Sequences are provided with a leader sequence.

| Name/Description | SEQ ID NO: | Sequence |
|---|---|---|
| | | GTCGGATACGATAGCTCCGGTTACTACCGGGACTACTACGGAATGGACGTG<br>TGGGGACAGGGCACCACCGTGACCGTGTCAAGCGGCGGAGGCGGTTCAGGA<br>GGGGGAGGCTCCGGCGGTGGAGGGTCCGAAATCGTCCTGACTCAGTCGCCT<br>GGCACTCTGTCGTTGTCCCCGGGGGAGCGCGCTACCCTGTCGTGTCGGGCG<br>TCGCAGTCCGTGTCGAGCTCCTACCTCGCGTGGTACCAGCAGAAGCCCGGA<br>CAGGCCCCTAGACTTCTGATCTACGGCACTTCTTCACGCGCCACCGGGATC<br>AGCGACAGGTTCAGCGGCTCCGGCTCCGGGACCGACTTCACCCTGACCATT<br>AGCCGGCTGGAGCCTGAAGATTTCGCCGTGTATTACTGCCAACACTACGGA<br>AACTCGCCGCCAAAGTTCACGTTCGGACCCGGAACCAAGCTGGAAATCAAG<br>ACCACTACCCCAGCACCGAGGCCACCCACCCCGGCTCCTACCATCGCCTCC<br>CAGCCTCTGTCCCTGCGTCCGGAGGCATGTAGACCCGCAGCTGGTGGGGCC<br>GTGCATACCCGGGGTCTTGACTTCGCCTGCGATATCTACATTTGGGCCCCT<br>CTGGCTGGTACTTGCGGGGTCCTGCTGCTTTCACTCGTGATCACTCTTTAC<br>TGTAAGCGCGGTCGGAAGAAGCTGCTGTACATCTTTAAGCAACCCTTCATG<br>AGGCCTGTGCAGACTACTCAAGAGGAGGACGGCTGTTCATGCCGGTTCCCA<br>GAGGAGGAGGAAGGCGGCTGCGAACTGCGCGTGAAATTCAGCCGCAGCGCA<br>GATGCTCCAGCCTACAAGCAGGGGCAGAACCAGCTCTACAACGAACTCAAT<br>CTTGGTCGAGAGAGGAGTACGACGTGCTGGACAAGCGGAGAGGACGGGAC<br>CCAGAAATGGGCGGGAAGCCGCGCAGAAAGAATCCCCAAGAGGGCCTGTAC<br>AACGAGCTCCAAAAGGATAAGATGGCAGAAGCCTATAGCGAGATTGGTATG<br>AAAGGGGAACGCAGAAGAGGCAAAGGCCACGACGGACTGTACCAGGGACTC<br>AGCACCGCCACCAAGGACACCTATGACGCTCTTCACATGCAGGCCCTGCCG<br>CCTCGG |
| BCMA_EBB-C1978-G4 | | |
| BCMA_EBB-C1978-G4-aa Full CAR | 899 | MALPVTALLLPLALLLHAARPEVQLVESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKMGWSSGYLGAFDIWGQGTTVTVSSGGGGSGGGGS<br>GGGGSEIVLTQSPGTLSLSPGERATLSCRASQSVASSFLAWYQQKPGQAPR<br>LLIYGASGRATGIPDRFSGSGSGTDFTLTISRLEPEDFAVYYCQHYGGSPR<br>LTFGGGTKVDIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCREPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| BCMA_EBB-C1978-G4-nt Full CAR | 921 | ATGGCCCTCCCTGTCACCGCCCTGCTGCTTCCGCTGGCTCTTCTGCTCCAC<br>GCCGCTCGGCCCGAAGTCCAACTGGTGGAGTCCGGGGGAGGGCTCGTGCAG<br>CCCGGAGGCAGCCTTCGGCTGTCGTGCGCCGCCTCCGGGTTCACGTTCTCA<br>TCCTACGCGATGTCGTGGGTCAGACAGGCACCAGGAAAGGGACTGGAATGG<br>GTGTCCGCCATTAGCGGCTCCGGCGGTAGCACCTACTATGCCGACTCAGTG<br>AAGGGAAGGTTCACTATCTCCCGCGACAACAGCAAGAACACCCTGTACCTC<br>CAAATGAACTCTCTGCGGGCCGAGGATACCGCGGTGTACTATTGCGCCAAG<br>ATGGGTTGGTCCAGCGGATACTTGGGAGCCTTCGACATTTGGGGACAGGGC<br>ACTACTGTGACCGTGTCCTCCGGGGGTGGCGGATCGGGAGGCGGCGGCTCG<br>GGTGGAGGGGGTTCCGAAATCGTGTTGACCCAGTCACCGGGAACCCTCTCG<br>CTGTCCCCGGGAGAACGGGCTACACTGTCATGTAGAGCGTCCCAGTCCGTG<br>GCTTCCTCGTTCCTGGCCTGGTACCAGCAGAAGCCGGGACAGGCACCCCGC<br>CTGCTCATCTACGGAGCCAGCGGCCGGGCGACCGGCATCCCTGACCGCTTC<br>TCCGGTTCCGGCTCGGGCACCGACTTTACTCTGACCATTAGCAGGCTTGAG<br>CCCGAGGATTTTGCCGTGTACTACTGCCAACACTACGGGGGGAGCCCTCGC<br>CTGACCTTCGGAGGCGGAACTAAGGTCGATATCAAAACCACTACCCCAGCA<br>CCGAGGCCACCCACCCCGGCTCCTACCATCGCCTCCCAGCCTCTGTCCCTG<br>CGTCCGGAGGCATGTAGACCCGCAGCTGGTGGGGCCGTGCATACCCGGGGT<br>CTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |

In one embodiment, the CAR molecule comprises (or consists of) an amino acid sequence provided in Table 13, or Table 1 of WO2016/014565, or as otherwise described herein. In one embodiment, the CAR molecule comprises (or consists of) an amino acid sequence of SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 879, SEQ ID NO: 880, SEQ ID NO: 881, SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, or SEQ ID NO: 899; or an amino acid sequence having at least one, two, three, four, five, 10, 15, 20 or 30 modifications (e.g., substitutions, e.g., conservative substitutions) but not more than 60, 50, or 40 modifications (e.g., substitutions, e.g., conservative substitutions) of an amino acid sequence of SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 879, SEQ ID NO: 880, SEQ ID NO: 881, SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, or SEQ ID NO: 899; or an amino acid sequence having 85%, 90%, 95%, 96%, 97%, 98%, 99% identity to an amino acid sequence of SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 879, SEQ ID NO: 880, SEQ ID NO: 881, SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, or SEQ ID NO: 899.

Transmembrane Domains

With respect to the transmembrane domain, in various embodiments, a CAR can be designed to comprise a transmembrane domain that is attached to the extracellular domain of the CAR, e.g., attached to any of the antigen binding domains listed above. The transmembrane domain can also, in some embodiments, be attached to an intracellular domain of the CAR (e.g., a costimulatory and/or primary signalling domain). A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR e.g., in one embodiment, the transmembrane domain may be from the same protein that the signaling domain, costimulatory domain or the hinge domain is derived from. In another aspect, the transmembrane domain is not derived from the same protein that any other domain of the CAR is derived from. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect, the amino acid sequence of the transmembrane domain may be modified or substituted so as to minimize interactions with the binding domains of the native binding partner present in the same CAR-expressing cell.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this disclosure may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R α, ITGA1, VLA1, CD49a, ITGA4, IA4, CD49D, ITGA6, VLA-6, CD49f, ITGAD, CD11 d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Lyl08), SLAM (SLAMF1, CD150, IPO-3), BLAME (SLAMF8), SELPLG (CD162), LTBR, PAG/Cbp, NKG2D, NKG2C, or a transmembrane domain derived from any protein thereof.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge (e.g., an IgG4 hinge, an IgD hinge), a GS linker (e.g., a GS linker described herein), a KIR2DS2 hinge or a CD8a hinge. In one embodiment, the hinge or spacer comprises (or consists of) the amino acid sequence of SEQ ID NO: 5. In one aspect, the transmembrane domain comprises (or consists of) a transmembrane domain of SEQ ID NO: 13.

In certain embodiments, the encoded transmembrane domain comprises an amino acid sequence of a CD8 transmembrane domain having at least one, two or three modifications but not more than 20, 10 or 5 modifications of an amino acid sequence of SEQ ID NO: 13, or a sequence with 95-99% identity to an amino acid sequence of SEQ ID NO: 13. In one embodiment, the encoded transmembrane domain comprises the sequence of SEQ ID NO: 13.

In other embodiments, the nucleic acid molecule encoding the CAR comprises a nucleotide sequence of a CD8 transmembrane domain, e.g., comprising the sequence of SEQ ID NO: 14, or a sequence with 95-99% identity thereof.

In certain embodiments, the encoded antigen binding domain is connected to the transmembrane domain by a hinge region. In one embodiment, the encoded hinge region comprises the amino acid sequence of a CD8 hinge, e.g., SEQ ID NO: 5; or the amino acid sequence of an IgG4 hinge, e.g., SEQ ID NO: 7, or a sequence with 95-99% identity to SEQ ID NO: 5 or 7. In other embodiments, the nucleic acid sequence encoding the hinge region comprises a sequence of SEQ ID NO: 6 or SEQ ID NO: 8, corresponding to a CD8 hinge or an IgG4 hinge, respectively, or a sequence with 95-99% identity to SEQ ID NO:6 or 8.

In one aspect, the hinge or spacer comprises an IgG4 hinge. For example, in one embodiment, the hinge or spacer comprises a hinge of the amino acid sequence (SEQ ID NO: 7)
ESKYGPPCPPCPAPEFLGGPSVFLFPPKPKDTLMISRTPEVTCVVVDVSQE

DPEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVKG

FYPSDIAVEWESNGQPENNYKTTPPVLDSDGSFFLYSRLTVDKSRWQEGNV

FSCSVMHEALHNHYTQKSLSLSLGKM.

In some embodiments, the hinge or spacer comprises a hinge encoded by a nucleotide sequence of (SEQ ID NO: 8)
GAGAGCAAGTACGGCCCTCCCTGCCCCCCTTGCCCTGCCCCCGAGTTCCTG

GGCGGACCCAGCGTGTTCCTGTTCCCCCCCAAGCCCAAGGACACCCTGATG

ATCAGCCGGACCCCCGAGGTGACCTGTGTGGTGGTGGACGTGTCCCAGGAG

GACCCCGAGGTCCAGTTCAACTGGTACGTGGACGGCGTGGAGGTGCACAAC

GCCAAGACCAAGCCCCGGGAGGAGCAGTTCAATAGCACCTACCGGGTGGTG

TCCGTGCTGACCGTGCTGCACCAGGACTGGCTGAACGGCAAGGAATACAAG

TGTAAGGTGTCCAACAAGGGCCTGCCCAGCAGCATCGAGAAAACCATCAGC

AAGGCCAAGGGCCAGCCTCGGGAGCCCCAGGTGTACACCCTGCCCCCTAGC

CAAGAGGAGATGACCAAGAACCAGGTGTCCCTGACCTGCCTGGTGAAGGGC

TTCTACCCCAGCGACATCGCCGTGGAGTGGGAGAGCAACGGCCAGCCCGAG

AACAACTACAAGACCACCCCCCCTGTGCTGGACAGCGACGGCAGCTTCTTC

CTGTACAGCCGGCTGACCGTGGACAAGAGCCGGTGGCAGGAGGGCAACGTC

TTTAGCTGCTCCGTGATGCACGAGGCCCTGCACAACCACTACACCCAGAAG

AGCCTGAGCCTGTCCCTGGGCAAGATG.

In one aspect, the hinge or spacer comprises an IgD hinge. For example, in one embodiment, the hinge or spacer comprises a hinge of the amino acid sequence (SEQ ID NO: 9)
RWPESPKAQASSVPTAQPQAEGSLAKATTAPATTRNTGRGGEEKKKEKEKE

EQEERETKTPECPSHTQPLGVYLLTPAVQDLWLRDKATFTCFVVGSDLKDA

HLTWEVAGKVPTGGVEEGLLERHSNGSQSQHSRLTLPRSLWNAGTSVTCTL

NHPSLPPQRLMALREPAAQAPVKLSLNLLASSDPPEAASWLLCEVSGESPP

NILLMWLEDQREVNTSGEAPARPPPQPGSTTFWAWSVLRVPAPPSPQPATY

TCVVSHEDSRTLLNASRSLEVSYVTDH.

In some embodiments, the hinge or spacer comprises a hinge encoded by a nucleotide sequence of (SEQ ID NO: 10)
AGGTGGCCCGAAAGTCCCAAGGCCCAGGCATCTAGTGTTCCTACTGCACAG

CCCCAGGCAGAAGGCAGCCTAGCCAAAGCTACTACTGCACCTGCCACTACG

-continued
CGCAATACTGGCCGTGGCGGGGAGGAGAAGAAAAAGGAGAAAGAGAAAGAA

GAACAGGAAGAGAGGGAGACCAAGACCCCTGAATGTCCATCCCATACCCAG

CCGCTGGGCGTCTATCTCTTGACTCCCGCAGTACAGGACTTGTGGCTTAGA

GATAAGGCCACCTTTACATGTTTCGTCGTGGGCTCTGACCTGAAGGATGCC

CATTTGACTTGGGAGGTTGCCGGAAAGGTACCCACAGGGGGGGTTGAGGAA

GGGTTGCTGGAGCGCCATTCCAATGGCTCTCAGAGCCAGCACTCAAGACTC

ACCCTTCCGAGATCCCTGTGGAACGCCGGGACCTCTGTCACATGTACTCTA

AATCATCCTAGCCTGCCCCCACAGCGTCTGATGGCCCTTAGAGAGCCAGCC

GCCCAGGCACCAGTTAAGCTTAGCCTGAATCTGCTCGCCAGTAGTGATCCC

CCAGAGGCCGCCAGCTGGCTCTTATGCGAAGTGTCCGGCTTTAGCCCGCCC

AACATCTTGCTCATGTGGCTGGAGGACCAGCGAGAAGTGAACACCAGCGGC

TTCGCTCCAGCCCGGCCCCCACCCCAGCCGGGTTCTACCACATTCTGGGCC

TGGAGTGTCTTAAGGGTCCCAGCACCACCTAGCCCCCAGCCAGCCACATAC

ACCTGTGTTGTGTCCCATGAAGATAGCAGGACCCTGCTAAATGCTTCTAGG

AGTCTGGAGGTTTCCTACGTGACTGACCATT.

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO:11). In some embodiments, the linker is encoded by a nucleotide sequence of GGTGGCGGAGGTTCTGGAGGTGGAGGTTCC (SEQ ID NO: 12).

In one aspect, the hinge or spacer comprises a KIR2DS2 hinge.

Signaling Domains

In embodiments having an intracellular signaling domain, such a domain can contain, e.g., one or more of a primary signaling domain and/or a costimulatory signaling domain. In some embodiments, the intracellular signaling domain comprises a sequence encoding a primary signaling domain. In some embodiments, the intracellular signaling domain comprises a costimulatory signaling domain. In some embodiments, the intracellular signaling domain comprises a primary signaling domain and a costimulatory signaling domain.

The intracellular signaling sequences within the cytoplasmic portion of the CAR may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequences. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

Primary Signaling Domains

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the disclosure include those of CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In one embodiment, a CAR of the disclosure comprises an intracellular signaling domain, e.g., a primary signaling domain of CD3-zeta.

In one embodiment, the encoded primary signaling domain comprises a functional signaling domain of CD3 zeta. The encoded CD3 zeta primary signaling domain can comprise an amino acid sequence having at least one, two or three modifications but not more than 20, 10 or 5 modifications of an amino acid sequence of SEQ ID NO: 21 or SEQ ID NO: 24, or a sequence with 95-99% identity to an amino acid sequence of SEQ ID NO: 21 or SEQ ID NO: 24. In some embodiments, the encoded primary signaling domain comprises a sequence of SEQ ID NO: 21 or SEQ ID NO: 24. In other embodiments, the nucleic acid sequence encoding the primary signaling domain comprises a sequence of SEQ ID NO: 22 or SEQ ID NO: 25, or a sequence with 95-99% identity thereof.

Costimulatory Signaling Domains

In some embodiments, the encoded intracellular signaling domain comprises a costimulatory signaling domain. For example, the intracellular signaling domain can comprise a primary signaling domain and a costimulatory signaling domain. In some embodiments, the encoded costimulatory signaling domain comprises a functional signaling domain of a protein chosen from one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD1 b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Lyl08), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D.

In certain embodiments, the encoded costimulatory signaling domain comprises an amino acid sequence having at least one, two or three modifications but not more than 20, 10 or 5 modifications of an amino acid sequence of SEQ ID NO: 16 or SEQ ID NO: 19, or a sequence with 95-99% identity to an amino acid sequence of SEQ ID NO: 16 or SEQ ID NO: 19. In one embodiment, the encoded costimulatory signaling domain comprises a sequence of SEQ ID NO: 16 or SEQ ID NO: 19. In other embodiments, the nucleic acid sequence encoding the costimulatory signaling domain comprises a sequence of SEQ ID NO: 17 or SEQ ID NO: 20, or a sequence with 95-99% identity thereof.

In other embodiments, the encoded intracellular domain comprises the sequence of SEQ ID NO: 16 or SEQ ID NO: 19, and the sequence of SEQ ID NO: 21 or SEQ ID NO: 24, wherein the sequences comprising the intracellular signaling domain are expressed in the same frame and as a single polypeptide chain.

In certain embodiments, the nucleic acid sequence encoding the intracellular signaling domain comprises a sequence of SEQ ID NO: 17 or SEQ ID NO: 20, or a sequence with 95-99% identity thereof, and a sequence of SEQ ID NO: 22 or SEQ ID NO: 25, or a sequence with 95-99% identity thereof.

In some embodiments, the nucleic acid molecule further encodes a leader sequence. In one embodiment, the leader sequence comprises the sequence of SEQ ID NO: 2.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 16. In one aspect, the signaling domain of CD3-zeta is a signaling domain of SEQ ID NO: 21.

In one aspect, the intracellular signaling domain is designed to comprise the signaling domain of CD3-zeta and the signaling domain of CD27. In one aspect, the signaling domain of CD27 comprises an amino acid sequence of QRRKYRSNKGESPVEPAEPCRYSCPREEEGSTIP-IQEDYRKPEPACSP (SEQ ID NO: 19). In one aspect, the signalling domain of CD27 is encoded by a nucleic acid sequence of AGGAGTAAGAG-GAGCAGGCTCCTGCACAGTGACTACATGAA-CATGACTCCCCGCC GCCCCGGGCC-CACCCGCAAGCATTACCAGCCCTATGCCCCACCAC-GCGACTTCGC AGCCTATCGCTCC (SEQ ID NO: 20).

Vectors

In another aspect, the disclosure pertains to a vector comprising a nucleic acid sequence encoding a CAR described herein. In one embodiment, the vector is chosen from a DNA vector, an RNA vector, a plasmid, a lentivirus vector, adenoviral vector, or a retrovirus vector. In one embodiment, the vector is a lentivirus vector. These vectors or portions thereof may, among other things, be used to create template nucleic acids, as described herein for use with the CRISPR systems as described herein. Alternatively, the vectors may be used to deliver nucleic acid directly to the cell, e.g., the immune effector cell, e.g., the T cell, e.g., the allogeneic T cell, independent of the CRISPR system.

The present disclosure also provides vectors in which a DNA disclosed herein is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the disclosure is an adenoviral vector (A5/35). In another embodiment, the expression of nucleic acids encoding CARs can be accomplished using of transposons such as sleeping beauty, crisper, CAS9, and zinc finger nucleases. See below June et al. 2009*Nature Reviews Immunology* 9.10: 704-716, is incorporated herein by reference.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Disclosed herein are methods for producing an in vitro transcribed RNA CAR. The present disclosure also includes a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO: 10555). RNA so produced can efficiently transfect different kinds of cells. In one aspect, the template includes sequences for the CAR.

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases). In specific embodiments, the use of the gene editing system inserts the nucleic acid sequence encoding the CAR at a defined locus, e.g., within a TET2 intron, e.g., within a sequence listed in Table 3.

In some embodiments, modified cells as disclosed herein, e.g., T or NK cells, e.g., autologous or allogeneic T cells, e.g., described herein, (e.g., that express a CAR described herein) are generated by contacting the cells with (a) a composition comprising one or more gRNA molecules, e.g., as described herein, and one or more Cas molecules, e.g., a Cas9 molecule, e.g., as described herein, and (b) nucleic acid comprising sequence encoding a CAR, e.g., described herein (such as a template nucleic acid molecule as described herein). Without being bound by theory, said composition of (a), above, will induce a break at or near the genomic DNA targeted by the targeting domain of the gRNA molecule(s), and the nucleic acid of (b) will incorporate, e.g., partially or wholly, into the genome at or near said break, such that upon integration, the encoded CAR molecule is expressed. In some embodiments, the % incorporation of the nucleic acid sequence is at least about 5%, 10%, 15%, 20%, 25%, 30%, 35%, 40%, 45%, 50%, 55%, 60%, 65% or 70% at a time point after the cell is contacted, as measured by a suitable method, e.g., PCR, sequencing, single-cell genotyping, ddPCR genotyping, Southern blot, and/or cell surface staining. In some embodiments, a population of cells is provided, for example, after subsequent selection steps, wherein the nucleic acid sequence is incorporated in, e.g., at least about 10%, 15%, 20%, 25%, 30%, 35%, 40%, 45%, 50%, 55%, 60%, 65%, 70%, 75%, 80%, 85%, 90%, 95%, or 99% of the cells of the population.

In embodiments, expression of the CAR will be controlled by promoters or other regulatory elements endogenous to the genome (e.g., the promoter controlling expression from the gene in which the nucleic acid of (b) was inserted). In other embodiments, the nucleic acid of (b) further comprises a promoter and/or other regulatory elements, e.g., as described herein, e.g., an EF1-alpha promoter, operably linked to the sequence encoding the CAR, such that upon integration, expression of the CAR is controlled by that promoter and/or other regulatory elements. Additional features of the disclosure relating to use of CRISPR/Cas9 systems, e.g., as described herein, to direct incorporation of nucleic acid sequence encoding a CAR, e.g., as described herein, are described elsewhere in this application, e.g., in the section relating to gene insertion and homologous recombination. In embodiments, the composition of a) above is a composition comprising RNPs comprising the one or more gRNA molecules. In embodiments, RNPs comprising gRNAs targeting unique target sequences are introduced into the cell simultaneously, e.g., as a mixture of RNPs comprising the one or more gRNAs. In embodiments, RNPs comprising gRNAs targeting unique target sequences are introduced into the cell sequentially.

In some embodiments, the modified cells are generated by contacting a cell with (a) a composition comprising one or more gRNA molecules, e.g., as described herein, and one or more Cas molecules, e.g., a Cas9 molecule, e.g., as described herein, and (b) a nucleic acid that is capable of disrupting the expression of TET2. Without being bound by theory, said composition of (a), above, will induce a break at or near the genomic DNA targeted by the targeting domain of the gRNA molecule(s), and the nucleic acid of (b) will incorporate, e.g., partially or wholly, into the genome at or near said break, such that upon integration, the expression of at least one TET2 isoform is reduced.

In some embodiments, the modified cells are generated by contacting a cell with (a) a composition comprising one or more gRNA molecules, e.g., as described herein, and one or more Cas molecules, e.g., a Cas9 molecule, e.g., as described herein, and (b) a nucleic acid comprising a sequence encoding a CAR. Without being bound by theory, said composition of (a), above, will induce a break at or near the genomic DNA targeted by the targeting domain of the gRNA molecule(s), and nucleic acid comprising a sequence encoding a CAR of (b) will incorporate, e.g., partially or wholly, into the genome at or near said break, such that upon integration, the expression of at least one TET2 isoform is reduced.

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Inhibitory Domains

In an embodiment, the vector comprises a nucleic acid sequence that encodes a CAR, e.g., a CAR described herein, and a nucleic acid sequence that encodes an inhibitory molecule comprising: an inhKIR cytoplasmic domain; a transmembrane domain, e.g., a KIR transmembrane domain; and an inhibitor cytoplasmic domain, e.g., an ITIM domain, e.g., an inhKIR ITIM domain. In an embodiment the inhibitory molecule is a naturally occurring inhKIR, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring inhKIR.

In an embodiment, the nucleic acid sequence that encodes an inhibitory molecule comprises: a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In an embodiment the inhibitory molecule is a naturally occurring SLAM family member, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring SLAM family member.

In one embodiment, the vector is an in vitro transcribed vector, e.g., a vector that transcribes RNA of a nucleic acid molecule described herein. In one embodiment, the nucleic acid sequence in the vector further comprises a poly(A) tail, e.g., a poly A tail. In one embodiment, the nucleic acid sequence in the vector further comprises a 3'UTR, e.g., a 3' UTR described herein, e.g., comprising at least one repeat of a 3'UTR derived from human beta-globulin. In one embodiment, the nucleic acid sequence in the vector further comprises promoter, e.g., a T2A promoter.

Promoters

In one embodiment, the vector further comprises a promoter. In some embodiments, the promoter is chosen from an EF-1 promoter, a CMV IE gene promoter, an EF-1a promoter, an ubiquitin C promoter, or a phosphoglycerate kinase (PGK) promoter. In one embodiment, the promoter is an EF-1 promoter. In one embodiment, the EF-1 promoter comprises a sequence of SEQ ID NO: 1.

Host Cells for CAR Expression

As noted above, in some aspects the disclosure pertains to a cell, e.g., an immune effector cell, (e.g., a population of cells, e.g., a population of immune effector cells) comprising a nucleic acid molecule (e.g., a template nucleic acid molecule), a CAR polypeptide molecule, or a vector as described herein.

In certain aspects of the present disclosure, immune effector cells, e.g., T cells, can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi: 10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., TREG cells), in a subject prior to apheresis or during manufacturing of a CAR-expressing cell product can reduce the risk of subject relapse. For example, methods of depleting TREG cells are known in the art. Methods of decreasing TREG cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) TREG cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete TREG cells prior to manufacturing of the CAR-expressing cell (e.g., T cell, NK cell) product.

In an embodiment, a subject is pre-treated with one or more therapies that reduce TREG cells prior to collecting cells for CAR-expressing cell product manufacturing, thereby reducing the risk of subject relapse to CAR-expressing cell treatment. In an embodiment, methods of decreasing TREG cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide to reduce TREG cells prior to collecting cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include B7-H1, B7-1, CD160, P1H, 2B4, PD1, TIM3, CEACAM (e.g., CEACAM-1, CEACAM-3 and/or CEACAM-5), LAG3, TIGIT, CTLA-4, BTLA and LAIR1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

Methods described herein can include a positive selection step. For example, T cells can be isolated by incubation with anti-CD3/anti-CD28 (e.g., 3×28)-conjugated beads, such as DYNABEADS® M-450 CD3/CD28 T, for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another embodiment, the time period is 10 to 24 hours, e.g., 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 10 billion cells/ml, 9 billion/ml, 8 billion/ml, 7 billion/ml, 6 billion/ml, or 5 billion/ml is used. In one aspect, a concentration of 1 billion cells/ml is used. In yet one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5 \times 10^6$/ml. In other aspects, the concentration used can be from about $1 \times 10^5$/ml to $1 \times 10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present disclosure.

Also contemplated in the context of the disclosure is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present disclosure, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present disclosure to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity. Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

In some aspects, the cells of the disclosure (e.g., the immune effector cells of the disclosure, e.g., the CAR-expressing cells of the disclosure) are induced pluripotent stem cells ("iPSCs") or embryonic stem cells (ESCs), or are T cells generated from (e.g., differentiated from) said iPSC and/or ESC. iPSCs can be generated, for example, by methods known in the art, from peripheral blood T lymphocytes, e.g., peripheral blood T lymphocytes isolated from a healthy volunteer. As well, such cells may be differentiated into T cells by methods known in the art. See e.g., Themeli M. et al., *Nat. Biotechnol.*, 31, pp. 928-933 (2013); doi: 10.1038/nbt.2678; WO2014/165707, the contents of each of which are incorporated herein by reference in their entirety.

Additional Expressed Agents

In embodiments, the CAR-expressing immune effector cell described herein can express a CAR comprising a conditional expression domain, for example, as described in WO2017/181119, or a CAR comprising a degradation domain as described in WO2017/024318. In some embodiments, a conditional expression domain may be used with a single CAR (e.g., a single CAR comprising one antigen binding domain, or a single CAR comprising two or more antigen binding domains) or with multiple CARs.

In another embodiment, a CAR-expressing immune effector cell described herein can further express another agent, e.g., an agent which enhances the activity of a CAR-expressing cell. Such additional expressed agents can be introduced together with the CAR, e.g., in the same vector or template nucleic acid, or in a separate vector.

For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta, e.g., as described herein. In one embodiment, the agent that inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGF beta, or a fragment of any of these, and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28, CD27, OX40 or 4-IBB signaling domain described herein and/or a CD3 zeta signaling domain described herein). In embodiments, the agent comprises a first polypeptide of an extracellular domain of an inhibitory molecule and a second polypeptide of an intracellular signaling domain of a costimulatory molecule described herein or primary signaling molecule described herein. Such molecules in which an inhibitory molecule (e.g., a domain of an inhibitory molecule) is associated with a molecule that provides a positive signal (e.g., a domain of a costimulatory molecule or primary signaling molecule) are further described in, for example, WO2013/019615.

In one embodiment, the CAR-expressing immune effector cell described herein can further comprise a second CAR, e.g., a second CAR that includes a different antigen binding domain, e.g., to a different epitope on the same target (e.g., a target described above) or a different target. In one embodiment, the second CAR includes an antigen binding domain to a target expressed on the same cancer cell type as the target of the first CAR. In one embodiment, the CAR-expressing immune effector cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain.

While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing immune effector cell comprises a first CAR that includes an antigen binding domain that targets, e.g., a target described above, a transmembrane domain and a costimulatory domain and a second CAR that targets an antigen other than antigen targeted by the first CAR (e.g., an antigen expressed on the same cancer cell type as the first target) and includes an antigen binding domain, a transmembrane domain and a primary signaling domain. In another embodiment, the CAR expressing immune effector cell comprises a first CAR that includes an antigen binding domain that targets, e.g., a target described above, a transmembrane domain and a primary signaling domain and a second CAR that targets an antigen other than antigen targeted by the first CAR (e.g., an antigen expressed on the same cancer cell type as the first target) and includes an antigen binding domain to the antigen, a transmembrane domain and a costimulatory signaling domain.

In one embodiment, the CAR-expressing immune effector cell comprises a CAR described herein, e.g., a CAR to a target described above, and an inhibitory CAR. In one embodiment, the inhibitory CAR comprises an antigen binding domain that binds an antigen found on normal cells but not cancer cells, e.g., normal cells that also express the target. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGF beta.

In one embodiment, an immune effector cell (e.g., T cell, NK cell) comprises a first CAR comprising an antigen binding domain that binds to a tumor antigen as described herein, and a second CAR comprising a PD1 extracellular domain or a fragment thereof.

In one embodiment, the cell further comprises an inhibitory molecule as described above. Non-limiting examples of inhibitory molecules include PD-1, PD-L1, PD-L2, CTLA4, TIM3, LAG3, CEACAM (e.g., CEACAM-1, CEACAM-3 and/or CEACAM-5), VISTA, BTLA, TIGIT, LAIR1, CD160, 2B4, CD80, CD86, B7-H3 (CD276), B7-H4 (VTCN1), HVEM (TNFRSF14 or CD107), KIR, A2aR, MHC class I, MHC class II, GAL9, adenosine, and TGF beta.

In one embodiment, the second CAR in the cell is an inhibitory CAR, wherein the inhibitory CAR comprises an antigen binding domain, a transmembrane domain, and an intracellular domain of an inhibitory molecule. The inhibitory molecule can be chosen from one or more of: PD1, PD-L1, CTLA-4, TIM-3, LAG-3, VISTA, BTLA, TIGIT, LAIR1, CD160, 2B4, TGF beta, CEACAM-1, CEACAM-3, and CEACAM-5. In one embodiment, the second CAR molecule comprises the extracellular domain of PD1 or a fragment thereof.

In embodiments, the second CAR molecule in the cell further comprises an intracellular signaling domain comprising a primary signaling domain and/or an intracellular signaling domain.

In other embodiments, the intracellular signaling domain in the cell comprises a primary signaling domain comprising the functional domain of CD3 zeta and a costimulatory signaling domain comprising the functional domain of 4-1BB.

In one embodiment, the second CAR molecule in the cell comprises the amino acid sequence of SEQ ID NO: 30.

In certain embodiments, the antigen binding domain of the first CAR molecule comprises a scFv and the antigen binding domain of the second CAR molecule does not comprise a scFv. For example, the antigen binding domain of the first CAR molecule comprises a scFv and the antigen binding domain of the second CAR molecule comprises a camelid VHH domain.

In other aspects and embodiments, a cell of the disclosure, e.g., a cell engineered to express a CAR, is also engineered to express a safety molecule, such as a molecule (or set of molecules) which mediates the depleting of the cells, e.g., CAR T cells, when appropriate (e.g., after the T cells have accomplished the anti-tumor function, or if the T cells are causing life-threatening side effects). In one exemplary aspect, the safety molecule is a molecule that does not affect the function of the cell, but which can be targeted by another agent, e.g., an antibody or ADC molecule targeting said molecule. One exemplary embodiment of such a molecule is a truncated receptor, e.g., a receptor comprising the extracellular domain and transmembrane domain of a receptor, but lacking all or a substantial portion of the intracellular domain of the receptor. An example is a truncated EGFR receptor, e.g., as described in WO2011/056894. Without being bound by theory, targeting said truncated EGFR receptor with an anti-EGFR antibody, e.g., cetuximab, will deplete cells expressing the truncated EGFR receptor. A second example is a iCasp9 switch polypeptide, e.g., a polypeptide having a dimerization domain, an optional linker, and a caspase domain oriented such that, when expressed in the presence of a dimerization compound in a mammalian host cell, the iCasp9 switch polypeptide homodimerizes, resulting in apoptosis of the host cell. In embodiments, the dimerization domain is a FKBP-based dimerization domain, e.g., the sequence harbors a mutation (F37V) which provides a complementary fitting cavity for AP1903 and AP1903-structurally related ligands (such as AP20187), which molecules may act as a dimerization compound. Such iCasp9 switch polypeptides (and associated dimerization compounds) are described in, for example, WO 1997/031899, US2011/286980, WO2014/164348, WO2013/040371, US2013/071414, WO2014/255360, and *N Engl J Med.* 2011 Nov. 3; 365(18):1673-83. A third example of such a molecule is a molecule targeted by an anti-CD20 antibody, wherein, for example, administering an anti-CD20 antibody (e.g., rituximab) allows said cells to be depleted. Examples of molecules targeted by an anti-CD20 antibody include CD20, and truncated versions thereof (e.g., molecules comprising an extracellular domain recognizable by an anti-CD20 antibody, a transmembrane domain, and lacking at least a portion of an intracellular domain).

Split CAR

In some embodiments, the CAR-expressing cell uses a split CAR. The split CAR approach is described in more detail in publications WO2014/055442 and WO2014/

055657. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

Multiple CAR Expression

In one aspect, the CAR-expressing cell described herein can further comprise a second CAR (see, e.g., Additional Expressed Agents above), e.g., a second CAR that includes a different antigen binding domain, e.g., to the same target or a different target (e.g., a target other than a cancer associated antigen described herein or a different cancer associated antigen described herein). In one embodiment, the second CAR includes an antigen binding domain to a target expressed by the same cancer cell type as the cancer associated antigen targeted by the first CAR. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27 or OX-40, onto the first CAR, and the primary signaling domain, e.g. CD3 zeta, on the second CAR can limit the CAR activity to cells where both targets are expressed. In one embodiment, the CAR expressing cell comprises a first cancer associated antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In some embodiments, the CAR-expressing cell comprises a first and second CAR, wherein the antigen binding domain of one of said first CAR said second CAR does not comprise a variable light domain and a variable heavy domain. In some embodiments, the antigen binding domain of one of said first CAR said second CAR is an scFv, and the other is not an scFv. In some embodiments, the antigen binding domain of one of said first CAR said second CAR comprises a single VH domain, e.g., a camelid, shark, or lamprey single VH domain, or a single VH domain derived from a human or mouse sequence. In some embodiments, the antigen binding domain of one of said first CAR said second CAR comprises a nanobody. In some embodiments, the antigen binding domain of one of said first CAR said second CAR comprises a camelid VHH domain.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, as disclosed herein can further comprise an ectopically expressed telomerase subunit, e.g., the catalytic subunit of telomerase, e.g., TERT, e.g., hTERT. In some aspects, this disclosure provides a method of producing a CAR-expressing cell with longer persistence in a patient, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

In embodiments in which a cell is engineered to express more than one molecule, the sequence encoding each of said molecules (e.g., sequence encoding a CAR and sequence encoding an NK inhibitory molecule) can be disposed on the same nucleic acid molecule (e.g., same template nucleic acid), e.g., the same plasmid or vector, e.g., viral vector, e.g., lentiviral vector. In an embodiment, (i) sequence encoding a CAR, as described herein, and (ii) sequence encoding an NK inhibitory molecule, as described herein, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A, T2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In other aspects, each molecule may be expressed from a different promoter. In an embodiment, a first promoter is operably linked to (i) and a second promoter is operably linked to (ii), such that (i) and (ii) are transcribed as separate mRNAs.

Alternatively, the sequence encoding the more than one molecules can be disposed on the different nucleic acid molecules (e.g., different template nucleic acid molecules), e.g., different plasmids or vectors, e.g., viral vector, e.g., lentiviral vector. E.g., the (i) sequence encoding a CAR as described herein can be present on a first nucleic acid, e.g., a first vector, and the (ii) sequence encoding a NK inhibitory molecule can be present on the second nucleic acid, e.g., the second vector. In various embodiments, the sequences below may be used.

TABLE 24

Exemplary sequences of various components of CAR
(aa—amino acids, na—nucleic acids that encodes the
corresponding protein)

| SEQ ID NO | description | Sequence |
|---|---|---|
| 1 | EF-1 promoter | CGTGAGGCTCCGGTGCCCGTCAGTGGGCAGAGCGCACATCGCCCACA<br>GTCCCCGAGAAGTTGGGGGGAGGGGTCGGCAATTGAACCGGTGCCTA<br>GAGAAGGTGGCGCGGGGTAAACTGGGAAAGTGATGTCGTGTACTGG<br>CTCCGCCTTTTTCCCGAGGGTGGGGGAGAACCGTATATAAGTGCAGT<br>AGTCGCCGTGAACGTTCTTTTTCGCAACGGGTTTGCCGCCAGAACACA<br>GGTAAGTGCCGTGTGTGGTTCCCGCGGGCCTGGCCTCTTTACGGGTTA<br>TGGCCCTTGCGTGCCTTGAATTACTTCCACCTGGCTGCAGTACGTGAT<br>TCTTGATCCCGAGCTTCGGGTTGGAAGTGGGTGGGAGAGTTCGAGGC<br>CTTGCGCTTAAGGAGCCCCTTCGCCTCGTGCTTGAGTTGAGGCCTGGC<br>CTGGGCGCTGGGGCCGCCGCGTGCGAATCTGGTGGACCTTCGCGCC<br>TGTCTCGCTGCTTTCGATAAGTCTCTAGCCATTTAAAATTTTTGATGA<br>CCTGCTGCGACGCTTTTTTTCTGGCAAGATAGTCTTGTAAATGCGGGC<br>CAAGATCTGCACACTGGTATTTCGGTTTTTGGGGCCGCGGGCGGCGA<br>CGGGGCCCGTGCGTCCCAGCGCACATGTTCGGCGAGGCGGGGCCTGC<br>GAGCGCGGCCACCGAGAATCGGACGGGGGTAGTCTCAAGCTGGCCG<br>GCCTGCTCTGGTGCCTGGCCTCGCGCCGCCGTGTATCGCCCCGCCCTG<br>GGCGGCAAGGCTGGCCCGGTCGGCACCAGTTGCGTGAGCGGAAAGA<br>TGGCCGCTTCCCGGCCCTGCTGCAGGGAGCTCAAAATGGAGGACGCG<br>GCGCTCGGGAGAGCGGGCGGGTGAGTCACCCACACAAAGGAAAAGG<br>GCCTTTCCGTCCTCAGCCGTCGCTTCATGTGACTCCACGGAGTACCGG<br>GCGCCGTCCAGGCACCTCGATTAGTTCTCGAGCTTTTGGAGTACGTCG<br>TCTTTAGGTTGGGGGGAGGGGTTTTATGCGATGGAGTTTCCCCACACT<br>GAGTGGGTGGAGACTGAAGTTAGGCCAGCTTGGCACTTGATGTAATT<br>CTCCTTGGAATTTGCCCTTTTTGAGTTTGGATCTTGGTTCATTCTCAAG<br>CCTCAGACAGTGGTTCAAAGTTTTTTTCTTCCATTTCAGGTGTCGTGA |
| 2 | Leader (aa) | MALPVTALLLPLALLLHAARP |
| 3 | Leader (na) | ATGGCCCTGCCTGTGACAGCCCTGCTGCTGCCTCTGGCTCTGCTGCTG<br>CATGCCGCTAGACCC |
| 4 | Leader (na) | ATGGCCCTCCCTGTCACCGCCCTGCTGCTTCCGCTGGCTCTTCTGCTCC<br>ACGCCGCTCGGCCC |
| 5 | CD 8 hinge (aa) | TTTPAPRPPTPAPTIASQPLSLRPEACRPAAGGAVHTRGLDFACD |
| 6 | CD8 hinge (na) | ACCACGACGCCAGCGCCGCGACCACCAACACCGGCGCCCACCATCGC<br>GTCGCAGCCCCTGTCCCTGCGCCCAGAGGCGTGCCGGCCAGCGGCGG<br>GGGGCGCAGTGCACACGAGGGGGCTGGACTTCGCCTGTGAT |
| 7 | Ig4 hinge (aa) | ESKYGPPCPPCPAPEFLGGPSVFLFPPKPKDTLMISRTPEVTCVVVDVSQE<br>DPEVQFNWYVDGVEVHNAKTKPREEQFNSTYRVVSVLTVLHQDWLNG<br>KEYKCKVSNKGLPSSIEKTISKAKGQPREPQVYTLPPSQEEMTKNQVSLT<br>CLVKGFYPSDIAVEWESNGQPENNYKTTPPVLDSDGSFFLYSRLTVDKSR<br>WQEGNVFSCSVMHEALHNHYTQKSLSLSLGKM |
| 8 | Ig4 hinge (na) | GAGAGCAAGTACGGCCCTCCCTGCCCCCCTTGCCCTGCCCCCGAGTTC<br>CTGGGCGGACCCAGCGTGTTCCTGTTCCCCCCCAAGCCCAAGGACAC<br>CCTGATGATCAGCCGGACCCCCGAGGTGACCTGTGTGGTGGTGGACG<br>TGTCCCAGGAGGACCCCGAGGTCCAGTTCAACTGGTACGTGGACGGC<br>GTGGAGGTGCACAACGCCAAGACCAAGCCCCGGGAGGAGCAGTTCA<br>ATAGCACCTACCGGGTGGTGTCCGTGCTGACCGTGCTGCACCAGGAC<br>TGGCTGAACGGCAAGGAATACAAGTGTAAGGTGTCCAACAAGGGCCT<br>GCCCAGCAGCATCGAGAAAACCATCAGCAAGGCCAAGGGCCAGCCT<br>CGGGAGCCCCAGGTGTACACCCTGCCCCCTAGCCAAGAGGAGATGAC<br>CAAGAACCAGGTGTCCCTGACCTGCCTGGTGAAGGGCTTCTACCCCA<br>GCGACATCGCCGTGGAGTGGGAGAGCAACGGCCAGCCCGAGAACAA<br>CTACAAGACCACCCCCCCTGTGCTGGACAGCGACGGCAGCTTCTTCCT<br>GTACAGCCGGCTGACCGTGGACAAGAGCCGGTGGCAGGAGGGCAAC<br>GTCTTTAGCTGCTCCGTGATGCACGAGGCCCTGCACAACCACTACACC<br>CAGAAGAGCCTGAGCCTGTCCCTGGGCAAGATG |
| 9 | IgD hinge (aa) | RWPESPKAQASSVPTAQPQAEGSLAKATTAPATTRNTGRGGEEKKKEKE<br>KEEQEERETKTPECPSHTQPLGVYLLTPAVQDLWLRDKATFTCFVVGSD<br>LKDAHLTWEVAGKVPTGGVEEGLLERHSNGSQSQHSRLTLPRSLWNAG<br>TSVTCTLNHPSLPPQRLMALREPAAQAPVKLSLNLLASSDPPEAASWLLC<br>EVSGFSPPNILLMWLEDQREVNTSGFAPARPPPQPGSTTFWAWSVLRVP<br>APPSPQPATYTCVVSHEDSRTLLNASRSLEVSYVTDH |

TABLE 24-continued

Exemplary sequences of various components of CAR
(aa—amino acids, na—nucleic acids that encodes the
corresponding protein)

| SEQ ID NO | description | Sequence |
|---|---|---|
| 10 | IgD hinge (na) | AGGTGGCCCGAAAGTCCCAAGGCCCAGGCATCTAGTGTTCCTACTGC<br>ACAGCCCCAGGCAGAAGGCAGCCTAGCCAAAGCTACTACTGCACCTG<br>CCACTACGCGCAATACTGGCCGTGGCGGGGAGGAGAAGAAAAAGGA<br>GAAAGAGAAAGAAGAACAGGAAGAGAGGGAGACCAAGACCCCTGA<br>ATGTCCATCCCATACCCAGCCGCTGGGCGTCTATCTCTTGACTCCCGC<br>AGTACAGGACTTGTGGCTTAGAGATAAGGCCACCTTTACATGTTTCGT<br>CGTGGGCTCTGACCTGAAGGATGCCCATTTGACTTGGGAGGTTGCCG<br>GAAAGGTACCCACAGGGGGGGTTGAGGAAGGGTTGCTGGAGCGCCA<br>TTCCAATGGCTCTCAGAGCCAGCACTCAAGACTCACCCTTCCGAGATC<br>CCTGTGGAACGCCGGGACCTCTGTCACATGTACTCTAAATCATCCTAG<br>CCTGCCCCCACAGCGTCTGATGGCCCTTAGAGAGCCAGCCGCCCAGG<br>CACCAGTTAAGCTTAGCCTGAATCTGCTCGCCAGTAGTGATCCCCCAG<br>AGGCCGCCAGCTGGCTCTTATGCGAAGTGTCCGGCTTTAGCCCGCCC<br>AACATCTTGCTCATGTGGCTGGAGGACCAGCGAGAAGTGAACACCAG<br>CGGCTTCGCTCCAGCCCGGCCCCCACCCCAGCCGGGTTCTACCACATT<br>CTGGGCCTGGAGTGTCTTAAGGGTCCCAGCACCACCTAGCCCCCAGC<br>CAGCCACATACACCTGTGTTGTGTCCCATGAAGATAGCAGGACCCTG<br>CTAAATGCTTCTAGGAGTCTGGAGGTTTCCTACGTGACTGACCATT |
| 11 | GS hinge/linker (aa) | GGGGSGGGGS |
| 12 | GS hinge/linker (na) | GGTGGCGGAGGTTCTGGAGGTGGAGGTTCC |
| 13 | CD8TM (aa) | IYIWAPLAGTCGVLLLSLVITLYC |
| 14 | CD8 TM (na) | ATCTACATCTGGGCGCCCTTGGCCGGGACTTGTGGGGTCCTTCTCCTG<br>TCACTGGTTATCACCCTTTACTGC |
| 15 | CD8 TM (na) | ATCTACATTTGGGCCCCTCTGGCTGGTACTTGCGGGGTCCTGCTGCTT<br>TCACTCGTGATCACTCTTTACTGT |
| 16 | 4-1BB intracellular domain (aa) | KRGRKKLLYIFKQPFMRPVQTTQEEDGCSCRFPEEEEGGCEL |
| 17 | 4-1BB intracellular domain (na) | AAACGGGGCAGAAAGAAACTCCTGTATATATTCAAACAACCATTTAT<br>GAGACCAGTACAAACTACTCAAGAGGAAGATGGCTGTAGCTGCCGAT<br>TTCCAGAAGAAGAAGAAGGAGGATGTGAACTG |
| 18 | 4-1BB intracellular domain (na) | AAGCGCGGTCGGAAGAAGCTGCTGTACATCTTTAAGCAACCCTTCAT<br>GAGGCCTGTGCAGACTACTCAAGAGGAGGACGGCTGTTCATGCCGGT<br>TCCCAGAGGAGGAGGAAGGCGGCTGCGAACTG |
| 19 | CD27 (aa) | QRRKYRSNKGESPVEPAEPCRYSCPREEEGSTIPIQEDYRKPEPACSP |
| 20 | CD27 (na) | AGGAGTAAGAGGAGCAGGCTCCTGCACAGTGACTACATGAACATGA<br>CTCCCCGCCGCCCCGGGCCCACCCGCAAGCATTACCAGCCCTATGCC<br>CCACCACGCGACTTCGCAGCCTATCGCTCC |
| 21 | CD3-zeta (aa) | RVKFSRSADAPAYKQGQNQLYNELNLGRREEYDVLDKRRGRDPEMGG<br>KPRRKNPQEGLYNELQKDKMAEAYSEIGMKGERRRGKGHDGLYQGLST<br>ATKDTYDALHMQALPPR |
| 22 | CD3-zeta (na) | AGAGTGAAGTTCAGCAGGAGCGCAGACGCCCCCGCGTACAAGCAGG<br>GCCAGAACCAGCTCTATAACGAGCTCAATCTAGGACGAAGAGAGGA<br>GTACGATGTTTTGGACAAGAGACGTGGCCGGGACCCTGAGATGGGGG<br>GAAAGCCGAGAAGGAAGAACCCTCAGGAAGGCCTGTACAATGAACT<br>GCAGAAAGATAAGATGGCGGAGGCCTACAGTGAGATTGGGATGAAA<br>GGCGAGCGCCGGAGGGGCAAGGGGCACGATGGCCTTTACCAGGGTC<br>TCAGTACAGCCACCAAGGACACCTACGACGCCCTTCACATGCAGGCC<br>CTGCCCCCTCGC |
| 23 | CD3-zeta (na) | CGCGTGAAATTCAGCCGCAGCGCAGATGCTCCAGCCTACAAGCAGGG<br>GCAGAACCAGCTCTACAACGAACTCAATCTTGGTCGGAGAGAGGAGT<br>ACGACGTGCTGGACAAGCGGAGAGGACGGGACCCAGAAATGGGCGG<br>GAAGCCGCGCAGAAAGAATCCCCAAGAGGGCCTGTACAACGAGCTC<br>CAAAAGGATAAGATGGCAGAAGCCTATAGCGAGATTGGTATGAAAG |

TABLE 24-continued

Exemplary sequences of various components of CAR
(aa—amino acids, na—nucleic acids that encodes the
corresponding protein)

| SEQ ID NO | description | Sequence |
|---|---|---|
| | | GGGAACGCAGAAGAGGCAAAGGCCACGACGGACTGTACCAGGGACT CAGCACCGCCACCAAGGACACCTATGACGCTCTTCACATGCAGGCCC TGCCGCCTCGG |
| 24 | CD3-zeta (aa) | RVKFSRSADAPAYQQGQNQLYNELNLGRREEYDVLDKRRGRDPEMGG KPRRKNPQEGLYNELQKDKMAEAYSEIGMKGERRRGKGHDGLYQGLST ATKDTYDALHMQALPPR |
| 25 | CD3-zeta (na) | AGAGTGAAGTTCAGCAGGAGCGCAGACGCCCCCGCGTACCAGCAGG GCCAG AACCAGCTCTATAACGAGCTCAATCTAGGACGAAGAGAGGAGTACG ATGTTT TGGACAAGAGACGTGGCCGGGACCCTGAGATGGGGGGAAAGCCGAG AAGGA AGAACCCTCAGGAAGGCCTGTACAATGAACTGCAGAAAGATAAGAT GGCGG AGGCCTACAGTGAGATTGGGATGAAAGGCGAGCGCCGGAGGGGCAA GGGGC ACGATGGCCTTTACCAGGGTCTCAGTACAGCCACCAAGGACACCTAC GACGC CCTTCACATGCAGGCCCTGCCCCCTCGC |
| 26 | linker | GGGGS |
| 28 | PD-1 extracellular domain (aa) | Pgwfldspdrpwnpptfspallyytegdnatftcsfsntsesfylnwyrmspsnqtdklaafpedrsqpgqdcr frvtqlpngrdfhmsvvrarrndsgtylcgaislapkaqikeslraelrvterraevptahspspsrpagqfqtly |
| 29 | PD-1 extracellular domain (na) | Cccggatggtttctggactctccggatcgcccgtggaatcccccaaccttctcaccggcactcttggttgtgactga gggcgataatgcgaccttcacgtgctcgttctcaacacctccgaatcattcgtgctgaactggtaccgcatgagcc cgtcaaaccagaccgacaagctcgccgcgtttccggaagatcggtcgcaacgggacaggattgtcggttccgc gtgactcaactgccgaatggcagagacttccacatgagcgtggtccgcgctaggcgaaacgactccgggacctac ctgtgcggagccatctcgctggcgcctaaggcccaaatcaaagagagcttgagggccgaactgagagtgaccga gcgcagagctgaggtgccaactgcacatccatcccatcgcctcggcctgcggggcagtttcagaccctggtc |
| 30 | PD-1 CAR (aa) with signal | Malpvtalllplalllhaarppgwfldspdrpwnpptfspallwtegdnatftcsfsntsesfylnwyrmspsnq tdklaafpedrsqpgqdcrfrvtqlpngrdfhmswrarrndsgtylcgaislapkaqikeslraelryterraevp tahspspsrpagqfqtlyttttpaprpptpaptiasqp1s1rpeacrpaaggayhtrgldfacdiyiwaplagtcgyll lslvitlyckrgrkkllyifkoftiirpvqttqeedgcscrfpeeeeggcelrykfsradapaykqgqnqlyneln lgrreeydvldkrrgrdpemggkprrknpqeglynelqkdkmaeaysegimkgerrgkghdglyqglstat kdtydalhmqalppr |
| 31 | PD-1 CAR (na) | Atggccctccctgtcactgccctgcttctcccctcgcactcctgctccacgccgctagaccaccggatggtttct ggactctccggatcgcccgtggaatcccccaaccttctcaccggcactcttggttgtgactgagggcgataatgcga ccttcacgtgctcgttctccaacacctccgaatcattcgtgctgaactggtaccgcatgagcccgtcaaaccagacc gacaagctcgccgcgtttccggaagatcggtcgcaaccgggacaggattgtcggttccgcgtgactcaactgccg aatggcagagacttccacatgagcgtggtccgcgctaggcgaaacgactccgggacctacctgtgcggagccat ctcgctggcgcctaaggcccaaatcaaagagagcttgagggccgaactgagagtgaccgagcgcagagctgag gtgccaactgcacatccatcccatcgcctcggcctgcggggcagtttcagaccctggtcacgaccactccggcg ccgcgccaccgactccgccccaactatcgcgagccagcccctgtcgctgaggccggaagcatgccgccctg ccgccggaggtgctgtgcataccggggattggacttcgcatgcgacatctacatttgggctcctctcgccggaact tgtggcgtgctccttctgtccctggtcatcaccctgtactgcaagcgggtcggaaaaagcttctgtacattttcaagc agccctccatgaggcccgtgcaaaccaccccaggaggaggacggttgctcctgccggttccccgaagaggaagaa ggaggttgcgagctcgcgtgaagttctcccggagcgccgacgcccccgcctataagcagggcagaaccagc tgtacaacgaactgaacctggacggcgggaagagtacgatgtgctggacaagggcgcggccgggacccccg aaatgggcgggaagcctagaagaaagaaccctcaggaaggcctgtataacgagctgcagaaggacaagatggc cgaggcctactccgaaattgggatgaaggagagcggcggagggaaagggcacgacggcctgtaccaagg actgtccaccgccaccaaggacacatacgatgccctgcacatgcaggccctccccctcgc |
| 32 | linker | (Gly-Gly-Gly-Ser)n, where n = 1-10 |
| 33 | linker | (Gly-Gly-Gly-Gly-Ser)n, where n = 1-10 |
| 34 | linker | (Gly4 Ser)4 |
| 35 | linker | (Gly4 Ser)3 |
| 36 | linker | (Gly3 Ser) |

TABLE 24-continued

Exemplary sequences of various components of CAR
(aa—amino acids, na—nucleic acids that encodes the
corresponding protein)

| SEQ ID NO | description | Sequence |
|---|---|---|
| 37 | PD1 CAR (aa) | Pqwfldspdrpwnpptfspallvvteqdnatftcsfsntsesfvlnwyrmspsnqtdklaafpedrsqpqqdcr frvtqlpngrdfhmsvvrarrndsqtylcqaislapkaqikeslraelrvterraevptahpspsprpaqqfqtlvtt tpaprpptpaptiasqplslrpeacrpaaggavhtrgldfacdiyiwaplagtcgvlllslvitlyckrgrkkllyifk qpfmrpvqttqeedgcscrfpeeeeggcelrvkfsrsadapaykgqnqlynelnlgrreeydvldkrrgrdpe mggkprrknpqeglynelqkdkmaeayseigmkgerrrgkghdglyqglstatkdtydalhmqalppr |
| 38 | linker | GSTSGSGKPGSGEGSTKG |

VI. Cells

In various embodiments, provided herein are cells, e.g., T or NK cells, e.g., autologous or allogeneic T cells. In some embodiments, the cell expresses at least one CAR as described herein. In some embodiments, the at least one CAR is BCMA. In some embodiments, the at least one CAR is CD19. In some embodiments, the CAR is encoded and expressed from a genomic insertion at or near the TET2 gene in the cell, e.g., at or near an intron or intron-exon junction, e.g., the intron between exons 9 and 10 of TET2. In some embodiments, the cell expresses at least one CAR and has reduced, disrupted, or eliminated expression of at least one gene that regulates MHC I expression, e.g., MHC I HLA-A, HLA-B, HLA-C, B2M, NLRC5, and/or MHC II expression, e.g., MHC II HLA-DM, HLA-DO, HLA-DR, HLA-DQ, HLA-DP, CIITA, RFXANK, RFXAP, RFX1, RFX5, NF-YA, NF-YB, NF-YC, X2BP, OCAB. In some embodiments, the cell is generated using a CRISPR system as described herein. Other methods for generating said cells may also be used.

In an aspect, the disclosure provides for cells comprising a gene editing system, e.g., a CRISPR system, described herein. In an aspect, the disclosure provides for cells modified by a gene editing system, e.g., a CRISPR system, described herein.

In another aspect, the disclosure provides cells which comprise, or which at any time comprised, a gRNA molecule, e.g., one or more gRNA molecules, as described herein, or a CRISPR system as described herein. In an embodiment, the cell has been altered, e.g., the target sequence targeted by the gRNA molecule has been altered, e.g., to create an indel, by introduction of a gRNA molecule as described herein (or nucleic acid encoding said gRNA molecule), or a CRISPR system (or nucleic acid encoding one or more components of said CRISPR system) as described herein, e.g., altered by a method described herein. In an embodiment, the alteration results in a change in transcription or translation of the functional (e.g., wild type) gene product of the gene comprising the target site. In an embodiment, the alteration results in reduced or no expression of the functional (e.g., wild type) gene product of the gene comprising the target site. In embodiments, the alteration is insertion of heterologous nucleic acid sequence, e.g., from a template nucleic acid (e.g., as described herein), e.g., sequence encoding a CAR (e.g., as described herein). In embodiments, the alteration results in reduced or no expression of the functional (e.g., wild type) gene product of the gene comprising the target site and insertion of heterologous nucleic acid sequence, e.g., from a template nucleic acid at the same target site. In embodiments, the alteration results in reduced or no expression of the functional (e.g., wild type) gene product of the gene comprising the target site and insertion of heterologous nucleic acid sequence, e.g., from a template nucleic acid at a different target site.

In one aspect, the cell is an animal cell. In embodiments, the cell is a mammalian, primate, or human cell. In embodiments, the cell is a human cell. In embodiments, the cell is an immune effector cell (e.g., a population of immune effector cells), for example a T cell or NK cell. In embodiments, the T cell (e.g., population of T cells) is or comprises a CD4+ T cell, a CD8+ T cell, or a combination thereof. In embodiments, the cell is autologous. In embodiments, the cell is allogeneic.

In a preferred embodiment the cell (or the population of cells) has been, or will be, engineered to express a chimeric antigen receptor (CAR), e.g., a CAR as described in Section V. In embodiments, the cell is engineered to express a BCMA CAR, e.g., as described herein. In embodiments, the CAR-engineered cell is allogeneic. In embodiments, the CAR-engineered cell is autologous. In embodiments, the sequence encoding the CAR is stably integrated into the genome of the cell within a TET2 intron, e.g., at or near a target sequence of a gRNA molecule described herein. In embodiments, the nucleic acid sequence integrated into said site does not comprise sequence of a lentivirus vector (e.g., does not comprise a cPPT or CPT element).

In another aspect, the disclosure provides cells, such as those described above, which include, has at any time included, or will include a second gRNA molecule as described herein, e.g., a second gRNA molecule with a targeting domain different from that of the first gRNA molecule. In embodiments, the two gRNA molecules are complementary to target sites within the same TET2 intron. In other embodiments, the two or more gRNA molecules are complementary to target sequences in different genes. In embodiments, at least one of said gRNA molecules comprises a targeting domain complementary to a TET2 intron sequence, e.g., as described herein. In embodiments, the one or more other gRNA molecules target sequences within an inhibitory molecule gene (e.g., PDCD1), an allogeneic T cell target (e.g., B2M, CIITA, RFXANK, RFXAP, RFX1, RFX5, or a component of the T cell receptor, e.g., TRAC, TRBC, CD3E, CD3D, or CD3G, or combinations thereof).

It will be understood that in any of the disclosed aspects and embodiments in which two or more target sites of different genes (or different molecular complexes, e.g., when targeting a TET2 intron, a component of the T cell receptor, and B2M) are targeted, that for any or all of the different gene (or molecular complex) targets, two or more gRNAs may be employed with respect to one or more of said different genes or different molecular complexes.

Additionally or alternatively, when gRNA molecules targeting more than one gene are employed, they may be employed for different means. For example, one may utilize a gRNA molecule to a TET2 intron in conjunction with a template nucleic acid to insert heterologous nucleic acid sequence at or near the target sequence within the TET2 intron. At the same time, one may further utilize one or more additional gRNA molecules to one or more additional targets, e.g., to a component of the T cell receptor (e.g., TRAC), B2M and/or CIITA, to reduce or eliminate expression and/or function of said one or more genes. These additional gRNA molecules may be utilized at the same time, subsequently, or prior to the first gRNA molecule.

In some embodiments, the two or more, e.g. two, gRNA molecules are complementary to target sites within different genes. Such cells may comprise alterations, e.g., indels, at or near each target site such that expression of the functional gene product of more than one gene is reduced or eliminated. As discussed above, in such embodiments, more than one gRNA molecule targeted to each of the different genes may be employed.

In embodiments, the cell comprises, has comprised or will comprise a first gRNA molecule comprising a targeting domain complementary with a target sequence of a TET2 intron or intron-exon junction (e.g., a targeting domain described in Tables 1, or 2). The cell may also comprise, or at any time has comprised or will comprise, a second gRNA molecule comprising a targeting domain complementary with a target sequence of an inhibitory molecule and/or a third gRNA molecule comprising a targeting domain complementary to a target sequence of TRAC, TRBC1, TRBC2, CD247, CD3D, CD3E, or CD3G, and/or a fourth gRNA molecule comprising a targeting domain complementary with a target sequence of B2M, NLRC5, HLA-A, HLA-B or HLA-C, and/or a $5^{th}$ gRNA molecule comprising a targeting domain complementary with a target sequence of CIITA. In embodiments the cell comprises heterologous nucleic acid sequence, e.g., sequence encoding a CAR, e.g., as described herein, integrated at or near a site targeted by the gRNA molecule to TET2, and optionally, has reduced or eliminated expression of one or more genes, e.g., one or more genes targeted by the second, third, fourth and/or fifth gRNA molecules.

In embodiments, a cell, e.g., a CAR-expressing cell as described herein, may comprises one or more modifications (e.g., heterologous nucleic acid sequence insertion, or nucleotide insertions or deletions) to an intron of TET2; one or more modifications (e.g., nucleotide insertions or deletions) to an endogenous gene encoding a component of the T cell receptor (e.g., TRAC or TRBC); one or more modifications (e.g., nucleotide insertions or deletions) to an endogenous B2M gene; and/or one or more modifications (e.g., nucleotide insertions or deletions) to an endogenous CIITA gene. In embodiments, one or more of said modifications reduce or eliminate expression of said gene. In embodiments, the disclosure provides a cell, e.g., a CAR-expressing cell, e.g., as described herein, with a modification to a TET2 intron that is further TCR- (e.g., has a level of expression of TCR greater than 50%, 60%, 70%, 80%, 90%, 95%, 96%, 97%, 98%, or 99% lower than that of an unmodified cell of the same type, as detected by FACS, e.g., FACS using an anti-CD3 antibody), B2M- (e.g., has a level of expression of B2M and/or one or more MHC class I proteins greater than 50%, 60%, 70%, 80%, 90%, 95%, 96%, 97%, 98%, or 99% lower than that of an unmodified cell of the same type, as detected by FACS, e.g., FACS using an anti-B2M antibody) and/or CIITA- (e.g., has a level of expression of CIITA and/or a MHC class II protein greater than 50%, 60%, 70%, 80%, 90%, 95%, 96%, 97%, 98%, or 99% lower than that of an unmodified cell of the same type, as detected by FACS, e.g., FACS using an anti-CIITA antibody). In an embodiment, the cell is engineered to express a CAR molecule, e.g., as described herein. In embodiments, the CAR is a CD19 CAR, e.g., as described herein. In other embodiments, the CAR is a BCMA CAR, e.g., as described herein. In other embodiments, the CAR is a CD123 CAR, e.g., as described herein.

In an aspect, a cell of the disclosure comprises (or a population of cells comprises one or more cells which comprise):

(a) Nucleic acid sequence encoding a CAR, e.g., a template nucleic acid comprising sequence encoding a CAR, e.g., as described herein, e.g., wherein said nucleic acid sequence encoding the CAR is (or becomes) integrated into the genome at a site at or near the target sequence of a TET2 intron gRNA molecule described herein (e.g., a gRNA molecule comprising a targeting domain of Table 1 or Table 2);

Wherein the cell (or population of cells comprises one or more cells which) expresses the CAR. In embodiments, the nucleic acid sequence encoding the CAR is integrated in only one allele of the target sequence. In embodiments, one or more functions of TET2 is reduced or eliminated in said cell. In embodiments, one or more functions of TET2 is reduced, e.g., reduced by 10%, 20%, 30%, 40%, 50%, 60% or more, but not eliminated.

In an aspect, a cell of the disclosure comprises (e.g., a population of cells of the disclosure comprises one or more cells which comprise):

(b) Nucleic acid sequence encoding a CAR, e.g., a template nucleic acid comprising sequence encoding a CAR, e.g., as described herein, e.g., wherein said nucleic acid sequence encoding the CAR is (or becomes) integrated into the genome at a site at or near the target sequence of a TET2 intron gRNA molecule described herein (e.g., a gRNA molecule comprising a targeting domain of Table 1 or Table 2);

(c) An indel at or near a sequence of a gene encoding a component of a TCR (e.g., TRAC, TRBC1 or TRBC2, e.g. TRAC) or its regulatory elements, e.g., an indel at or near a target sequence of a gRNA comprising a targeting domain to a component of a TCR (e.g., TRAC, TRBC1 or TRBC2, e.g. TRAC);

(d) An indel at or near a sequence of the gene encoding B2M or its regulatory elements, e.g., an indel at or near a target sequence of a gRNA comprising a targeting domain to B2M; and Optionally, an indel at or near a sequence of the gene encoding CIITA or its regulatory elements, e.g., an indel at or near a target sequence of a gRNA comprising a targeting domain to CIITA; wherein the cell (or population of cells comprises one or more cells which) expresses the CAR, and exhibits reduced or eliminated expression and/or function of one or more of: i) a component of a TCR (e.g., TRAC, TRBC1 or TRBC2, e.g. TRAC), ii) B2M, and/or iii) CIITA In any of the aforementioned embodiments and aspects the cell comprises one or more CRISPR systems, e.g., as described herein, comprising the gRNA molecule(s) indicated. In embodiments, the cell comprises one or more ribonuclear protein (RNP) complexes each comprising a Cas9 molecule, e.g., as described herein, and a gRNA molecule comprising the indicated targeting domain, e.g., as described herein. In embodiments, including in any of the methods described herein, where gRNAs to more than one target sequence are employed, the gRNAs (and CRISPR systems comprising said gRNAs) may be introduced into the cell simultaneously. In other embodiments, including in any of the methods described herein, where gRNAs to more than one target sequence are employed, the gRNAs (and CRISPR systems comprising said gRNAs) may be introduced into the cell sequentially.

In an aspect involving any of the aforementioned embodiments or aspects, the population of cells comprises at least 20%, e.g., at least 30%, at least 40%, at least 50%, at least 60%, at least 70%, at least 80%, at least 90%, at least 95%, or at least 99%, of cells which include an insertion of nucleic acid sequence encoding the CAR at or near the target sequence of a gRNA targeting a TET2 intron or intron-exon junction (as described herein), e.g., include an insertion of nucleic acid sequence encoding the CAR at or near the target sequence of a gRNA targeting a TET2 intron or intron-exon junction (as described herein) at only one allele. In an aspect involving any of the aforementioned embodiments or aspects, the population of cells comprises at least 20%, e.g., at least 30%, at least 40%, at least 50%, at least 60%, at least 70%, at least 80%, at least 90%, at least 95%, or at least 99%, of cells which include an indel at or near each of the target sequences targeted by each of the gRNA molecules. Said population may be obtained, for example, by utilizing high efficiency gRNA molecules (e.g., gRNA molecules which cause an indel in >85% of said cells which are exposed to said gRNA molecule), or by enriching the population for the desired cell, e.g., by selecting for the desired cell population, e.g., by affinity chromatography or cell sorting.

VII. Template Nucleic Acids (For Modification of Nucleic Acid Sequence)

In an aspect, the disclosure provides for insertion of nucleic acid sequence, e.g., nucleic acid sequence from a template nucleic acid, at or near a target sequence recognized by a CRISPR system, e.g., a CRISPR system comprising a gRNA molecule to a tet2 intron, e.g., to the intron between exon 9 and exon 10 of the tet2 gene, e.g., described herein. In an embodiment, nucleic acid sequence at or near the target sequence is modified to have some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA.

In embodiments, the template nucleic acid comprises sequence encoding a first heterologous protein, for example, a chimeric antigen receptor (CAR), e.g., a CAR as described above in section V. In some embodiments, the template nucleic acid further comprises another nucleic acid sequence encoding a second heterologous protein. In some embodiments, the sequence encoding the first heterologous protein and the sequence encoding the second heterologous protein are transcribed as a single transcript. In embodiments, two (or more) proteins of interest may be separated from each other by inclusion of an intervening cleavage site, such as a 2A cleavage site. In other embodiments, the template nucleic acid includes an internal ribosomal entry site (IRES), such that the two (or more) proteins are produced as separate proteins from the same mRNA. Examples of 2A cleavage sites that can be used as described herein are shown below:

2A Peptide: Amino acid sequence*

T2A:
(SEQ ID NO: 130)
(GSG) E G R G S L L T C G D V E E N P G P

P2A:
(SEQ ID NO: 131)
(GSG) A T N F S L L K Q A G D V E E N P G P

E2A:
(SEQ ID NO: 132)
(GSG) Q C T N Y A L L K L A G D V E S N P G P

F2A:
(SEQ ID NO: 133)
(GSG) V K Q T L N F D L L K L A G D V E S N P G P (GSG) sequence is optional, and can be added to the 5' end of the 2A sequence to improve cleavage in some contexts.

In an embodiment, the template nucleic acid alters the structure of the target position by participating in an insertion event, e.g., a homology directed repair event. In an embodiment, the template nucleic acid alters the sequence of the target position, for example by insertion of part or all of the template nucleic acid sequence at or near the target sequence. In an embodiment, the template nucleic acid results in the incorporation of a modified or non-naturally occurring base at or near the target sequence.

Mutations in a gene or pathway described herein may be corrected using one of the approaches discussed herein. In an embodiment, a mutation in a gene or pathway described herein is corrected by homology directed repair (HDR) using a template nucleic acid. In an embodiment, a mutation in a gene or pathway described herein is corrected by homologous recombination (HR) using a template nucleic acid. In an embodiment, a mutation in a gene or pathway described herein is corrected by Non-Homologous End Joining (NHEJ) repair using a template nucleic acid. In other embodiments, nucleic acid encoding molecules of interest may be inserted at or near a site modified by a CRISPR system of the present disclosure. In an embodiment, the nucleic acid inserted encodes a chimeric antigen receptor as described herein. In embodiments, the template nucleic acid comprises regulatory elements, e.g., one or more promotors and/or enhancers, operably linked to the nucleic acid sequence encoding a molecule of interest, e.g., a chimeric antigen receptor, e.g., as described herein.

HDR Repair and/or Insertion, and Template Nucleic Acids

As described herein, nuclease-induced homology directed repair (HDR) can be used to alter a target sequence (e.g., insert heterologous nucleic acid, e.g., insert nucleic acid encoding a heterologous protein) and/or correct (e.g., repair or edit) a mutation in the genome. While not wishing to be bound by theory, it is believed that alteration of the target sequence occurs by homology-directed repair (HDR) with a donor template or template nucleic acid. For example, the donor template or the template nucleic acid provides for alteration of the target sequence. It is contemplated that a plasmid donor can be used as a template for homologous recombination. It is contemplated that a vector can be used as a template nucleic acid, or can provide the template nucleic acid to a cell of interest. Exemplary vectors include lentiviral vectors, mRNA, adenoviral vectors, adenoassociated viral vectors (AAV), minicircles, and nanoplasmids. In an embodiment, the template nucleic acid is delivered by a recombinant AAV. In some embodiments, the AAV does not incorporate its genome into that of a host cell, e.g., a target cell, e.g., an immune effector cell, e.g., a T cell, e.g., as describe herein. In some embodiments, the AAV can incorporate its genome into that of the host cell. In some embodiments, the AAV is a self-complementary adenoassociated virus (scAAV), e.g., a scAAV that packages both strands which anneal together to form double stranded DNA. In an embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV rh32/33, AAV.rh43, AAV.rh64R1, or AAV7m8. In an embodiment, the template nucleic acid is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV. rh64R1. In an embodiment, the template nucleic acid is delivered by a chimeric AAV capsid. Exemplary chimeric AAV capsids include, but are not limited to, AAV9i1, AAV2i8, AAV-DJ, AAV2G9, AAV2i8G9, or AAV8G9. In a preferred embodiment, the vector is an AAV6 vector or reengineered AAV6 vector. It is further contemplated that a single stranded donor template can be used as a template for alteration of the target sequence by alternate methods of homology directed repair (e.g., single strand annealing) between the target sequence and the template nucleic acid. Template nucleic acid-effected alteration of a target sequence depends on cleavage by a Cas9 molecule. Cleavage by Cas9 can comprise a double strand break or two single strand breaks.

In an embodiment, a mutation can be corrected or nucleic acid sequence inserted by either a single double-strand break or two single strand breaks. In an embodiment, a mutation can be corrected or nucleic acid sequence inserted by (1) a single double-strand break, (2) two single strand breaks, (3) two double stranded breaks with a break occurring on each side of the target sequence, (4) one double stranded breaks and two single strand breaks with the double strand break and two single strand breaks occurring on each side of the target sequence or (5) four single stranded breaks with a pair of single stranded breaks occurring on each side of the target sequence.

Double Strand Break Mediated Correction or Insertion

In an embodiment, double strand cleavage is effected by a Cas9 molecule having the ability to cleave both strands of DNA, for example, having cleavage activity associated with an HNH-like domain and cleavage activity associated with a RuvC-like domain, e.g., an N-terminal RuvC-like domain, e.g., a wild type Cas9. Such embodiments require only a single gRNA.

Single Strand Break Mediated Correction or Insertion

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA).

In an embodiment, in which a nickase and two gRNAs are used to position two single strand nicks, one nick is on the + strand and one nick is on the − strand of the target nucleic acid. The PAMs are outwardly facing. The gRNAs can be selected such that the gRNAs are separated by, from about 0-50, 0-100, or 0-200 nucleotides. In an embodiment, there is no overlap between the target sequence that is complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran el al., CELL 2013).

In an embodiment, a single nick can be used to induce HDR. It is contemplated herein that a single nick can be used to increase the ratio of HDR, HR or NHEJ at a given cleavage site.

Placement of the Double Strand Break or a Single Strand Break Relative to Target Position The double strand break or single strand break in one of the strands should be sufficiently close to target position such that correction or insertion occurs at or near said target position. In an embodiment, the distance is not more than 50, 100, 200, 300, 350 or 400 nucleotides. While not wishing to be bound by theory, it is believed that the break should be sufficiently close to target position such that the break is within the region that is subject to exonuclease-mediated removal during end resection. If the distance between the target position and a break is too great, the mutation may not be included in the end resection and, therefore, may not be corrected, as donor sequence may only be used to correct sequence within the end resection region. For insertion, the distance between the target position (i.e., the position where the heterologous sequence is desired to be inserted) and the break should also be sufficiently close.

In an embodiment, in which a gRNA (e.g., sgRNA or dgRNA) and Cas9 nuclease induce a double strand break for the purpose of inducing HDR- or HR-mediated correction or insertion, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In an embodiment, in which two gRNAs (independently, unimolecular (or chimeric) or modular gRNA) complexing with Cas9 nickases induce two single strand breaks for the purpose of inducing HDR-mediated correction or insertion, the closer nick is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25-55 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp) and no more than 100 bp away from each other (e.g., no more than 90, 80, 70, 60, 50, 40, 30, 20, 10 or 5 bp away from each other). In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on either side of the target position (e.g., the first gRNA is used to target upstream (i.e., 5') of the target position and the second gRNA is used to target downstream (i.e., 3') of the target position). In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position (e.g., the first gRNA is used to target upstream (i.e., 5') of the target position and the second gRNA is used to target downstream (i.e., 3') of the target position). The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35. to 50, 40 to 50, 45 to 50, 35 to 45, or 40 to 45 bp) and no more than 100 bp away from each other (e.g., no more than 90, 80, 70, 60, 50, 40, 30, 20 or 10 bp).

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on two target sequences (e.g., the first gRNA is used to target an upstream (i.e., 5') target sequence and the second gRNA is used to target a downstream (i.e., 3') target sequence of an insertion site. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of an insertion site (e.g., the first gRNA is used to target an upstream (i.e., 5') target sequence described herein, and the second gRNA is used to target a downstream (i.e., 3') target sequence described herein). The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

Length of the Homology Arms

In embodiments, incorporation of the heterologous sequence may be facilitated by including in the template nucleic acid one or more, e.g., two (e.g., a 5' and a 3'), homology arms having homology to sequence at or near, e.g., adjacent to, the target sequence or double strand break, e.g., homology arms having homology to sequence within a TET2 intron, or to sequence comprising sequence within a TET2 intron. The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., ALU repeats, LINE repeats. A template may have two homology arms of the same or different lengths.

In one embodiment, the homology arm comprises, e.g., consists of, the sequence below (SEQ ID NO: 124):

GAATTCCTGTTGCAAAGTGACCTGCTTTGGCATAACTAGCACTCTCATGAT

AGGTTGGCACATTAGTTTCCTGTCAATTGTGTTGACAAGCACATGAGAATC

ATGGAAATCCTTGGTGTTAATCTAAACCAGTGACTATGCATTGCCAGTTAC

AGTTAACTTCCAGGAAAATCTCAAAATTCAGTGCCAGTTACCTGGTAGATT

GTAATCAGTTAAGCAAAAAGCCAAATACAAGCCATTCACCTTACAGAGAGA

GAAGCATATTCACCTTACAGAGAGAGAAGCATAAATGAGAAACACATCATC

ATTGTCACAGTAACTGTGGTAACCTATTGTAAAAGATTCACAGTGCAAAAG

AGCCTGACTACATATTACAGTGGGTAAAATGGATCGGTCTTGTA

In one embodiment, the homology arm comprises, e.g., consists of, the sequence below (SEQ ID NO: 125):

TGAGGGGAAAATAGATACATGTTATATATATATATATATATATATATGTTC

TATACCAACAAAGGGTTCAGGGTATAATTTTGCATGTAAAGGGGTGACCCA

GAGTAGAGATAAAGAACAAAATATTCTGTTGAAAAAACTATGAATCAATCA

ACCTAATGAATTATCAACATGGATGTAGGTGTAGTTGAAGAAGATGGTCAG

TGAGAATATGGAAACAGATATCAGGAATTAAAGTCATATTCTAGGGCAGAA

AAGCATTCATGGAGGTATTAGATGATAGCTGAAGTAATTTGAAGAAGCTGG

TGTGAA

In one embodiment, the first homology arm comprises SEQ ID NO: 124, and the second homology arm comprises SEQ ID NO: 125. In embodiments, a template nucleic acid comprising homology arms comprising SEQ ID NO: 124 and/or SEQ ID NO: 125 is used in conjunction with a CRISPR system comprising a gRNA molecule comprising SEQ ID NO: 10148, 10149 or 10206. In embodiments, a template nucleic acid comprising homology arms comprising SEQ ID NO: 124 and/or SEQ ID NO: 125 is used in conjunction with a CRISPR system comprising a gRNA molecule comprising SEQ ID NO: 10148 or 10149. In embodiments the template nucleic acid is comprised in an AAV vector, e.g., an AAV6 vector.

Exemplary homology arm lengths include at least about 25, 50, 100, 200, 250, 500, 750, 1000, or 1500 nucleotides. In some embodiments, a homology arm length of about 200 nucleotides or less may be used, e.g., if there are regions of repeats present within the genomic region of homology which would otherwise be targeted by a longer homology arm. "Target position," as used herein, refers to a site on a target nucleic acid (e.g., the chromosome) that is modified by a Cas9 molecule-dependent process. For example, the target position can be a modified Cas9 molecule cleavage of the target nucleic acid and template nucleic acid directed modification, e.g., correction or insertion, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or downstream of a target sequence (e.g., the sequence to which the gRNA binds).

Typically, the template sequence undergoes a breakage mediated or catalyzed recombination with the target sequence. In an embodiment, the template nucleic acid includes sequence that corresponds to a site on the target sequence that is cleaved by a Cas9 mediated cleavage event. In an embodiment, the template nucleic acid includes sequence that corresponds to both a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a coding sequence, e.g., in an exon, or non-coding sequence, e.g., an alteration in an intron or in a 5' or 3' non-translated or non-transcribed region. Such alterations include an alteration in a control element, e.g., a promoter, enhancer, and an alteration in a cis-acting or trans-acting control element. In some embodiments, the alteration includes the insertion of nucleic acid sequence, e.g., nucleic acid sequence encoding a heterologous protein, e.g., a CAR, e.g., as described herein, at or near the target sequence, e.g., the target sequence recognized by a gRNA molecule described herein.

The template nucleic acid can include sequence which, when integrated, results in:
decreasing the activity of a positive control element;
increasing the activity of a positive control element;
decreasing the activity of a negative control element;
increasing the activity of a negative control element;
decreasing the expression of a gene;
increasing the expression of a gene;
increasing resistance to a disorder or disease;
increasing resistance to viral entry;
correcting a mutation or altering an unwanted amino acid residue
conferring, increasing, abolishing or decreasing a biological property of a gene product, e.g., increasing the enzymatic activity of an enzyme, or increasing the ability of a gene product to interact with another molecule.

The template nucleic acid can include sequence which results in:

a change in sequence of 1, 2, 3, 4, 5, 6, 7, 8, 9, 10, 11, 12 or more nucleotides of the target sequence.

In an embodiment, the template nucleic acid is 20+/−10, 30+/−10, 40+/−10, 50+/−10, 60+/−10, 70+/−10, 80+/−10, 90+/−10, 100+/−10, 110+/−10, 120+/−10, 130+/−10, 140+/−10, 150+/−10, 160+/−10, 170+/−10, 180+/−10, 190+/−10, 200+/−10, 210+/−10, 220+/−10, 200-300, 300-400, 400-500, 500-600, 600-700, 700-800, 800-900, 900-1000, 1000-2000, 2000-3000 or more than 3000 nucleotides in length.

A template nucleic acid comprises the following components:

[5' homology arm]-[insertion sequence]-[3' homology arm].

The homology arms provide for recombination into the chromosome, which can replace the undesired element, e.g., a mutation or signature, with the replacement sequence, or insert the desired sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 60, 70, 80, 90, 100, 120, 150, 180, 200, 300, 400, 500, 600, 700, 800, 900, 1000, 1500, or 2000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 60, 70, 80, 90, 100, 120, 150, 180, 200, 300, 400, 500, 600, 700, 800, 900, 1000, 1500, or 2000 nucleotides 3' from the 3' end of the replacement sequence.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In one aspect, the insertion sequence comprises nucleic acid sequence that encodes a chimeric antigen receptor, e.g., as described herein. In one embodiment the insertion sequence further comprises a promotor operably linked to the nucleic acid sequence encoding a chimeric antigen receptor, e.g., an EF-1 alpha promoter. In one aspect, the insertion sequence comprises a vector encoding a chimeric antigen receptor, e.g., as described herein, or a portion thereof.

NHEJ Approaches for Gene Targeting

As described herein, nuclease-induced non-homologous end-joining (NHEJ) can be used to target gene-specific knockouts. Nuclease-induced NHEJ can also be used to remove (e.g., delete) sequence in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations may alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double strand cleaving Cas9 molecules and single strand, or nickase, Cas9 molecules can be used in the methods and compositions described herein to generate NHEJ-mediated indels. NHEJ-mediated indels targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Placement of double strand or single strand breaks relative to the target position In an embodiment, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-500 bp away from the target position (e.g., less than 500, 400, 300, 200, 100, 50, 40, 30, 25, 20, 15, 10, 9, 8, 7, 6, 5, 4, 3, 2 or 1 bp from the target position).

In an embodiment, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In an embodiment, the gRNAs are configured to position cuts at the same position, or within a few nucleotides of one another, on different strands, essentially mimicking a double strand break. In an embodiment, the closer nick is between 0-30 bp away from the target position (e.g., less than 30, 25, 20, 1, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of a nucleotide of the target position.

Both double strand cleaving Cas9 molecules and single strand, or nickase, Cas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks is deleted). In one embodiment, two gRNAs, e.g., independently, unimolecular (or chimeric) or modular gRNA, are configured to position a double-strand break on both sides of a target position (e.g., the first gRNA is used to target upstream (i.e., 5') of the mutation in a gene or pathway described herein, and the second gRNA is used to target downstream (i.e., 3') of the mutation in a gene or pathway described herein). In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on either side of a target position (e.g., the first gRNA is used to target upstream (i.e., 5') of the mutation in a gene or pathway described herein, and the second gRNA is used to target downstream (i.e., 3') of the mutation in a gene or pathway described herein). In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position (e.g., the first gRNA is used to target upstream (i.e., 5') of the mutation in a gene or pathway described herein, and the second gRNA is used to target downstream (i.e., 3') of the mutation in a gene or pathway described herein). The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

Thus, in a specific embodiment, the disclosure provides a method of manufacturing a cell, e.g., an immune effector cell, e.g., a T cell, e.g., as described herein, for adoptive immunotherapy, the method comprising:

a) Introducing into said cell 1) a gRNA molecule (e.g., a CRISPR system comprising said gRNA molecule) described herein, e.g., a gRNA molecule to a tet intron or intron-exon junction, e.g., tet2 intron or intron-exon junction, e.g., a gRNA molecule comprising a targeting domain in Table 1 or Table 2 and 2) a template nucleic acid, e.g., a template nucleic acid comprising nucleic acid sequence encoding a CAR (e.g., as described herein);

Wherein at least a portion of the template nucleic acid (e.g., the nucleic acid sequence encoding a CAR) integrates into the genome of said cell within a tet, e.g., tet2 intron (e.g., at or near the target sequence of the tet, e.g., tet2 gRNA molecule).

In some embodiments, the template nucleic acid sequence for targeting a TET2 intron or intron-exon junction comprises a nucleic acid sequence encoding a CAR selected from CD19 CAR, BCMA CAR, and CD22 CAR (e.g., as described herein); the template nucleic acid sequence further comprises a first homology arm comprising SEQ ID NO: 124 and a second homology arm comprising SEQ ID NO: 125; and the gRNA molecule is selected from a gRNA comprising a targeting domain complementary to a sequence within a genomic region (according to hg38) of chr4:105269748-105272563, e.g., chr4:105270624-105270643, chr4:105270630-105270649, chr4:105271863-105271883.

In some embodiments, the template nucleic acid sequence for targeting a TET2 intron or intron-exon junction comprises a first homology arm comprising SEQ ID NO: 124 and a second homology arm comprising SEQ ID NO: 125; and the gRNA molecule is selected from a gRNA comprising a targeting domain complementary to a sequence within a genomic region (according to hg38) of chr4:105269748-105272563, e.g., chr4:105270624-105270643, chr4:105270630-105270649, chr4:105271863-105271883.

In some embodiments, the template nucleic acid sequence for targeting a TET2 intron or intron-exon junction comprises a nucleic acid sequence encoding a CAR selected from CD19 CAR, BCMA CAR, and CD22 CAR (e.g., as described herein); and the gRNA molecule is selected from a gRNA comprising a targeting domain complementary to a sequence within a genomic region (according to hg38) of chr4:105269748-105272563, e.g., chr4:105270624-105270643, chr4:105270630-105270649, chr4:105271863-105271883.

In some embodiments, the template nucleic acid sequence for targeting a TET2 intron or intron-exon junction is provided on an AAV6 vector; the template nucleic acid sequence comprises a nucleic acid sequence encoding a CAR selected from CD19, BCMA, and CD22; the template nucleic acid sequence further comprises a first homology arm comprising SEQ ID NO: 124 and a second homology arm comprising SEQ ID NO: 125; and the gRNA molecule is selected from a gRNA comprising a targeting domain complementary to a sequence within a genomic region (according to hg38) of chr4:105269748-105272563, e.g., chr4:105270624-105270643, chr4:105270630-105270649, chr4:105271863-105271883.

In some embodiments, the template nucleic acid sequence for targeting a TET2 intron or intron-exon junction is provided on an AAV6 vector; the template nucleic acid sequence comprises a first homology arm comprising SEQ ID NO: 124 and a second homology arm comprising SEQ ID NO: 125; and the gRNA molecule is selected from a gRNA comprising a targeting domain complementary to a sequence within a genomic region (according to hg38) of chr4:105269748-105272563, e.g., chr4:105270624-105270643, chr4:105270630-105270649, chr4:105271863-105271883.

In some embodiments, the template nucleic acid sequence for targeting a TET2 intron or intron-exon junction is provided on an AAV6 vector; the template nucleic acid sequence comprises a nucleic acid sequence encoding a CAR selected from CD19 CAR, BCMA CAR, and CD22 CAR (e.g., as described herein); and the gRNA molecule is selected from a gRNA comprising a targeting domain complementary to a sequence within a genomic region (according to hg38) of chr4:105269748-105272563, e.g., chr4:105270624-105270643, chr4:105270630-105270649, chr4:105271863-105271883.

In some embodiments, the template nucleic acid sequence for targeting a TET2 intron or intron-exon junction is provided on an AAV6 vector; and the gRNA molecule is selected from a gRNA comprising a targeting domain complementary to a sequence within a genomic region (according to hg38) of chr4:105269748-105272563, e.g., chr4:105270624-105270643, chr4:105270630-105270649, chr4:105271863-105271883.

In some embodiments, the template nucleic acid sequence for targeting a TET2 intron or intron-exon junction comprises a nucleic acid sequence encoding a CAR selected from CD19 CAR, BCMA CAR, and CD22 CAR (e.g., as described herein); the template nucleic acid sequence further comprises a first homology arm comprising SEQ ID NO: 124 and a second homology arm comprising SEQ ID NO: 125; and the gRNA molecule is selected from a gRNA comprising a targeting domain of any of the sequences in Table 1 or Table 2, e.g., SEQ ID NO: 10148, SEQ ID NO: 10149, SEQ ID NO: 10206, e.g., SEQ ID NO: 10148 or SEQ ID NO: 10149.

In some embodiments, the template nucleic acid sequence for targeting a TET2 intron or intron-exon junction comprises a first homology arm comprising SEQ ID NO: 124 and a second homology arm comprising SEQ ID NO: 125; and the gRNA molecule is selected from a gRNA comprising a targeting domain of any of the sequences in Table 1 or Table 2, e.g., SEQ ID NO: 10148, SEQ ID NO: 10149, SEQ ID NO: 10206.

In some embodiments, the template nucleic acid sequence for targeting a TET2 intron or intron-exon junction comprises a nucleic acid sequence encoding a CAR selected from CD19 CAR, BCMA CAR, and CD22 CAR (e.g., as described herein); and the gRNA molecule is selected from a gRNA comprising a targeting domain of any of the sequences in Table 1 or Table 2.

In some embodiments, the template nucleic acid sequence for targeting a TET2 intron or intron-exon junction is provided on an AAV6 vector; the template nucleic acid sequence comprises a nucleic acid sequence encoding a CAR selected from CD19, BCMA, and CD22; the template nucleic acid sequence further comprises a first homology arm comprising SEQ ID NO: 124 and a second homology arm comprising SEQ ID NO: 125; and the gRNA molecule is selected from a gRNA comprising a targeting domain of any of the sequences in Table 1 or Table 2, e.g., SEQ ID NO: 10148, SEQ ID NO: 10149, SEQ ID NO: 10206.

In some embodiments, the template nucleic acid sequence for targeting a TET2 intron or intron-exon junction is provided on an AAV6 vector; the template nucleic acid sequence comprises a first homology arm comprising SEQ ID NO: 124 and a second homology arm comprising SEQ ID NO: 125; and the gRNA molecule is selected from a gRNA comprising a targeting domain of any of the sequences in Table 1 or Table 2, e.g., SEQ ID NO: 10148, SEQ ID NO: 10149, SEQ ID NO: 10206.

In some embodiments, the template nucleic acid sequence for targeting a TET2 intron or intron-exon junction is provided on an AAV6 vector; the template nucleic acid sequence comprises a nucleic acid sequence encoding a CAR selected from CD19 CAR, BCMA CAR, and CD22 CAR (e.g., as described herein); and the gRNA molecule is selected from a gRNA comprising a targeting domain of any of the sequences in Table 1 or Table 2, e.g., SEQ ID NO: 10148, SEQ ID NO: 10149, SEQ ID NO: 10206.

In some embodiments, the template nucleic acid sequence for targeting a TET2 intron or intron-exon junction is provided on an AAV6 vector; and the gRNA molecule is selected from a gRNA comprising a targeting domain of any of the sequences in Table 1 or Table 2, e.g., SEQ ID NO: 10148, SEQ ID NO: 10149, SEQ ID NO: 10206.

In some embodiments, the template nucleic acid comprises SEQ ID NO: 126. In some embodiments, the template nucleic acid comprises SEQ ID NO: 126 and is provided on an AAV vector, e.g., an AAV6 vector. In some embodiments, the template nucleic acid comprises SEQ ID NO: 126 and is provided on an AAV vector, e.g., an AAV6 vector, and the gRNA molecule is selected from a gRNA comprising a targeting domain of any of the sequences in Table 1 or Table 2, e.g., SEQ ID NO: 10148, SEQ ID NO: 10149, SEQ ID NO: 10206, e.g., selected from SEQ ID NO: 10148 and SEQ ID NO: 10149.

In some embodiments, a gRNA molecule described herein and a Cas9 molecule described herein are mixed to form a ribonuclear protein complex (RNP); next the RNP is introduced to a cell described herein; and then the cell is introduced to the vector described herein, e.g., AAV6.

In some embodiments, the gRNA molecules disclosed herein are capable of generating the editing repair pattern described in Table 22 and/or the indel frequencies described in Table 23.

The disclosure also provides cells that comprise or at one time comprised one or more gRNA molecules disclosed herein, and exhibit or at one time exhibited the editing repair pattern described in Table 22 and/or the indel frequencies described in Table 23.

VIII. Systems Comprising More Than One gRNA Molecule

While not intending to be bound by theory, targeting of two target sequences (e.g., by two gRNA molecule/Cas9 molecule complexes which each induce a single- or double-strand break at or near their respective target sequences) located in close proximity on a continuous nucleic acid induces excision (e.g., deletion) of the nucleic acid sequence (or at least 80%, 85%, 90%, 95%, 96%, 97%, 98%, 99% of the nucleic acid sequence) located between the two target sequences. In some aspects, the present disclosure provides for the use of two or more gRNA molecules that comprise targeting domains targeting target sequences in close proximity on a continuous nucleic acid, e.g., a chromosome, e.g., a gene or gene locus, including its introns, exons and regulatory elements. The use may be, for example, by introduction of the two or more gRNA molecules, together with one or more Cas9 molecules (or nucleic acid encoding the two or more gRNA molecules and/or the one or more Cas9 molecules) into a cell. Such systems may be used, for example, to insert heterologous nucleic acid sequence, e.g., sequence from a template nucleic acid, e.g., sequence encoding a CAR (e.g., as described herein) into the site of the excision.

In some aspects, the target sequences of the two or more gRNA molecules are located at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, or 70000 nucleotides apart on a continuous nucleic acid, but not more than 10000 nucleotides apart on a continuous nucleic acid. In an embodiment, the target sequences are located about 4000 nucleotides apart. In an embodiment, the target sequences are located about 6000 nucleotides apart.

In some aspects, the plurality of gRNA molecules each target sequences within the same gene or gene locus. In another aspect, the plurality of gRNA molecules each target sequences within 2 or more different genes.

In some aspects, the disclosure provides compositions and cells comprising a plurality, for example, 2 or more, for example, 2, gRNA molecules of the disclosure, wherein the plurality of gRNA molecules target sequences less than 10,000, less than 9,000, less than 8,000, less than 7,000, less than 6,000, less than 5,000, less than 4,000, less than 3,000, less than 2,000, less than 1,000, less than 900, less than 800, less than 700, less than 600, less than 500, less than 400, less than 300, less than 200, less than 100, less than 90, less than 80, less than 70, less than 60, less than 50, less than 40, or less than 30 nucleotides apart. In an embodiment, the target sequences are on the same strand of duplex nucleic acid. In an embodiment, the target sequences are on different strands of duplex nucleic acid.

In one embodiment, the disclosure provides a method for excising (e.g., deleting) nucleic acid disposed between two gRNA binding sites disposed less than 10,000, less than 9,000, less than 8,000, less than 7,000, less than 6,000, less than 5,000, less than 4,000, less than 3,000, less than 2,000, less than 1,000, less than 900, less than 800, less than 700, less than 600, less than 500, less than 400, less than 300, less than 200, less than 100, less than 90, less than 80, less than 70, less than 60, less than 50, less than 40, or less than 30 nucleotides apart on the same or different strands of duplex nucleic acid. In an embodiment, the method provides for deletion of more than 50%, more than 60%, more than 70%, more than 80%, more than 85%, more than 86%, more than 87%, more than 88%, more than 89%, more than 90%, more than 91%, more than 92%, more than 93%, more than 94%, more than 95%, more than 96%, more than 97%, more than 98%, more than 99%, or 100% of the nucleotides disposed between the PAM sites associated with each gRNA binding site. In embodiments, the deletion further comprises of one or more nucleotides within one or more of the PAM sites associated with each gRNA binding site. In embodiments, the deletion also comprises one or more nucleotides outside of the region between the PAM sites associated with each gRNA binding site.

In one aspect, the two or more gRNA molecules comprise targeting domains targeting target sequences flanking a gene regulatory element, e.g., a promotor binding site, an enhancer region, or a repressor region, such that excision of the intervening sequence (or a portion of the intervening sequence) causes up- or down-regulation of a gene of interest.

In an embodiment, the two or more gRNA molecules are selected from the gRNA molecules of Table 1 or Table 2. In aspects, the two or more gRNA molecules comprise targeting domains that are complementary with sequences in the same gene, for example, same region, e.g., same intron.

In addition to the gRNA molecules described herein, e.g., gRNA molecules to a tet intron or intron-exon junction, e.g., tet2 intron or intron-exon junction, the CRISPR systems, cells, methods and other embodiments of the disclosure may further include one or more additional gRNA molecules, CRISPR systems or, in the case of, for example, cells, one or more alterations within other genes, for example, effected by CRISPR systems.

As described herein, when utilizing more than one gRNA molecule (or CRISPR system comprising more than one gRNA molecule, e.g., a CRISPR system comprising a first gRNA molecule and a CRISPR system comprising a second gRNA molecule, e.g., wherein each gRNA molecule is complexed with a Cas molecule, e.g., a Cas9 molecule, e.g., as described herein), the more than one gRNA molecules may be introduced into a cell simultaneously, e.g., in a single introduction step, e.g., a single electroporation step. Alternatively, the more than one gRNA molecules (or CRISPR systems comprising said gRNA molecules) can be introduced into a cell in more than one steps, e.g., more than one electroporations. If multiple introduction steps are utilized, the steps may be separated by a period of hours, days, or weeks, e.g., by a period of 1 hour, 2 hours, 5 hours, 10 hours, 15 hours, 20 hours, 24 hours, 2 days, 3, days, 4 days, 5 days, 6 days, 7 days, 8 days, 9 days, 10 days, or more.

In embodiments where template nucleic acid is utilized and it is desired to insert nucleic acid sequence only at a target sequence of one of the gRNA molecules in a system or method utilizing more than one gRNA molecule, the alteration of the cell of interest can be accomplished in stepwise fashion. For example, in a first step, a CRISPR system comprising a gRNA molecule which binds the target sequence where insertion is desired is introduced into the cell together with a template nucleic acid, e.g., as described herein. In a second step, for example, at a time when there is no longer template nucleic acid present in said cell, one or more CRISPR systems comprising one or more gRNA molecules to additional target sequences (e.g., target sequences in genes where it is desired to have reduced or eliminated function or expression of said gene or genes) are introduced. In embodiments, the first and second steps may be reversed in order. In embodiments, the second step may comprise a plurality of steps, each involving a single CRISPR system/gRNA molecule.

In a specific embodiment, the disclosure provides a method of manufacturing a cell, e.g., an immune effector cell, e.g., a T cell, e.g., as described herein, for adoptive immunotherapy, the method comprising:
 a) Introducing into said cell 1) a gRNA molecule (e.g., a CRISPR system comprising said gRNA molecule) described herein, e.g., a gRNA molecule to a tet intron or intron-exon junction, e.g., tet2 intron or intron-exon junction, e.g., a gRNA molecule comprising a targeting domain in Table 1 or Table 2 and 2) a template nucleic acid, e.g., a template nucleic acid comprising nucleic acid sequence encoding a CAR (e.g., as described herein); and
 b) Introducing into said cell a gRNA molecule (e.g., a CRISPR system comprising said gRNA molecule) comprising a targeting domain specific for a target sequence of a component of the T cell receptor (e.g., TRAC, TRBC, CD3E, CD3D, or CD3G), and/or introducing into said cell a gRNA molecule (e.g., a CRISPR system comprising said gRNA molecule) comprising a targeting domain specific for a target sequence of B2M and/or Introducing into said cell a gRNA molecule (e.g., a CRISPR system comprising said gRNA molecule) comprising a targeting domain specific for a target sequence of CIITA;
Wherein at least a portion of the template nucleic acid (e.g., the nucleic acid sequence encoding a CAR) integrates into the genome of said cell within a tet, e.g., tet2 intron (e.g., at or near the target sequence of the tet, e.g., tet2 gRNA molecule) and said cell has reduced or eliminated expression of a component of the T cell, B2M and/or CIITA.

In a specific embodiment, the disclosure provides a method of manufacturing a cell, e.g., an immune effector cell, e.g., a T cell, e.g., as described herein, for adoptive immunotherapy, the method comprising:
 a) Introducing into said cell 1) a gRNA molecule (e.g., a CRISPR system comprising said gRNA molecule) described herein, e.g., a gRNA molecule to a tet intron or intron-exon junction, e.g., tet2 intron or intron-exon junction, e.g., a gRNA molecule comprising a targeting domain in Table 1 or Table 2 and 2) a template nucleic acid, e.g., a template nucleic acid comprising nucleic acid sequence encoding a CAR (e.g., as described herein); and
 b) Introducing into said cell a gRNA molecule (e.g., a CRISPR system comprising said gRNA molecule) comprising a targeting domain specific for a target sequence of a component of the T cell receptor (e.g., TRAC, TRBC, CD3E, CD3D, or CD3G), and/or introducing into said cell a gRNA molecule (e.g., a CRISPR system comprising said gRNA molecule) comprising a targeting domain specific for a target of an immunosuppressant;
Wherein at least a portion of the template nucleic acid (e.g., the nucleic acid sequence encoding a CAR) integrates into the genome of said cell within a tet, e.g., tet2 intron (e.g., at or near the target sequence of the tet, e.g., tet2 gRNA molecule) and said cell has reduced or eliminated expression of a target for an immunosuppressant. Exemplary targets of an immunosuppressant include FKBP1A or CD52.

IX. Properties of the gRNA

While not intending to be bound by theory, gRNA molecules and CRISPR systems comprising said gRNA molecules produce similar or identical indel patterns when the same system is used in the same cell type through multiple experiments. Without being bound by theory, it is believed that some indel patterns may be more advantageous than others. For example, indels which predominantly include insertions and/or deletions which result in a "frameshift mutation" (e.g., 1- or 2-base pair insertion or deletions, or any insertion or deletion where n/3 is not a whole number (where n=the number of nucleotides in the insertion or deletion)) may be beneficial in reducing or eliminating expression of a functional protein. Likewise, indels which predominantly include "large deletions" (deletions of more than 10, 11, 12, 13, 14, 15, 20, 25, or 30 nucleotides) may also be beneficial in, for example, removing critical regulatory sequences such as promoter binding sites, which may similarly have an improved effect on expression of functional protein. While the indel patterns induced by a given gRNA/CRISPR system have surprisingly been found to be consistently reproduced across cell types, as described herein, not any single indel structure will inevitably be produced in a given cell upon introduction of a gRNA/CRISPR system. In embodiments, specific gRNAs, Cas molecules, cell types, scaffolds, etc., may be selected to affect the indel patterns induced by the CRISPR system.

The disclosure thus provides for gRNA molecules which create a beneficial indel pattern or structure, for example, which have indel patterns or structures predominantly composed of frameshift mutation(s) and/or large deletions. Such gRNA molecules may be selected by assessing the indel pattern or structure created by a candidate gRNA molecule in a test cell (for example, a HEK293 cell or in the cell of interest, e.g., a T cell) by NGS, as described herein. As shown in the Examples, gRNA molecules have been discovered, which, when introduced into the desired cell population, result in a population of cells comprising a significant fraction of the cells having a frameshift mutation in the targeted gene. In some cases, the rate of frameshift mutation is as high as 75%, 80%, 85%, 90% or more. The disclosure thus provides for populations of cells which comprise at least about 40% of cells (e.g., at least about 45%, at least about 50%, at least about 55%, at least about 60%, at least about 65%, at least about 70%, at least about 75%, at least about 80%, at least about 85%, at least about 90%, at least about 95%, or at least about 99%) having a frameshift mutation, e.g., as described herein, at or near the target site of a gRNA molecule described herein. The disclosure also provides for populations of cells which comprise at least about 50% of cells (e.g., at least about 55%, at least about 60%, at least about 65%, at least about 70%, at least about 75%, at least about 80%, at least about 85%, at least about 90%, at least about 95%, or at least about 99%) having a frameshift mutation, e.g., as described herein, at or near the target site of a gRNA molecule described herein.

The disclosure thus provides methods of selecting gRNA molecules for use in the therapeutic methods of the disclosure comprising: 1) providing a plurality of gRNA molecules to a target of interest, 2) assessing the indel pattern or structure created by use of said gRNA molecules, 3) selecting a gRNA molecule that forms an indel pattern or structure composed predominantly of frameshift mutations, large deletions or a combination thereof, and 4) using said selected gRNA in a methods of the disclosure.

The disclosure further provides methods of altering cells, and altered cells, wherein a particular indel pattern is consistently produced with a given gRNA/CRISPR system in that cell type.

It may also be beneficial to utilize gRNA molecules that do not create indels at off-target sequences within the genome of the target cell type, or produce indels at off target sites at very low frequencies (e.g., <5% of cells within a population) relative to the frequency of indel creation at the target site. Thus, the disclosure provides for gRNA molecules and CRISPR systems which do not exhibit off-target indel formation in the target cell type, or which produce a frequency of off-target indel formation of <5%. In embodiments, the disclosure provides gRNA molecules and CRISPR systems which do not exhibit any off target indel formation in the target cell type. Thus, the disclosure further provides a cell, e.g., a population of cells, e.g., immune effector cells, e.g., CAR-expressing immune effector cells, e.g., as described herein, which comprise an indel at or near a target site of a gRNA molecule described herein (e.g., a frameshift indel, or any one of the top 5 indels produced by a given gRNA/CRISPR system, e.g., as described herein), but does not comprise an indel at any off-target site of the gRNA molecule. In other embodiments, the disclosure further provides a population of cells, e.g., immune effector cells, e.g., CAR-expressing immune effector cells, e.g., as described herein, which comprises >50% of cells which have an indel at or near a target site of a gRNA molecule described herein (e.g., a frameshift indel, or any one of the top 5 indels produced by a given gRNA/CRISPR system, e.g., as described herein), but which comprises less than 5%, e.g., less than 4%, less than 3%, less than 2% or less than 1%, of cells comprising an indel at any off-target site of the gRNA molecule.

X. Delivery/Constructs

The components, e.g., a Cas9 molecule, gRNA molecule and/or template nucleic acid, or combinations thereof, can be delivered, formulated, or administered in a variety of forms. As a non-limiting example, the gRNA molecule and Cas9 molecule can be formulated (in one or more compositions), directly delivered or administered to a cell in which a genome editing event is desired. Alternatively, nucleic acid encoding one or more components, e.g., a Cas9 molecule or gRNA molecule, or both, can be formulated (in one or more compositions), delivered or administered. In one aspect, the gRNA molecule is provided as DNA encoding the gRNA molecule and the Cas9 molecule is provided as DNA encoding the Cas9 molecule. In one embodiment, the gRNA molecule and Cas9 molecule are encoded on separate nucleic acid molecules. In one embodiment, the gRNA molecule and Cas9 molecule are encoded on the same nucleic acid molecule. In one aspect, the gRNA molecule is provided as RNA and the Cas9 molecule is provided as DNA encoding the Cas9 molecule. In one embodiment, the gRNA molecule is provided with one or more modifications, e.g., as described herein. In one aspect, the gRNA molecule is provided as RNA and the Cas9 molecule is provided as mRNA encoding the Cas9 molecule. In one aspect, the gRNA molecule is provided as RNA and the Cas9 molecule is provided as a protein. In one embodiment, the gRNA and Cas9 molecule are provided as a ribonuclear protein complex (RNP). In one aspect, the gRNA molecule is provided as DNA encoding the gRNA molecule and the Cas9 molecule is provided as a protein. In any of the aforementioned embodiments, the composition may further include a template nucleic acid.

Delivery may be accomplished by, for example, electroporation (e.g., as known in the art) or other method that renders the cell membrane permeable to nucleic acid and/or polypeptide molecules. Additional techniques for rendering the membrane permeable are known in the art and include, for example, cell squeezing (e.g., as described in WO2015/023982 and WO2013/059343, the contents of which are hereby incorporated by reference in their entirety), nanoneedles (e.g., as described in Chiappini et al., Nat. Mat., 14; 532-39, or US2014/0295558, the contents of which are hereby incorporated by reference in their entirety) and nanostraws (e.g., as described in Xie, ACS Nano, 7(5); 4351-58, the contents of which are hereby incorporated by reference in their entirety).

When a component is delivered encoded in DNA the DNA will typically include a control region, e.g., comprising a promoter, to effect expression. Useful promoters for Cas9 molecule sequences include CMV, EF-1alpha, MSCV, PGK, CAG control promoters. Useful promoters for gRNAs include H1, EF-1a and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment, a promoter for a Cas9 molecule or a gRNA molecule can be, independently, inducible, tissue specific, or cell specific.

DNA-Based Delivery of a Cas9 Molecule and or a gRNA Molecule

DNA encoding Cas9 molecules and/or gRNA molecules, can be administered to subjects or delivered into cells by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

In some embodiments, the Cas9- and/or gRNA-encoding DNA is delivered by a vector (e.g., viral vector/virus, plasmid, minicircle or nanoplasmid). In some embodiments, the Cas9- and/or gRNA-encoding DNA is delivered by at least one vector. For example, the Cas9 is delivered by a vector that is different than the vector by which the gRNA-encoding DNA is delivered.

A vector can comprise a sequence that encodes a Cas9 molecule and/or a gRNA molecule. A vector can also comprise a sequence encoding a signal peptide (e.g., for nuclear localization, nucleolar localization, mitochondrial localization), fused, e.g., to a Cas9 molecule sequence. For example, a vector can comprise one or more nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and a splice acceptor or donor can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector or delivery vehicle is a minicircle. In some embodiments, the vector or delivery vehicle is a nanoplasmid.

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus).

Exemplary viral vectors/viruses include, e.g., retroviruses, lentiviruses, adenovirus, adeno-associated virus (AAV), vaccinia viruses, poxviruses, and herpes simplex viruses. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In some embodiments, the Cas9- and/or gRNA-encoding DNA is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted.

In some embodiments, the Cas9- and/or gRNA-encoding DNA is delivered by a recombinant lentivirus. For example, the lentivirus is replication-defective, e.g., does not comprise one or more genes required for viral replication.

In some embodiments, the Cas9- and/or gRNA-encoding DNA is delivered by a recombinant adenovirus. In some embodiments, the adenovirus is engineered to have reduced immunity in human.

In some embodiments, the Cas9- and/or gRNA-encoding DNA and/or template nucleic acid is delivered by a recombinant AAV. In some embodiments, the AAV can incorporate its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods include, e.g., AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV8.2, AAV9, AAVrh10, and pseudotyped AAV, such as AAV2/8, AAV2/5 and AAV2/6 can also be used in the disclosed methods. In some embodiments, the recombinant AAV is AAV6.

In some embodiments, the Cas9- and/or gRNA-encoding DNA is delivered by a hybrid virus, e.g., a hybrid of one or more of the viruses described herein.

A packaging cell is used to form a virus particle that is capable of infecting a host or target cell. Such a cell includes a 293 cell, which can package adenovirus, and a ω2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed. For example, an AAV vector used in gene therapy typically only possesses inverted terminal repeat (ITR) sequences from the AAV genome which are required for packaging and gene expression in the host or target cell. The missing viral functions are supplied in trans by the packaging cell line. Henceforth, the viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibody, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutin (HA) can be incorporated to increase viral uptake into cells. In an embodiment, the viral vector has the ability of nuclear localization. For example, a virus that requires the breakdown of the cell wall (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In some embodiments, the Cas9- and/or gRNA-encoding DNA is delivered by a combination of a vector and a non-vector based method. For example, a virosome comprises a liposome combined with an inactivated virus (e.g., HIV or influenza virus), which can result in more efficient gene transfer, e.g., in a respiratory epithelial cell than either a viral or a liposomal method alone.

In an embodiment, the delivery vehicle is a non-viral vector. In an embodiment, the non-viral vector is an inorganic nanoparticle (e.g., attached to the payload to the surface of the nanoparticle). Exemplary inorganic nanoparticles include, e.g., magnetic nanoparticles (e.g., Fe lvln0$_2$), or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids and/or polymers for transfer of CRISPR systems or nucleic acid, e.g., vectors, encoding CRISPR systems or components thereof include, for example, those described in WO2011/076807, WO2014/136086, WO2005/060697, WO2014/140211, WO2012/031046, WO2013/103467, WO2013/006825, WO2012/006378, WO2015/095340, and WO2015/095346, the contents of each of the foregoing are hereby incorporated by reference in their entirety. In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovesicle (30-100 nm) of endocytic origin (e.g., can be produced from various cell types and can therefore be taken up by cells without the need of for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas9 system are delivered. In an embodiment, the nucleic acid molecule is delivered by a different means than one or more of the components of the Cas9 system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein. Delivery of RNA encoding a Cas9 molecule RNA encoding Cas9 molecules (e.g., active Cas9 molecules, inactive Cas9 molecules or inactive Cas9 fusion proteins) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, lipid-mediated transfection, peptide-mediated delivery, or a combination thereof.

Delivery of Cas9 Molecule as Protein

Cas9 molecules (e.g., active Cas9 molecules, inactive Cas9 molecules or inactive Cas9 fusion proteins) can be delivered into cells by art-known methods or as described herein. For example, Cas9 protein molecules can be delivered, e.g., by microinjection, electroporation, lipid-mediated transfection, peptide-mediated delivery, cell squeezing or abrasion (e.g., by nanoneedles) or a combination thereof. Delivery can be accompanied by DNA encoding a gRNA or by a gRNA.

In an embodiment the Cas9 molecule, e.g., as described herein, is delivered as a protein and the gRNA molecule is delivered at one or more RNAs (e.g., as a dgRNA or sgRNA, as described herein). In embodiments, the Cas9 protein is complexed with the gRNA molecule prior to delivery to a cell, e.g., as described herein, as a ribonuclear protein complex ("RNP"). In embodiments, the RNP can be delivered into cells, e.g., described herein, by any art-known method, e.g., electroporation. As described herein, and without being bound by theory, it can be preferable to use a gRNA molecule and Cas9 molecule which result in high % editing at the target sequence (e.g., >85%, >90%, >95%, >98%, or >99%) in the target cell, e.g., described herein, even when the concentration of RNP delivered to the cell is reduced. Again, without being bound by theory, delivering a reduced or low concentration of RNP comprising a gRNA molecule that produces a high % editing at the target sequence in the target cell (including at the low RNP concentration), can be beneficial because it may reduce the frequency and number of off-target editing events. In one aspect, where a low or reduced concentration of RNP is to be used, the following procedure can be used to generate the RNP:

1. Provide the Cas9 molecule and the tracr in solution at a high concentration (e.g., a concentration higher than the final RNP concentration to be delivered to the cell), and allow the two components to equilibrate;
2. Provide the crRNA molecule, and allow the components to equilibrate (thereby forming a high-concentration solution of the RNP);
3. Dilute the RNP solution to the desired concentration;
4. Deliver said RNP at said desired concentration to the target cells, e.g., by electroporation.

The above procedure may be modified for use with sgRNA molecules by omitting step 2, above, and in step 1, providing the Cas9 molecule and the sgRNA molecule in solution at high concentration, and allowing the components to equilibrate. In embodiments, the Cas9 molecule and each gRNA component are provided in solution at a 1:2 ratio (Cas9:gRNA), e.g., a 1:2 molar ratio of Cas9:gRNA molecule. Where dgRNA molecules are used, the ratio, e.g., molar ratio, is 1:2:2 (Cas9:tracr:crRNA). In embodiments, the RNP is formed at a concentration of 20 uM or higher, e.g., a concentration from about 20 uM to about 50 uM. In embodiments, the RNP is formed at a concentration of 10 uM or higher, e.g., a concentration from about 10 uM to about 30 uM. In embodiments, the RNP is diluted to a final concentration of 10 uM or less (e.g., a concentration from about 0.01 uM to about 10 uM) in a solution comprising the target cell (e.g., described herein) for delivery to said target cell. In embodiments, the RNP is diluted to a final concentration of 3 uM or less (e.g., a concentration from about 0.01 uM to about 3 uM) in a solution comprising the target cell (e.g., described herein) for delivery to said target cell. In embodiments, the RNP is diluted to a final concentration of 1 uM or less (e.g., a concentration from about 0.01 uM to about 1 uM) in a solution comprising the target cell (e.g., described herein) for delivery to said target cell. In embodiments, the RNP is diluted to a final concentration of 0.3 uM or less (e.g., a concentration from about 0.01 uM to about 0.3 uM) in a solution comprising the target cell (e.g., described herein) for delivery to said target cell. In embodiments, the RNP is provided at a final concentration of about 3 uM in a solution comprising the target cell (e.g., described herein) for delivery to said target cell. In embodiments, the RNP is provided at a final concentration of about 1 uM in a solution comprising the target cell (e.g., described herein) for delivery to said target cell. In embodiments, the RNP is provided at a final concentration of about 0.3 uM in a solution comprising the target cell (e.g., described herein) for delivery to said target cell. In embodiments, the RNP is provided at a final concentration of about 0.1 uM in a solution comprising the target cell (e.g., described herein) for delivery to said target cell. In embodiments, the RNP is provided at a final concentration of about 0.05 uM in a solution comprising the target cell (e.g., described herein) for delivery to said target cell. In embodiments, the RNP is provided at a final concentration of about 0.03 uM in a solution comprising the target cell (e.g., described herein) for delivery to said target cell. In embodiments, the RNP is provided at a final concentration of about 0.01 uM in a solution comprising the target cell (e.g., described herein) for delivery to said target cell.

XI. Methods of Treatment

The Cas systems, e.g., one or more gRNA molecules and one or more Cas molecules (e.g., Cas9 molecules), described herein are useful for the treatment of disease in a mammal, e.g., in a human. The terms "treat," "treated," "treating," and "treatment," include the administration of Cas systems, e.g., one or more gRNA molecules and one or more Cas9 molecules, to cells to prevent or delay the onset of the symptoms, complications, or biochemical indicia of a disease, alleviating the symptoms or arresting or inhibiting further development of the disease, condition, or disorder. Treatment may be prophylactic (to prevent or delay the onset of the disease, or to prevent the manifestation of clinical or subclinical symptoms thereof) or therapeutic suppression or alleviation of symptoms after the manifestation of the disease. Treatment can be measured by the therapeutic measures described herein. The methods of "treatment" of the present disclosure also include administration of cells altered by the introduction of a Cas system (e.g., one or more gRNA molecules and one or more Cas molecules) into said cells to a subject in order to cure, delay, reverse, reduce the severity of, or ameliorate one or more symptoms of a disease or condition, in order to prolong the health or survival of a subject beyond that expected in the absence of such treatment. For example, "treatment" includes the alleviation of a disease symptom in a subject by at least 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95% or more.

Methods of Treatment/Combination Therapies

In various embodiments, methods of administering cells to a subject are provided, e.g., T or NK cells, e.g., autologous or allogeneic T cells, e.g., described herein, (e.g., those that express a CAR and/or have been modified at a TET2 intron or a TET2 intron-exon as described herein). In some embodiments, the cell is generated using the CRISPR methods disclosed herein. Other methods for generating the cells may also be used.

In one embodiment, the method comprises administering a cell which comprises or which at any time comprised a gRNA molecule as described herein, to a subject. In embodiments, the cell has been altered by the introduction of the gRNA molecule such that the gene comprising sequence complementary to the gRNA molecule targeting domain is altered, such that expression of functional product of that gene is reduced or eliminated relative to an unmodified cell. In embodiments, the cell is further engineered to express a CAR, e.g., as described herein. In embodiments, the cell is an immune effector cell, e.g., an NK cell or T cell. In embodiments, the cell is allogeneic. In embodiments, the cell is autologous.

In another aspect, the present disclosure provides a method comprising administering a gRNA molecule, e.g., a gRNA molecule described herein, or a cell comprising or which at any time comprised a gRNA molecule, e.g., a gRNA molecule described herein, to a subject in need thereof. In one embodiment, the subject has a disorder described herein, e.g., the subject has cancer, e.g., the subject has a cancer which expresses a target antigen described herein. In one embodiment, the subject is a human.

In another aspect, the disclosure pertains to a method of treating a subject having a disease associated with expression of a cancer associated antigen as described herein comprising administering to the subject an effective amount of a gRNA molecule, e.g., a gRNA molecule described herein, or a cell comprising or which at any time comprised a gRNA molecule, e.g., a gRNA molecule described herein.

In yet another aspect, the disclosure features a method of treating a subject having a disease associated with expression of a tumor antigen (e.g., an antigen described herein), comprising administering to the subject an effective amount of a cell, e.g., an immune effector cell (e.g., a population of immune effector cells) comprising or which at any time comprised a gRNA molecule, e.g., a gRNA molecule described herein, further comprising a CAR molecule, wherein the CAR molecule comprises an antigen binding domain, a transmembrane domain, and an intracellular domain, said intracellular domain comprises a costimulatory domain and/or a primary signaling domain, wherein said antigen binding domain binds to the tumor antigen associated with the disease, e.g. a tumor antigen as described herein.

In a related aspect, the disclosure features a method of treating a subject having a disease associated with expression of a tumor antigen. The method comprises administering to the subject an effective amount of a gRNA molecule, e.g., a gRNA molecule described herein, or a cell comprising or which at any time comprised a gRNA molecule, e.g., a gRNA molecule described herein, in combination with an agent that increases the efficacy of the cell, wherein:
the agent that increases the efficacy of the immune cell is chosen from one or more of:
a protein phosphatase inhibitor;
a kinase inhibitor;
a cytokine;
an inhibitor of an immune inhibitory molecule; or
an agent that decreases the level or activity of a TREG cell.

In another aspect, the disclosure features a composition comprising an immune effector cell (e.g., a population of immune effector cells) comprising or which at any time comprised a gRNA molecule, e.g., a gRNA molecule described herein, for use in the treatment of a subject having a disease associated with expression of a tumor antigen, e.g., a disorder as described herein.

In certain embodiments of any of the aforesaid methods or uses, the cell comprising or which at any time comprised a gRNA described herein, has been altered such that the expression of the functional gene product of the gene comprising the target sequence complementary to the gRNA targeting domain has been reduced or abolished. In an embodiment, expression of the functional gene product of the gene comprising the target sequence complementary to the gRNA targeting domain has been abolished. In embodiments, the cell further expresses a CAR, e.g., as described herein. In embodiments the cell is allogeneic. In embodiments, the cell is autologous.

In certain embodiments of any of the aforesaid methods or uses, the disease associated with a tumor antigen, e.g., a tumor antigen described herein, is selected from a proliferative disease such as a cancer or malignancy or a precancerous condition such as a myelodysplasia, a myelodysplastic syndrome or a preleukemia, or is a non-cancer related indication associated with expression of a tumor antigen described herein. In one embodiment, the disease is a cancer described herein, e.g., a cancer described herein as being associated with a target described herein. In one embodiment, the disease is a hematologic cancer. In one embodiment, the hematologic cancer is leukemia. In one embodiment, the cancer is selected from the group consisting of one or more acute leukemias including but not limited to B-cell acute lymphoid leukemia ("BALL"), T-cell acute lymphoid leukemia ("TALL"), acute lymphoid leukemia (ALL), pediatric acute lymphoid leukemia; one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and to disease associated with expression of a tumor antigen described herein include, but not limited to, atypical and/or non-classical cancers, malignancies, precancerous conditions or proliferative diseases expressing a tumor antigen as described herein; and any combination thereof. In one embodiment, the cancer is acute lymphoid leukemia (ALL). In one embodiment, the cancer is pediatric ALL. In one embodiment, the cancer is diffuse large B cell lymphoma. In one embodiment, the cancer is chronic lymphocytic leukemia. In one embodiment, the cancer is follicular lymphoma. In one embodiment, the cancer is Hodgkin lymphoma. In one embodiment, the cancer is non-Hodgkin lymphoma. In another embodiment, the disease associated with a tumor antigen described herein is a solid tumor.

In certain embodiments, the methods or uses are carried out in combination with an agent that increases the efficacy of the immune effector cell, e.g., an agent as described herein.

In any of the aforesaid methods or uses, the disease associated with expression of the tumor antigen is selected from the group consisting of a proliferative disease, a precancerous condition, a cancer, and a non-cancer related indication associated with expression of the tumor antigen.

The cancer can be a hematologic cancer, e.g., a cancer chosen from one or more of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, or pre-leukemia.

The cancer can also be chosen from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In certain embodiments of the methods or uses described herein, the cell is administered in combination with an agent that increases the efficacy of the immune effector cell, e.g., one or more of a protein phosphatase inhibitor, a kinase inhibitor, a cytokine, an inhibitor of an immune inhibitory molecule; or an agent that decreases the level or activity of a TREG cell.

In certain embodiments of the methods or uses described herein, the protein phosphatase inhibitor is a SHP-1 inhibitor and/or an SHP-2 inhibitor.

In other embodiments of the methods or uses described herein, kinase inhibitor is chosen from one or more of a CDK4 inhibitor, a CDK4/6 inhibitor (e.g., palbociclib), a BTK inhibitor (e.g., ibrutinib or RN-486), an mTOR inhibitor (e.g., rapamycin or everolimus (RAD001)), an MNK inhibitor, or a dual P13K/mTOR inhibitor. In one embodiment, the BTK inhibitor does not reduce or inhibit the kinase activity of interleukin-2-inducible kinase (ITK).

In other embodiments of the methods or uses described herein, the agent that decreases the level or activity of the TREG cells is chosen from cyclophosphamide, anti-GITR antibody, CD25-depletion, or a combination thereof.

In other embodiments, the agent that inhibits the inhibitory molecule comprises a first polypeptide comprising an inhibitory molecule or a fragment thereof and a second polypeptide that provides a positive signal to the cell, and wherein the first and second polypeptides are expressed on the CAR-containing immune cells, wherein (i) the first polypeptide comprises PD1, PD-L1, CTLA-4, TIM-3, LAG3, VISTA, BTLA, TIGIT, LAIR1, CD160, 2B4, TGF beta, CEACAM-1, CEACAM-3, and CEACAM-5 or a fragment thereof; and/or (ii) the second polypeptide comprises an intracellular signaling domain comprising a primary signaling domain and/or a costimulatory signaling domain. In one embodiment, the primary signaling domain comprises a functional domain of CD3 zeta; and/or the costimulatory signaling domain comprises a functional domain of a protein selected from 41BB, CD27 and CD28.

In other embodiments, cytokine is chosen from IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; IL-21, or a combination thereof. Exemplary hetIL-15 are heterodimeric non-covalent complexes of IL-15 and IL-15Ra (Admune Therapeutics, LLC). Such hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. Other exemplary embodiments of hetIL-15 are covalent complexes between an IL-15 polypeptide and an IL-15R (e.g., IL-15Ra) polypeptide.

In other embodiments, the cell and a second, e.g., any of the combination therapies disclosed herein (e.g., the agent that that increases the efficacy of the cell) are administered substantially simultaneously or sequentially.

In other embodiments, the cell is administered in combination with a molecule that targets GITR and/or modulates GITR function. In certain embodiments, the molecule targeting GITR and/or modulating GITR function is administered prior to the CAR-expressing cell or population of cells, or prior to apheresis.

In one embodiment, lymphocyte infusion, for example allogeneic lymphocyte infusion, is used in the treatment of the cancer, wherein the lymphocyte infusion comprises at least one cell, e.g., CAR-expressing cell, of the present disclosure. In one embodiment, autologous lymphocyte infusion is used in the treatment of the cancer, wherein the autologous lymphocyte infusion comprises at least one cell, e.g., CAR-expressing cell described herein.

In one embodiment, the cell is a T cell and the T cell is diaglycerol kinase (DGK) deficient. In one embodiment, the cell is a T cell and the T cell is Ikaros deficient. In one embodiment, the cell is a T cell and the T cell is both DGK and Ikaros deficient.

In one embodiment, the method includes administering a cell of the disclosure, as described herein, in combination with an agent which enhances the activity of the cell, wherein the agent is, e.g., a cytokine such as IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; IL-21; or a combination thereof. The cytokine can be delivered in combination with, e.g., simultaneously or shortly after, administration of the cell. Alternatively, the cytokine can be delivered after a prolonged period of time after administration of the cell, e.g., after assessment of the subject's response to the cell. In one embodiment the cytokine is administered to the subject simultaneously (e.g., administered on the same day) with or shortly after administration (e.g., administered 1 day, 2 days, 3 days, 4 days, 5 days, 6 days, or 7 days after administration) of the cell or population of cells of any of claims 61-80. In other embodiments, the cytokine is administered to the subject after a prolonged period of time (e.g., e.g., at least 2 weeks, 3 weeks, 4 weeks, 6 weeks, 8 weeks, 10 weeks, or more) after administration of the cell or population of cells of any of claims 61-80, or after assessment of the subject's response to the cell.

In other embodiments, the cells of the disclosure that are further engineered to express a CAR are administered in combination with an agent that ameliorates one or more side effects associated with administration of a cell expressing a CAR molecule. Side effects associated with the CAR-expressing cell can be chosen from cytokine release syndrome (CRS) or hemophagocytic lymphohistiocytosis (HLH).

In embodiments of any of the aforesaid methods or uses, the cells expressing the CAR molecule are administered in combination with an agent that treats the disease associated with expression of the tumor antigen, e.g., any of the second or third therapies disclosed herein. Additional exemplary combinations include one or more of the following.

In another embodiment, the cell, e.g., as described herein, can be administered in combination with another agent, e.g., a kinase inhibitor and/or checkpoint inhibitor described herein. In an embodiment, a cell of the disclosure can further express another agent, e.g., an agent which enhances the activity of the cell.

For example, in one embodiment, the agent that enhances the activity of the cell can be an agent which inhibits an inhibitory molecule.

In one embodiment, the agent that inhibits the inhibitory molecule is an inhibitory nucleic acid is a dsRNA, a siRNA, or a shRNA.

In another embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule, or a fragment thereof (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one embodiment, the cell of the present disclosure, e.g., T cell or NK cell, is administered to a subject that has received a previous stem cell transplantation, e.g., autologous stem cell transplantation.

In one embodiment, the cell of the present disclosure, e.g., T cell or NK cells, is administered to a subject that has received a previous dose of melphalan.

In one embodiment, the cell of the disclosure, is administered in combination with an agent that increases the efficacy of the cell, e.g., an agent described herein.

In one embodiment, the cells of the disclosure, are administered in combination with a low, immune enhancing dose of an mTOR inhibitor. While not wishing to be bound by theory, it is believed that treatment with a low, immune enhancing, dose (e.g., a dose that is insufficient to completely suppress the immune system but sufficient to improve immune function) is accompanied by a decrease in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2.

In an embodiment this approach can be used to optimize the performance of the cells described herein in the subject. While not wishing to be bound by theory, it is believed that, in an embodiment, the performance of endogenous, non-modified immune effector cells, e.g., T cells or NK cells, is improved. While not wishing to be bound by theory, it is believed that, in an embodiment, the performance of a CAR-expressing cell is improved. In other embodiments, cells, e.g., T cells or NK cells, which comprise or will be engineered to comprise a gRNA molecule of the disclosure, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., T cells or NK cells. In an embodiment, the cells are administered after a sufficient time, or sufficient dosing, of an mTOR inhibitor, such that the level of PD1 negative immune effector cells, e.g., T cells or NK cells, or the ratio of PD1 negative immune effector cells, e.g., T cells/PD1 positive immune effector cells, e.g., T cells, has been, at least transiently, increased.

In an embodiment, the cell, e.g., T cell or NK cell, to be engineered to comprise a gRNA of the disclosure, is harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In one embodiment, the cell of the disclosure is administered in combination with an agent that ameliorates one or more side effect associated with administration of a cell, e.g., an agent described herein.

In one embodiment, the cell is administered in combination with an agent that treats the disease associated with a cancer associated antigen as described herein, e.g., an agent described herein.

In one embodiment, the cell is administered at a dose and/or dosing schedule described herein.

In one embodiment, the subject (e.g., human) receives an initial administration of cells of the disclosure, and one or more subsequent administrations of cells of the disclosure, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of cells of the disclosure are administered to the subject (e.g., human) per week, e.g., 2, 3, or 4 administrations of cells comprising a CAR molecule are administered per week. In one embodiment, the subject (e.g., human subject) receives more than one administration of cells of the disclosure per week (e.g., 2, 3 or 4 administrations per week) (also referred to herein as a cycle), followed by a week of no administration of cells of the disclosure, and then one or more additional administration of cells of the disclosure (e.g., more than one administration of the cells of the disclosure per week) is administered to the subject. In another embodiment, the subject (e.g., human subject) receives more than one cycle of cells of the disclosure, and the time between each cycle is less than 10, 9, 8, 7, 6, 5, 4, or 3 days. In one embodiment, the cells of the disclosure are administered every other day for 3 administrations per week. In one embodiment, the cells of the disclosure are administered for at least two, three, four, five, six, seven, eight or more weeks.

In one embodiment, the cells of the disclosure are administered as a first line treatment for the disease, e.g., the cancer, e.g., the cancer described herein. In another embodiment, the cells of the disclosure, are administered as a second, third, fourth line treatment for the disease, e.g., the cancer, e.g., the cancer described herein.

In one embodiment, a population of cells described herein is administered.

In another aspect, the disclosure pertains to the isolated nucleic acid molecule encoding a gRNA of the disclosure, the gRNA molecule of the disclosure, and/or the cell comprising or which at any time comprised a gRNA of the disclosure for use as a medicament. In embodiments, the cell comprising or which at any time comprised a gRNA of the disclosure is or will be altered such that expression of the functional product of the gene comprising sequence complementary to the gRNA targeting domain is reduced or abolished.

In another aspect, the disclosure pertains to the isolated nucleic acid molecule encoding a gRNA of the disclosure, the gRNA molecule of the disclosure, and/or the cell comprising or which at any time comprised a gRNA of the disclosure for use in the treatment of a disease expressing a cancer associated antigen as described herein. In embodiments, the cell comprising or which at any time comprised a gRNA of the disclosure is or will be altered such that expression of the functional product of the gene comprising sequence complementary to the gRNA targeting domain is reduced or abolished.

In another aspect, the disclosure pertains to the isolated nucleic acid molecule encoding a gRNA of the disclosure, the gRNA molecule of the disclosure, and/or the cell comprising or which at any time comprised a gRNA of the disclosure for use as a medicament in combination with a cytokine, e.g., IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; and/or IL-21; and/or combinations thereof as described herein. In another aspect, the disclosure pertains to a cytokine described herein for use as a medicament in combination with a cell described herein. In embodiments, the cell comprising or which at any time comprised a gRNA of the disclosure is or will be altered such that expression of the functional product of the gene comprising sequence complementary to the gRNA targeting domain is reduced or abolished. In another aspect, the disclosure pertains to the isolated nucleic acid molecule encoding a gRNA, the gRNA molecule, and/or the cell comprising or which at any time comprised a gRNA for use as a medicament in combination with a cytokine, e.g., IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; and/or IL-21; and/or combinations thereof as described herein. In another aspect, the disclosure pertains to a cytokine described herein for use as a medicament in combination with a cell described herein. In embodiments, the cell comprising or which at any time comprised a gRNA is or will be altered such that expression of the functional product of the gene comprising sequence complementary to the gRNA targeting domain is reduced or abolished.

In another aspect, the disclosure pertains to the isolated nucleic acid molecule encoding a gRNA of the disclosure, the gRNA molecule of the disclosure, and/or the cell comprising or which at any time comprised a gRNA of the disclosure for use as a medicament in combination with a kinase inhibitor and/or a checkpoint inhibitor as described herein. In another aspect, the disclosure pertains to a kinase inhibitor and/or a checkpoint inhibitor described herein for use as a medicament in combination with a cell comprising or which at any time comprised a gRNA of the disclosure.

In another aspect, the disclosure features a composition comprising a cell of the disclosure for use in the treatment of a subject having a disease associated with expression of a tumor-supporting antigen, e.g., a disorder as described herein.

In any of the aforesaid methods or uses, the disease associated with expression of the tumor-supporting antigen is selected from the group consisting of a proliferative disease, a precancerous condition, a cancer, and a non-cancer related indication associated with expression of the tumor-supporting antigen. In an embodiment, the disease associated with a tumor-supporting antigen described herein is a solid tumor.

In one embodiment of the methods or uses described herein, the cell of the disclosure is administered in combination with another agent. In one embodiment, the agent can be a kinase inhibitor, e.g., a CDK4/6 inhibitor, a BTK inhibitor, an mTOR inhibitor, a MNK inhibitor, or a dual PI3K/mTOR inhibitor, and combinations thereof. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo [3,4-d]pyrimidine. The MNK inhibitor can be, e.g., a MNK1a, MNK1b, MNK2a and/or MNK2b inhibitor. The dual PI3K/mTOR inhibitor can be, e.g., PF-04695102.

In one embodiment of the methods or uses described herein, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]

thiazol-2-yl]piperidine-4-carboxamide (BMS 387032); 4-[[9-chloro-7-(2,6-difluorophenyl)-5H-pyrimido[5,4-d][2] benzazepin-2-yl]amino]-benzoic acid (MLN8054); 5-[3-(4, 6-difluoro-1H-benzimidazol-2-yl)-1H-indazol-5-yl]-N-ethyl-4-methyl-3-pyridinemethanamine (AG-024322); 4-(2, 6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment of the methods or uses described herein, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment of the methods or uses described herein, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In one embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment of the methods or uses described herein, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment of the methods or uses described herein, the kinase inhibitor is a BTK inhibitor that does not inhibit the kinase activity of ITK, e.g., RN-486, and RN-486 is administered at a dose of about 100 mg, 110 mg, 120 mg, 130 mg, 140 mg, 150 mg, 160 mg, 170 mg, 180 mg, 190 mg, 200 mg, 210 mg, 220 mg, 230 mg, 240 mg, 250 mg (e.g., 150 mg, 200 mg or 250 mg) daily for a period of time, e.g., daily a 28 day cycle. In one embodiment, 1, 2, 3, 4, 5, 6, 7, or more cycles of RN-486 are administered.

In one embodiment of the methods or uses described herein, the kinase inhibitor is an mTOR inhibitor selected from temsirolimus; ridaforolimus (1R,2R,4S)-4-[(2R)-2-[(1R,9S,12S, 15R,16E,18R,19R,21R,23S,24E,26E,28Z, 30S,32S,35R)-1,18-dihydroxy-19,30-dimethoxy-15,17,21, 23, 29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl] pyrido[2,3-d]pyrimidin-7-yl}-2-methoxyphenyl)methanol (AZD8055); 2-amino-8-[trans-4-(2-hydroxyethoxy)cyclohexyl]-6-(6-methoxy-3-pyridinyl)-4-methyl-pyrido[2,3-d] pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartyl-L-serine (SEQ ID NO: 10556) inner salt (SF1126); and XL765.

In one embodiment of the methods or uses described herein, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment of the methods or uses described herein, the kinase inhibitor is an MNK inhibitor selected from CGP052088; 4-amino-3-(p-fluorophenylamino)-pyrazolo [3,4-d] pyrimidine (CGP57380); cercosporamide; ETC-1780445-2; and 4-amino-5-(4-fluoroanilino)-pyrazolo [3,4-d] pyrimidine.

In one embodiment of the methods or uses described herein, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7 (8H)-one (PF-04691502); N-[4-[[4-(Dimethylamino)-1-piperidinyl]carbonyl]phenyl]-N-[4-(4,6-di-4-morpholinyl-1,3, 5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl] phenyl}propanenitrile (BEZ-235); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4, 5-c]quinolin-2(3H)-one Maleic acid (NVP-BGT226); 3-[4-(4-Morpholinylpyrido[3', 2':4,5]furo[3,2-d]pyrimidin-2-yl] phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In one embodiment of the methods or uses described herein, a CAR expressing immune effector cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment of the methods or uses described herein, the cell of the disclosure is administered in combination with another agent, and the agent is a cytokine. The cytokine can be, e.g., IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; IL-21; or a combination thereof. In another embodiment, the cell of the disclosure is administered in combination with a checkpoint inhibitor, e.g., a checkpoint inhibitor described herein. For example, in one embodiment, the check point inhibitor inhibits an inhibitory molecule selected from PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta.

In one aspect, the disclosure provides a method of treating a subject, e.g., a subject having a condition described herein, with a cell, e.g., described herein, e.g., a cell which has heterologous nucleic acid sequence, e.g., encoding a CAR (e.g., described herein), stably integrated into the genome at a site at or near the target sequence of a gRNA molecule described herein, e.g., a gRNA molecule comprising a targeting domain listed in Table 1 or Table 2.

In any of the embodiments and aspects of the disclosure, including in any of the aforementioned aspects and embodiments, the population of cells may be enriched, for example, during manufacturing, for a particular subset or subpopulation, e.g., for T-cells, e.g., for stem-cell memory-like T cells.

In another aspect, a method of treating a subject, e.g., reducing or ameliorating, a hyperproliferative condition or disorder (e.g., a cancer), e.g., solid tumor, a soft tissue tumor, or a metastatic lesion, in a subject is provided. As used herein, the term "cancer" is meant to include all types of cancerous growths or oncogenic processes, metastatic tissues or malignantly transformed cells, tissues, or organs, irrespective of histopathologic type or stage of invasiveness. Examples of solid tumors include malignancies, e.g., sarcomas, adenocarcinomas, and carcinomas, of the various organ systems, such as those affecting liver, lung, breast, lymphoid, gastrointestinal (e.g., colon), genitourinary tract (e.g., renal, urothelial cells), prostate and pharynx. Adenocarcinomas include malignancies such as most colon cancers, rectal cancer, renal-cell carcinoma, liver cancer, non-small cell carcinoma of the lung, cancer of the small intestine and cancer of the esophagus. In one embodiment, the cancer is a melanoma, e.g., an advanced stage melanoma. Metastatic lesions of the aforementioned cancers can also be treated or prevented using the methods and compositions of the disclosure. Examples of other cancers that can be treated include bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers. Treatment of metastatic cancers, e.g., metastatic cancers that express PD-L1 (Iwai et al. (2005) Int. Immunol. 17:133-144) can be effected using the antibody molecules described herein.

Exemplary cancers whose growth can be inhibited include cancers typically responsive to immunotherapy. Non-limiting examples of cancers for treatment include melanoma (e.g., metastatic malignant melanoma), renal cancer (e.g. clear cell carcinoma), prostate cancer (e.g. hormone refractory prostate adenocarcinoma), breast cancer, colon cancer and lung cancer (e.g. non-small cell lung cancer). Additionally, refractory or recurrent malignancies can be treated using the molecules described herein.

In one aspect, the disclosure pertains to a method of treating cancer in a subject. In one aspect, the cancer associated with expression of a cancer associate antigen as described herein is a hematological cancer. In one aspect, the hematological cancer is a leukemia or a lymphoma. In one aspect, a cancer associated with expression of a cancer associate antigen as described herein includes cancers and malignancies including, but not limited to, e.g., one or more acute leukemias including but not limited to, e.g., B-cell acute Lymphoid Leukemia ("BALL"), T-cell acute Lymphoid Leukemia ("TALL"), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of a cancer associate antigen as described herein include, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with a cancer associate antigen as described herein expression include, but not limited to, e.g., atypical and/or non-classical cancers, malignancies, precancerous conditions or proliferative diseases associated with expression of a cancer associate antigen as described herein.

In some embodiments, a cancer that can be treated is multiple myeloma. Generally, myeloma cells are thought to be negative for a cancer associate antigen as described herein expression by flow cytometry. Thus, in some embodiments, a cell further engineered to express a CAR as described herein, e.g., a CD19 CAR or BCMA CAR as described herein, may be used to target myeloma cells. In some embodiments, cars of the present disclosure therapy can be used in combination with one or more additional therapies, e.g., lenalidomide treatment.

In various aspects, the immune effector cells (e.g., T cells, NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell or NK cell to the patient.

The disclosure also includes a type of cellular therapy where immune effector cells (e.g., T cells, NK cells) are further modified, e.g., by in vitro transcribed RNA, to transiently express a chimeric antigen receptor (CAR) and the CAR T cell or NK cell is infused to a recipient in need thereof. The infused cell is able to kill tumor cells in the recipient. Thus, in various aspects, the immune effector cells (e.g., T cells, NK cells) administered to the patient, is present for less than one month, e.g., three weeks, two weeks, one week, after administration of the T cell or NK cell to the patient.

Without wishing to be bound by any particular theory, the anti-tumor immunity response elicited by the CAR-modified immune effector cells (e.g., T cells, NK cells) may be an active or a passive immune response, or alternatively may be due to a direct vs indirect immune response. In one aspect, the CAR transduced immune effector cells (e.g., T cells, NK cells) exhibit specific proinflammatory cytokine secretion and potent cytolytic activity in response to human cancer cells expressing the a cancer associate antigen as described herein, resist soluble a cancer associate antigen as described herein inhibition, mediate bystander killing and mediate regression of an established human tumor. For example, antigen-less tumor cells within a heterogeneous field of a cancer-associated antigen as described herein-expressing tumor may be susceptible to indirect destruction (e.g., destruction of a precursor cell) by a cancer-associated antigen as described herein-redirected immune effector cells (e.g., T cells, NK cells) that has previously reacted against adjacent antigen-positive cancer cells.

Ex vivo procedures are well known in the art and are discussed more fully below. Briefly, cells are isolated from a mammal (e.g., a human) and genetically modified (i.e., transduced or transfected in vitro) with a gRNA molecule of the disclosure, and optionally, a vector expressing a CAR disclosed herein. The modified cell can be administered to a mammalian recipient to provide a therapeutic benefit. The mammalian recipient may be a human and the cell can be autologous with respect to the recipient. Alternatively, the cells can be allogeneic with respect to the recipient.

The procedure for ex vivo expansion of hematopoietic stem and progenitor cells is described in U.S. Pat. No. 5,199,942, incorporated herein by reference, can be applied to the cells of the present disclosure. Other suitable methods are known in the art, therefore the present disclosure is not limited to any particular method of ex vivo expansion of the cells. Briefly, ex vivo culture and expansion of immune effector cells (e.g., T cells, NK cells) comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

Procedures for ex vivo expansion of immune effector cells, e.g., T cells, are described, for example, in WO2015/142675, the contents of which are hereby incorporated by reference in their entirety. Such procedures may be useful when used in conjunction with the methods described herein.

In addition to using a cell-based vaccine in terms of ex vivo immunization, the present disclosure also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified immune effector cells (e.g., T cells, NK cells) of the disclosure are used in the treatment of diseases, disorders and conditions associated with expression of a cancer associate antigen as described herein. In certain aspects, the cells of the disclosure are used in the treatment of patients at risk for developing diseases, disorders and conditions associated with expression of a cancer associate antigen as described herein. Thus, the present disclosure provides methods for the treatment or prevention of diseases, disorders and conditions associated with expression of a cancer associate antigen as described herein comprising administering to a subject in need thereof, a therapeutically effective amount of the CAR-modified immune effector cells (e.g., T cells, NK cells) of the disclosure.

In one aspect the cells of the disclosure, including the cells further engineered to express a CAR, may be used to treat a proliferative disease such as a cancer or malignancy or is a precancerous condition such as a myelodysplasia, a myelodysplastic syndrome or a preleukemia. Further a disease associated with a cancer associate antigen as described herein expression include, but not limited to, e.g., atypical and/or non-classical cancers, malignancies, precancerous conditions or proliferative diseases expressing a cancer associated antigen as described herein. Non-cancer related indications associated with expression of a cancer associate antigen as described herein include, but are not limited to, e.g., autoimmune disease, (e.g., lupus), inflammatory disorders (allergy and asthma) and transplantation.

The cells (e.g., T cells, NK cells) of the present disclosure may be administered either alone, or as a pharmaceutical composition in combination with diluents and/or with other components such as IL-2 or other cytokines or cell populations.

Hematologic Cancer

Hematological cancer conditions are the types of cancer such as leukemia, lymphoma, and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

The present disclosure also provides methods for inhibiting the proliferation or reducing a cancer associated antigen as described herein-expressing cell population, the methods comprising contacting a population of cells comprising a cancer associated antigen as described herein-expressing cell with a cell of the disclosure (e.g., an NK cell or T cell) further engineered to express a CAR that binds to the a cancer associated antigen as described herein-expressing cell. In a specific aspect, the present disclosure provides methods for inhibiting the proliferation or reducing the population of cancer cells expressing a cancer associated antigen as described herein, the methods comprising contacting a cancer associate antigen as described herein-expressing cancer cell population with a T cell or NK cell of the disclosure further engineered to express a CAR that binds to a cancer associated antigen as described herein-expressing cell. In one aspect, the present disclosure provides methods for inhibiting the proliferation or reducing the population of cancer cells expressing a cancer associated antigen as described herein, the methods comprising contacting a cancer associated antigen as described herein-expressing cancer cell population with a T cell or NK cell of the disclosure further engineered to express a CAR that binds to a cancer associated antigen as described herein-expressing cell. In certain aspects, T cell or NK cell of the disclosure reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with a cancer associated antigen as described herein-expressing cells relative to a negative control. In one aspect, the subject is a human.

The present disclosure also provides methods for preventing, treating and/or managing a disease associated with a cancer associated antigen as described herein-expressing cells (e.g., a hematologic cancer or atypical cancer expressing a cancer associated antigen as described herein), the methods comprising administering to a subject in need a T cell or NK cell of the disclosure, including those further engineered to express a CAR that binds to a cancer associated antigen as described herein-expressing cell. In one aspect, the subject is a human. Non-limiting examples of disorders associated with a cancer associated antigen as described herein-expressing cells include autoimmune disorders (such as lupus), inflammatory disorders (such as allergies and asthma) and cancers (such as hematological cancers or atypical cancers expressing a cancer associated antigen as described herein).

The present disclosure also provides methods for preventing, treating and/or managing a disease associated with a cancer associated antigen as described herein-expressing cells, the methods comprising administering to a subject in need a T cell or NK cell of the disclosure, including those further engineered to express a CAR that binds to a cancer associated antigen as described herein-expressing cell. In one aspect, the subject is a human.

The present disclosure provides methods for preventing relapse of cancer associated with a cancer associated antigen as described herein-expressing cells, the methods comprising administering to a subject in need thereof a T cell or NK cell of the disclosure, including those further engineered to express a CAR that binds to a cancer associated antigen as described herein-expressing cell. In one aspect, the methods comprise administering cell in combination with an effective amount of another therapy.

Pharmaceutical Compositions and Treatments

Pharmaceutical compositions disclosed herein may comprise a cell, e.g., a plurality of cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextran, mannitol; proteins; polypeptides or amino acids such as glycine; antioxidants; chelating agents such as EDTA or glutathione; adjuvants (e.g., aluminium hydroxide); and preservatives. Compositions of the present disclosure are in one aspect formulated for intravenous administration.

Pharmaceutical compositions disclosed herein may comprise a nucleic acid, e.g., a gRNA or a vector as disclosed herein, in combination with one or more pharmaceutically or physiologically acceptable carriers, diluents or excipients.

Pharmaceutical compositions of the present disclosure may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present disclosure to be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated immune effector cells (e.g., T cells, NK cells) to a subject and then subsequently redraw blood (or have an apheresis performed), activate immune effector cells (e.g., T cells, NK cells) therefrom according to the present disclosure, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the T cell compositions of the present disclosure are administered to a patient by intradermal or subcutaneous injection. In one aspect, the T cell compositions of the present disclosure are administered by i.v. injection. The compositions of immune effector cells (e.g., T cells, NK cells) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These T cell isolates may be expanded by methods known in the art and treated as described herein thereby creating a T cell of the disclosure. Subjects in need thereof may subsequently undergo standard treatment with high dose chemotherapy followed by peripheral blood stem cell transplantation. In certain aspects, following or concurrent with the transplant, subjects receive an infusion of the expanded T cells of the present disclosure. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. The dose for CAM-PATH, for example, will generally be in the range 1 to about 100 mg for an adult patient, usually administered daily for a period between 1 and 30 days. The preferred daily dose is 1 to 10 mg per day although in some instances larger doses of up to 40 mg per day may be used (described in U.S. Pat. No. 6,120,766).

In one aspect, CAR-expressing cells of the present disclosures are generated using lentiviral viral vectors, such as lentivirus. Cells, e.g., CARTs, generated that way will have stable CAR expression.

In one aspect, CAR-expressing cells, e.g., CARTs, are generated using a viral vector such as a gammaretroviral vector, e.g., a gammaretroviral vector described herein. CARTs generated using these vectors can have stable CAR expression.

In one aspect, CARTs transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the T cell by electroporation.

A potential issue that can arise in patients being treated using transiently expressing CAR immune effector cells (e.g., T cells, NK cells) (particularly with murine scFv bearing CARTs) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CART infusion breaks should not last more than ten to fourteen days.

Methods of Making Modified CAR-Expressing Cells

In an embodiment, the disclosure pertains to a method of making a cell (e.g., an immune effector cell or population thereof) comprising introducing into (e.g., transducing) a cell a gRNA molecule to a TET2 intron (e.g., to a sequence within a sequence of Table 3), e.g., a gRNA molecule comprising a targeting domain listed in Table 1 or Table 2 and introducing into said cell template nucleic acid comprising sequence encoding a CAR (e.g., as described herein). In embodiments, the sequence encoding the CAR is integrated into the genome at or near the target sequence of the gRNA molecule. In embodiments, the heterologous nucleic acid sequence integrated or near said site does not comprise an element of a lentiviral vector (e.g., does not comprise a cPPT or CPT element).

In another aspect, the disclosure pertains to a method of making a cell (e.g., an immune effector cell or population thereof) comprising introducing into (e.g., transducing) a cell, e.g., a T cell or a NK cell described herein, with a vector of comprising a nucleic acid encoding a CAR, e.g., a CAR described herein; or a nucleic acid encoding a CAR molecule e.g., a CAR described herein.

The cell in the methods is an immune effector cell (e.g., a T cell or a NK cell, or a combination thereof). In some embodiments, the cell in the methods is diaglycerol kinase (DGK) and/or Ikaros deficient.

In some embodiments, the introducing the nucleic acid molecule encoding a CAR comprises transducing a vector comprising the nucleic acid molecule encoding a CAR, or transfecting the nucleic acid molecule encoding a CAR, wherein the nucleic acid molecule is an in vitro transcribed RNA.

In some embodiments, the method further comprises:
providing a population of immune effector cells (e.g., T cells or NK cells); and
removing T regulatory cells from the population, thereby providing a population of T regulatory-depleted cells;
wherein steps a) and b) are performed prior to introducing the nucleic acid encoding the CAR and/or CRISPR system to the population.

In embodiments of the methods, the T regulatory cells comprise CD25+ T cells, and are removed from the cell population using an anti-CD25 antibody, or fragment thereof. The anti-CD25 antibody, or fragment thereof, can be conjugated to a substrate, e.g., a bead.

In other embodiments, the population of T regulatory-depleted cells provided from step (b) contains less than 30%, 25%, 20%, 15%, 10%, 5%, 4%, 3%, 2%, 1% of CD25+ cells.

In yet other embodiments, the method further comprises removing cells from the population which express a tumor antigen that does not comprise CD25 to provide a population of T regulatory-depleted and tumor antigen depleted cells prior to introducing the nucleic acid encoding a CAR to the population. The tumor antigen can be selected from CD19, CD30, CD38, CD123, CD20, CD14 or CD11b, or a combination thereof.

In other embodiments, the method further comprises removing cells from the population which express a checkpoint inhibitor, to provide a population of T regulatory-depleted and inhibitory molecule depleted cells prior to introducing the nucleic acid encoding a CAR or CRISPR system to the population. The checkpoint inhibitor can be chosen from PD-1, LAG-3, TIM3, B7-H1, CD160, P1H, 2B4, CEACAM (e.g., CEACAM-1, CEACAM-3, and/or CEACAM-5), TIGIT, CTLA-4, BTLA, and LAIR1.

Further embodiments disclosed herein encompass providing a population of immune effector cells. The population of immune effector cells provided can be selected based upon the expression of one or more of CD3, CD28, CD4, CD8, CD45RA, and/or CD45RO. In certain embodiments, the population of immune effector cells provided are CD3+ and/or CD28+.

In certain embodiments of the method, the method further comprises expanding the population of cells after the nucleic acid molecule encoding a CAR has been introduced.

In embodiments, the population of cells is expanded for a period of 8 days or less.

In certain embodiments, the population of cells is expanded in culture for 5 days, and the resulting cells are more potent than the same cells expanded in culture for 9 days under the same culture conditions.

In other embodiments, the population of cells is expanded in culture for 5 days show at least a one, two, three or four fold increase in cell doublings upon antigen stimulation as compared to the same cells expanded in culture for 9 days under the same culture conditions.

In yet other embodiments, the population of cells is expanded in culture for 5 days, and the resulting cells exhibit higher proinflammatory IFN-γ and/or GM-CSF levels, as compared to the same cells expanded in culture for 9 days under the same culture conditions.

In other embodiments, the population of cells is expanded by culturing the cells in the presence of an agent that stimulates a CD3/TCR complex associated signal and/or a ligand that stimulates a costimulatory molecule on the surface of the cells. The agent can be a bead conjugated with anti-CD3 antibody, or a fragment thereof, and/or anti-CD28 antibody, or a fragment thereof.

In other embodiments, the population of cells is expanded in an appropriate media that includes one or more interleukin that result in at least a 200-fold, 250-fold, 300-fold, or 350-fold increase in cells over a 14 day expansion period, as measured by flow cytometry.

In other embodiments, the population of cells is expanded in the presence IL-15 and/or IL-7.

In certain embodiments, the method further includes cryopreserving the population of the cells after the appropriate expansion period.

In yet other embodiments, the method of making disclosed herein further comprises contacting the population of immune effector cells with a nucleic acid encoding a telomerase subunit, e.g., hTERT. The nucleic acid encoding the telomerase subunit can be DNA.

The present disclosure also provides a method of generating a population of RNA-engineered cells, e.g., cells described herein, e.g., immune effector cells (e.g., T cells, NK cells), transiently expressing exogenous RNA. The method comprises introducing an in vitro transcribed RNA or synthetic RNA into a cell, where the RNA comprises a nucleic acid encoding a CAR molecule described herein.

In another aspect, the disclosure pertains to a method of providing an anti-tumor immunity in a subject comprising administering to the subject an effective amount of a cell comprising a CAR molecule, e.g., a cell expressing a CAR molecule described herein. In one embodiment, the cell is an autologous T cell or NK cell. In one embodiment, the cell is an allogeneic T cell or NK cell. In one embodiment, the subject is a human.

In one aspect, the disclosure includes a population of autologous cells that are transfected or transduced with a vector comprising a nucleic acid molecule encoding a CAR molecule, e.g., as described herein. In one embodiment, the vector is a retroviral vector. In one embodiment, the vector is a self-inactivating lentiviral vector as described elsewhere herein. In one embodiment, the vector is delivered (e.g., by transfecting or electroporating) to a cell, e.g., a T cell or a NK cell, wherein the vector comprises a nucleic acid molecule encoding a CAR of the present disclosure as described herein, which is transcribed as an mRNA molecule, and the CARs of the present disclosure is translated from the RNA molecule and expressed on the surface of the cell.

In another aspect, the present disclosure provides a population of CAR-expressing cells, e.g., CAR-expressing immune effector cells (e.g., T cells or NK cells). In some embodiments, the population of CAR-expressing cells comprises a mixture of cells expressing different CARs. For example, in one embodiment, the population of CAR-expressing immune effector cells (e.g., T cells or NK cells) can include a first cell expressing a CAR having an antigen binding domain that binds to a first tumor antigen as described herein, and a second cell expressing a CAR having a different antigen binding domain that binds to a second tumor antigen as described herein. As another example, the population of CAR-expressing cells can include a first cell expressing a CAR that includes an antigen binding domain that binds to a tumor antigen as described herein, and a second cell expressing a CAR that includes an antigen binding domain to a target other than a tumor antigen as described herein. In one embodiment, the population of CAR-expressing cells includes, e.g., a first cell expressing a CAR that includes a primary intracellular signaling domain, and a second cell expressing a CAR that includes a secondary signaling domain, e.g., a costimulatory signaling domain.

In another aspect, the present disclosure provides a population of cells wherein at least one cell in the population expresses a CAR having an antigen binding domain that binds to a tumor antigen as described herein, and a second cell expressing another agent, e.g., an agent which enhances the activity of a CAR-expressing cell. For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta. In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, LAG-3, CTLA-4, CD160, BTLA, LAIR1, TIM-3, CEACAM (e.g., CEACAM-1, CEACAM-3 and/or CEACAM-5), 2B4 and TIGIT, or a fragment of any of these, and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28, CD27, OX40 or 4-IBB signaling domain described herein and/or a CD3 zeta signaling domain described herein).

In one embodiment, the nucleic acid molecule encoding a CAR of the present disclosure molecule, e.g., as described herein, is expressed as an mRNA molecule. In one embodiment, the genetically modified CAR of the present disclosure-expressing cells, e.g., immune effector cells (e.g., T cells, NK cells), can be generated by transfecting or electroporating an RNA molecule encoding the desired CARs (e.g., without a vector sequence) into the cell. In one embodiment, a CAR of the present disclosure molecule is translated from the RNA molecule once it is incorporated and expressed on the surface of the recombinant cell.

A method for generating mRNA for use in transfection involves in vitro transcription (IVT) of a template with specially designed primers, followed by polyA addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a polyA tail, typically 50-2000 bases in length (SEQ ID NO: 10555). RNA so produced can efficiently transfect different kinds of cells. In one embodiment, the template includes sequences for the CAR. In an embodiment, an RNA CAR vector is transduced into a cell, e.g., a T cell or a NK cell, by electroporation.

XII. Methods of Manufacture

The disclosure provides methods of manufacturing cells, e.g., T cells, e.g., allogeneic T cells, e.g., CAR-engineered cells modified, or to be modified, with the gRNA molecules described herein.

Introduction of CRISPR Systems

The disclosure comprises cells, e.g., immune effector cells, e.g., allogeneic or autologous cells, which comprise, or at one time comprised, one or more gRNA molecules as described herein. The CRISPR systems described herein may be introduced into the cells by any of the methods described herein. The cells may further be engineered to express a CAR as described herein.

In one aspect, the disclosure provides a method for making a cell comprising:
- a) introducing a gRNA molecule, or nucleic acid encoding said gRNA molecule, e.g., as described herein (e.g., comprising a targeting domain comprising a sequence complementary to a target sequence within a region specified in Table 3 or e.g., comprising a targeting domain listed in Table 1 or Table 2) into said cell;
- b) introducing a Cas9 molecule as described herein, or nucleic acid encoding said Cas9 molecule, into said cell;
- c) introducing nucleic acid encoding a CAR into said cell (e.g., a template nucleic acid comprising sequence encoding a CAR); and
- d) expanding and activating the cells.

In embodiments, steps a), b) and c) occur together (e.g., are performed in one step, e.g., the gRNA molecule and the Cas9 protein are introduced as a ribonuclear protein (RNP) complex and the template nucleic acid are introduced together, e.g., by electroporation). In embodiments, the introduction of a) and b) (e.g., by electroporation of an RNP) occur before steps c) (e.g., via a transfection) and d). In embodiments, the introduction of c) (e.g., via transfection) occurs before the introduction of a) and b) (e.g., by electroporation of an RNP). In embodiments, the introduction of c) and the expanding and activating of d) occurs before the introduction of a) and b). In embodiments, the method further comprises e) selecting the cells which are CAR-expressing. In embodiments, the method further comprises f) selecting the cells which have reduced or eliminated function or expression of the gene targeted by the gRNA molecule of step a). For example, if the gRNA molecule comprises a targeting domain complementary to a target sequence in a TET2 intron or intron-exon junction (e.g., comprises a targeting domain comprising, e.g., consisting of, a sequence listed in Table 1 or Table 2, insertion of the nucleic acid sequence encoding the CAR may occur at or near the target sequence of the gRNA molecule of step a), and the cell may have reduced function, e.g., catalytic function, of TET2.

Expansion and Activation of Cells

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005, each of which is incorporated by reference in its entirety.

Generally, a population of immune effector cells e.g., T regulatory cell depleted cells, may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besançon, France) can be used as can other methods commonly known in the art (Berg et al., *Transplant Proc.* 30(8):3975-3977, 1998; Haanen et al., *J. Exp. Med.* 190(9):13191328, 1999; Garland et al., *J. Immunol Meth.* 227(1-2):53-63, 1999).

In embodiments in which the cells have reduced or absent levels of expression or levels of a component of the TCR, activation may be achieved through means other than interaction with CD3. In cells which further express a CAR, activation may be achieved by contacting said cells with the antigen bound by the antigen-binding domain of the CAR, or a fragment thereof capable of binding the CAR. Such antigen or fragment thereof may be present on, for example, an antibody scaffold, a cell (e.g., an antigen presenting cell, e.g., a cell which naturally expresses said antigen or one which has been artificially engineered to express said antigen on its cell surface), or a solid support such as a bead or membrane.

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present disclosure.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present disclosure, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In one aspect, more anti-CD28 antibody is bound to the particles than anti-CD3 antibody, i.e., the ratio of CD3:CD28 is less than one. In certain aspects, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present disclosure. In particular, ratios will vary depending on particle size and on cell size and type. In one aspect, the most typical ratios for use are in the neighborhood of 1:1, 2:1 and 3:1 on the first day.

In further aspects, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present disclosure. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells of the disclosure, e.g., cells comprising or which at any time comprised or will comprise a gRNA molecule as described herein, e.g., said cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells are expanded for 5 days show at least a one, two, three or four fold increase in cells doublings upon antigen stimulation as compared to the same cells expanded in culture for 9 days under the same culture conditions. In one embodiment, the cells are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, manufacturing methods for cells of the disclosure, e.g., cells comprising or which at any time comprised or will comprise a gRNA molecule as described herein, e.g., said cells expressing a CAR, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein. In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments the cells of the disclosure, e.g., cells comprising or which at any time comprised or will comprise a gRNA molecule as described herein, e.g., said cells expressing a CAR as described herein, are contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a cell described herein is contacted with a composition comprising an IL-15 polypeptide during the manufacturing of the cell, e.g., ex vivo. In embodiments, a cell described herein is contacted with a composition comprising a combination of both a IL-15 polypeptide and a IL-15 Ra polypeptide during the manufacturing of the CAR-expressing cell, e.g., ex vivo. In embodiments, a cell described herein is contacted with a composition comprising hetIL-15 during the manufacturing of the CAR-expressing cell, e.g., ex vivo.

In one embodiment the cells of the disclosure, e.g., cells comprising or which at any time comprised or will comprise a gRNA molecule as described herein, e.g., said cells expressing a CAR as described herein, is contacted with a composition comprising hetIL-15 during ex vivo expansion. In an embodiment, the cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a cell of the disclosure has been engineered to express a CAR described herein is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a CAR and/or cell expressing CAR are described in further detail below Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of $CD4^+$ and $CD8^+$ T cells) expressing the CARs are expanded in vitro for more than 10 days followed by lysis and SDS-PAGE under reducing conditions. CARs containing the full length TCR-cytoplasmic domain and the endogenous TCR-chain are detected by western blotting using an antibody to the TCR-t chain. The same T cell subsets are used for SDS-PAGE analysis under non-reducing conditions to permit evaluation of covalent dimer formation.

In vitro expansion of $CAR^+$ T cells following antigen stimulation can be measured by flow cytometry. For example, a mixture of $CD4^+$ and $CD8^+$ T cells are stimulated with αCD3/αCD28 aAPCs followed by transduction with lentiviral vectors expressing GFP under the control of the promoters to be analyzed. Exemplary promoters include the CMV IE gene, EF-1a, ubiquitin C, or phosphoglycerokinase (PGK) promoters. GFP fluorescence is evaluated on day 6 of culture in the CD4$^+$ and/or CD8$^+$ T cell subsets by flow cytometry. See, e.g., Milone et al., Molecular Therapy 17(8): 1453-1464 (2009). Alternatively, a mixture of CD4$^+$ and CD8$^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either a cancer associated antigen as described herein$^+$ K562 cells (K562 expressing a cancer associated antigen as described herein), wild-type K562 cells (K562 wild type) or K562 cells expressing hCD32 and 4-1BBL in the presence of anti-CD3 and anti-CD28 antibody (K562-BBL-3/28) following washing. Exogenous IL-2 is added to the cultures every other day at 100 IU/ml. GFP$^+$ T cells are enumerated by flow cytometry using bead-based counting. See, e.g., Milone et al., Molecular Therapy 17(8): 1453-1464 (2009).

Sustained CAR$^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CART activity. For example, xenograft model using human a cancer associated antigen described herein-specific CAR$^+$ T cells to treat a primary human pre-B ALL in immunodeficient mice can be used. See, e.g., Milone et al., Molecular Therapy 17(8): 1453-1464 (2009). Very briefly, after establishment of ALL, mice are randomized as to treatment groups. Different numbers of a cancer associated antigen-specific CAR engineered T cells are coinjected at a 1:1 ratio into NOD-SCID-γ$^{-/-}$ mice bearing B-ALL. The number of copies of a cancer associated antigen-specific CAR vector in spleen DNA from mice is evaluated at various times following T cell injection. Animals are assessed for leukemia at weekly intervals. Peripheral blood a cancer associate antigen as described herein$^+$ B-ALL blast cell counts are measured in mice that are injected with a cancer associated antigen described herein-ζ CAR$^+$ T cells or mock-transduced T cells. Survival curves for the groups are compared using the log-rank test. In addition, absolute peripheral blood CD4$^+$ and CD8$^+$ T cell counts 4 weeks following T cell injection in NOD-SCID-γ$^{-/-}$ mice can also be analyzed. Mice are injected with leukemic cells and 3 weeks later are injected with T cells engineered to express CAR by a bicistronic lentiviral vector that encodes the CAR linked to eGFP. T cells are normalized to 45-50% input GFP$^+$ T cells by mixing with mock-transduced cells prior to injection, and confirmed by flow cytometry. Animals are assessed for leukemia at 1-week intervals. Survival curves for the CAR$^+$ T cell groups are compared using the log-rank test.

Dose dependent CAR treatment response can be evaluated. See, e.g., Milone et al., Molecular Therapy 17(8): 1453-1464 (2009). For example, peripheral blood is obtained 35-70 days after establishing leukemia in mice injected on day 21 with CAR T cells, an equivalent number of mock-transduced T cells, or no T cells. Mice from each group are randomly bled for determination of peripheral blood a cancer associate antigen as described herein$^+$ ALL blast counts and then killed on days 35 and 49. The remaining animals are evaluated on days 57 and 70.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing a cancer associated antigen described herein (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8$^+$ T cell expansion ex vivo. T cells are enumerated in cultures using CountBright™ fluorescent beads (Invitrogen, Carlsbad, CA) and flow cytometry as described by the manufacturer. CAR$^+$ T cells are identified by GFP expression using T cells that are engineered with eGFP-2A linked CAR-expressing lentiviral vectors. For CAR+ T cells not expressing GFP, the CAR+ T cells are detected with biotinylated recombinant a cancer associate antigen as described herein protein and a secondary avidin-PE conjugate. CD4+ and CD8$^+$ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, CA) according the manufacturer's instructions. Fluorescence is assessed using a FACScalibur flow cytometer, and data is analyzed according to the manufacturer's instructions.

Cytotoxicity can be assessed by a standard 51Cr-release assay. See, e.g., Milone et al., Molecular Therapy 17(8): 1453-1464 (2009). Briefly, target cells (K562 lines and primary pro-B-ALL cells) are loaded with 51Cr (as NaCrO4, New England Nuclear, Boston, MA) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, MA). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/γc$^{-/-}$ (NSG) mice are injected IV with Nalm-6 cells followed 7 days later with T cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR$^+$ T cells in Nalm-6 xenograft model can be measured as the following: NSG mice are injected with Nalm-6 transduced to stably express firefly luciferase, followed by a single tail-vein injection of T cells electroporated with CAR 7 days later. Animals are imaged at various time points post injection. For example, photon-density heat maps of firefly luciferase-positive leukemia in representative mice at day 5 (2 days before treatment) and day 8 (24 hr post CAR+ PBLs) can be generated.

Other assays, including those described in the Example section herein as well as those that are known in the art can also be used to evaluate the cells and cells expressing CARs described herein.

Delivery Timing

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Bi-modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety. In an embodiment, the Cas9 molecule and the gRNA molecule are delivered by different modes, or as sometimes referred to herein as differential modes. Different or differential modes, as used herein, refer modes of delivery, that confer different pharmacodynamic or pharmacokinetic properties on the subject component molecule, e.g., a Cas9 molecule, gRNA molecule, template nucleic acid, or payload. E.g., the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure of it to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmacokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance,' safety and efficacy. For example, the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment, the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In an embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

In one aspect, the delivery is accomplished ex vivo.

XIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:
 (i) alteration, e.g., replacement, of one or both of the non-linking phosphate oxygens and/or of one or more of the linking phosphate oxygens in the phosphodiester backbone linkage;
 (ii) alteration, e.g., replacement, of a constituent of the ribose sugar, e.g., of the 2' hydroxyl on the ribose sugar;
 (iii) wholesale replacement of the phosphate moiety with "dephospho" linkers;
 (iv) modification or replacement of a naturally occurring nucleobase, including with a non-canonical nucleobase;
 (v) replacement or modification of the ribose-phosphate backbone;
 (vi) modification of the 3' end or 5' end of the oligonucleotide, e.g., removal, modification or replacement of a terminal phosphate group or conjugation of a moiety, cap or linker; and
 (vii) modification or replacement of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond. As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl. Phosphate Backbone Modifications The Phosphate Group In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $0(CH_2CH_2O)_nCH2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $Ci_{-6}$ alkylene or $Cj$-6 heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $0(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH2CH_2$— amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the F position on the sugar, e.g., alpha-nucleosides. The modified nucleic acids can also include "abasic" sugars, which lack a nucleobase at C—. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with a-L-threofuranosyl-(3'-→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-u,ridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo^U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carb oxymethylaminomethyl-2-thio-uridine (cmnm\s2U), 5-propynyl-uridine, 1-propynyl-pseudouridine, 5-taurinomethyl-uridine (xcm$^5$U), 1-taurinomethyl-pseudouridine, 5-taurinomethyl-2-thio-uridine(Trn$^5$s2U), 1-taurinomethyl-4-thio-pseudouridine, 5-methyl-uridine (m$^5$U, i.e., having the nucleobase deoxythymine), 1-methyl-pseudouridine (ιπι'ψ). 5-methyl-2-thio-uridine (m$^5$ s2U), 1-methyl-4-thio-pseudouridine (m's \l/), 4-thio-1-methyl-pseudouridine, 3-methyl-pseudouridine (m'V), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp$^3$U), 1-methyl-3-(3-amino-3-carboxypropyp-seudouridine 5-(isopentenylaminomethyl)uridine (inm$^5$U), 5-(isopentenylaminomethy])-2-thio-uridine (inm$^5$s2U), a-thio-uridine, 2'-0-methyl-uridine (Urn), 5,2'-0-dimethyl-uridine (m$^5$Um), 2'-0-methyl-pseudouridine (Ψπι), 2-thio-2'-0-methyl-uridine (s2Um), 5-methoxycarbonylmethyl-2'-0-methyl-uridine (mcm$^5$Um), 5-carbamoylmethyl-2'-0-methyl-uridine (ncm$^5$Um), 5-carboxymethylaminomethyl-2'-0-methyl-uridine (cmnm$^5$Um), 3,2'-0-dimethyl-uridine (m$^3$Um), 5-(isopentenylaminomethyl)-2'-0-methyl-uridine (inm$^5$Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), a-thio-cytidine, 2'-0-methyl-cytidine (Cm), 5,2'-0-dimethyl-cytidine (m$^5$Cm), N4-acetyl-2'-0-methyl-cytidine (ac$^4$Cm), N4,2'-0-dimethyl-cytidine (m$^4$Cm), 5-formyl-2'-0-methyl-cytidine (f$^5$Cm), N4,N4,2'-0-trimethyl-cytidine (m$^4_2$Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloipurine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m'A), 2-methyl-adenine (m A), N6-methyl-adenosine (m$^6$A), 2-methylthio-N6-methyl-adenosine (ms2 m$^6$A), N6-isopentenyl-adenosine (i$^6$A), 2-methylthio-N6-isopentenyl-adenosine (ms$^2$i6A), N6-(cis-hydroxyisopentenyl)adenosine (io$^6$A), 2-methylthio-N6-(cis-hydroxyisopentenyl)adenosine (ms2io$^6$A), N6-glycinylcarbamoyl-adenosine (g$^6$A), N6-threonylcarbamoyl-adenosine (t$^6$A), N6-methyl-N6-threonylcarbamoyl-adenosine (m$^6$t$^6$A), 2-methylthio-N6-threonylcarbamoyl-adenosine (ms$^2$g6A), N6,N6-dimethyl-adenosine (m$^6_2$A), N6-hydroxynorvalyl-carbamoyl-adenosine (hn$^6$A), 2-methylthio-N6-hydroxynorvalylcarbamoyl-adenosine (ms2hn$^6$A), N6-acetyl-adenosine (ac$^6$A), 7-methyl-adenine, 2-methylthio-adenine, 2-methoxy-adenine, a-thio-adenosine, 2'-0-methyl-adenosine (Am), N$^6$,2'-0-dimethyl-adenosine (m$^5$Am), N$^6$-Methyl- 2'-deoxyadenosine, N6,N6,2'-0-trimethyl-adenosine (m$^6$2Am), 1,2'-0-dimethyl-adenosine (m'Am), 2'-0-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m'1), wyosine (imG), methylwyosine (mimG), 4-demethyl-wyo"sine (imG-14), isowyosine (imG2), wybutosine (yW), peroxywybutosine (o2yW), hydroxywybutosine (OHyW), undemriodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deazaguanosine (preQo), 7-aminomethyl-7-deaza-guanosine (preQi), archaeosine (G$^+$), 7-deaza-8-aza-guanosine, 6-thioguanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m'G), N2-methyl-guanosine (m$^2$G), N2,N2-dimethyl-guanosine (m$^2$ 2G), N2,7-dimethyl-guanosine (m$^2$,7G), N2, N2,7-dimethyl-guanosine (m$^2$,2, 7G), 8-oxo-guanosine, 7-methyl-8-oxo-guanosine, 1-meth thio-guanosine, N2-methyl-6-thio-guanosine, N2,N2-dimethyl-6-thio-guanosine, a-thio-guanosine, 2'-0-methyl-guanosine (Gm), N2-methyl-2'-0-methyl-guanosine (m¾m), N2,N2-dimethyl-2'-0-methyl-guanosine (m$^2$ 2Gm), 1-methyl-2'-0-methyl-guanosine (m'Gm), N2,7-dimethyl-2'-0-methyl-guanosine (m$^2$,7Gm), 2'-0-methyl-inosine (Im), 1,2'-0-dimethyl-inosine (m'lm), 0$^6$-phenyl-2'-deoxyinosine, 2'-0-ribosylguanosine (phosphate) (Gr(p)), 1-thio-guanosine, 0$^6$-methyl]-guanosine, 0$^6$-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside, wherein U can be an unmodified or modified uridine.

In another embodiment, the 3' terminal U can be modified with a 2' 3' cyclic phosphate, wherein U can be an unmodified or modified uridine. In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, 0- and N-alkylated nucleotides, e.g., N6-methyl adenosine, can be incorporated into the gRNA. In some embodiments, sugar-modified ribonucleotides can be incorporated, e.g., wherein the 2' OH— group is replaced by a group selected from H, —OR, —R (wherein R can be, e.g., methyl, alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F 2'-0-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In an embodiment, a one or more or all of the nucleotides in single stranded overhang of an RNA molecule, e.g., a gRNA molecule, are deoxynucleotides.

Candidate Cas molecules, e.g., Cas9 molecules, candidate gRNA molecules, candidate Cas9 molecule/gRNA molecule complexes, and candidate CRISPR systems, can be evaluated by art-known methods or as described herein. For example, exemplary methods for evaluating the endonuclease activity of Cas9 molecule are described, e.g., in Jinek el al., SCIENCE 2012; 337(6096):8 16-821.

EXAMPLES

Example 1: Assays

Guide Selection

Initial guide selection was performed in silico using a human reference genome and user defined genomic regions of interest (e.g., a gene, an exon of a gene, an intron of a gene, a non-coding regulatory region, etc.), for identifying PAMs in the regions of interest. For each identified PAM, analyses were performed and statistics reported. gRNA molecules were further selected and rank-ordered based on a number of criteria known in the art. gRNA molecules were then tested as described herein for cutting efficiency and indel formation as described herein.

Generation of CRISPR CAR T Cells

Isolated and frozen Pan T cells were thawed and activated with CD3/CD28 beads (CD3/CD28 CTS Dynabeads® 43205D) on day 0. Activated T cells were cultured until day 3 then electroporated to introduce CRISPR/Cas systems in the form of pre-complexed gRNA/Cas9 ribonuclear protein ("RNP"). To form RNP, all RNA samples were heated at 95 C. S. pyogenes CAS9 Protein (NLS CAS9 iPROT106154, 37 µM) was diluted in buffer before tracrRNA (having the sequence: AGCAUAGCAAGUUAAAAUAAGGCUAGU-CCGUUAUCAACUUGAAAAAGUGGCAC CGAGUCG-GUGCUUU (SEQ ID NO: 85); IDT) was added to it. After mixing CAS9 Protein with tracrRNA, the crRNA was added (in each case, each crRNA comprised the sequence nnnnnnnnnnnnnnnnnnnn GUUUUAGAGCUAUGCU (SEQ ID NO: 10562), where the n residues represent the 20 ribonucleic acid residues of the indicated targeting domain sequence; IDT). Where single gRNA molecules were used, unless indicated otherwise, the sequence of the gRNA molecule was nnnnnnnnnnnnnnnnnnnnGUUUUAGAGC-UAGAAAUAGCAAGUUAAAAUAAGGCUAGU CCGUUAUCAACUUGAAAAAGUGGCACCGAGUCG-GUGCUUUU (SEQ ID NO: 10563), where the n residues represent the 20 ribonucleic acid residues of the indicated targeting domain sequence). The precomplexed RNPs were then added to a total of 0.2 million cells, RNP concentration was 1.1 µM. Electroporation was done by neon electroporator using Neon® Transfection System 100 µL Kit (MPK10096) at 1600V, 10 ms, 3 pulses. The cells were kept in culture for 7 more days by using T cell complete medium at 37 C with 5% CO2.

Transfection of HEK-293_Cas9GFP Cells for Primary Guide Screening

Transfection of Cas9GFP-expressing HEK293 cells (HEK-293_Cas9GFP) can be used for primary screening of target specific crRNAs. In this example, target specific crRNAs are designed and selected for primary screening using defined criteria including in silico off-target detection, e.g., as described herein. Selected crRNAs are chemically synthesized and delivered in a 96 well format. HEK-293-Cas9GFP cells are transfected with target crRNAs comprising a flagpole region of SEQ ID NO: 79 in a 1:1 ratio with stock trRNA of SEQ ID NO: 65. The transfection is mediated using lipofection technology according to manufacturer's protocol (DharmaFECT Duo, GE LifeSciences; or RNAiMax, LifeTechnologies). Transfected cells are lysed 24 h following lipofection and editing (e.g., cleavage) is detected within lysates with the T7E1 assay and/or next generation sequencing (NGS; below).

T7E1 Assay

The T7E1 assay is used to detect mutation events in genomic DNA such as insertions, deletions and substitutions created through non-homologous end joining (NHEJ) following DNA cleavage by Cas9 (See Cho et al., Targeted genome engineering in human cells with the Cas9 RNA-guided endonuclease. *Nature Biotechnology.* 2013; 31, 230-232).

Genomic DNA regions that have been targeted for cutting by CRISPR/Cas9 are amplified by PCR, denatured at 95° C. for 10 minutes, and then re-annealed by ramping down from 95° C. to 25° C. at 0.5° C. per second. If mutations are present within the amplified region, the DNA is combined to form heteroduplexes. The re-annealed heteroduplexes are then digested with T7E1 (New England Biolabs) at 37° C. for 1 hour. T7E1 endonuclease recognizes DNA mismatches, heteroduplexes and nicked double stranded DNA and generates a double stranded break at these sites. The resulting DNA fragments are analyzed using a Fragment Analyzer and quantified to determine cleavage efficiency.

Next-Generation Sequencing (NGS) and Analysis for On-Target Cleavage Efficiency and Indel Formation To determine the efficiency of editing (e.g., cleaving) the target location in the genome, deep sequencing is utilized to identify the presence of insertions and deletions introduced by non-homologous end joining.

PCR primers are first designed around the target site, and the genomic area of interest PCR amplified. Additional PCR is performed according to manufacturer's protocols (Illumina) to add the necessary chemistry for sequencing. The amplicons are then sequenced on an Illumina MiSeq instrument. The reads are then aligned to the human reference genome (e.g., hg38) after eliminating those having low quality scores. From the resulting files containing the reads mapped to the reference genome (BAM files), reads which overlap the target region of interest are selected and the number of wild type reads versus the number of reads which contain an insertion or deletion is calculated. The editing percentage is then defined as the total number of reads with insertions or deletions over the total number of reads, including wild type. To determine the pattern of insertions and/or deletions that result from the edit, the aligned reads with indels are selected and the number of a reads with a given indel are summed. This information is then displayed as a list as well as visualized in the form on histograms which represent the frequency of each indel.

RNP Generation

The addition of crRNA and trRNA (for a dgRNA), or chimeric gRNA (for sgRNA) to Cas9 protein results in the formation of the active Cas9 ribonucleoprotein complex (RNP), which mediates binding to the target region specified by the crRNA and specific cleavage of the targeted genomic DNA. This complex is formed by loading trRNA and crRNA into Cas9, which is believed to cause conformational changes to Cas9 allowing it to bind and cleave dsDNA.

The crRNA and trRNA are separately denatured at 95° C. for 2 minutes, and are allowed to come to room temperature. Cas9 protein (10 mg/ml) is added to 5×CCE buffer (20 mM HEPES, 100 mM KCl, 5 mM $MgCl_2$, 1 mM DTT, 5% glycerol), to which trRNA and crRNAs is added (in separate reactions) and incubated at 37° C. for 10 minutes, thereby forming the active RNP complex. The complex is delivered by electroporation and other methods into a wide variety of cells, including HEK-293 and CD3+ T cells.

Delivery of RNPs to T cells

CD3+ T cells are comprised of multiple T cell populations including CD4+ T helper cells and CD8+ cytotoxic T cells. These cells can be isolated from whole blood or from leukophoresis samples. T cells can be modified to specifically target cancerous cells and to be less immunogenic, by engineering patient T cells using Cas9-mediated editing. This example describes a basic method used to deliver Cas9 RNP, for example, Cas9 RNP targeting a TET2 intron, in T cells. Only the targeting crRNA in the RNP would need to be changed to adapt this protocol to a different T cell target (e.g., any of those provided herein).

T cells are first enriched from a leukopak using a commercially available kit (e.g., EasySep™ Human T Cell Isolation Kit, Stem Cell Technology). Enriched T cells are aliquoted and frozen down (at $10 \times 10^6$/vial) for future use. Vials are subsequently thawed as needed, and activated by addition of 3:1 ratio of CD3/CD28 beads (Dynabeads, Life Technologies) or using ImmunoCult Human CD3/CD28 T cell Activator (Stem Cell Technologies) in T cell media (RPMI 1640, FBS, L-glutamine, non-essential amino acids, sodium pyruvate, HEPES buffer, 2-mercaptoethanol and optionally IL2). RNPs are generated as described herein, and are added to ~50,000-100,000 CD3+ T cells resuspended in P3 buffer and nucleofected using the Amaxa nucleofection program EO-115. T cell media is added to cells immediately post-nucleofection and cultured for 24 h or more.

Additional assays, including those for assaying the function of a resulting CAR T cell population, are known in the art and described herein, e.g., cytokine production assay, T cell proliferation assay. See, e.g., WO2017049166A1, which is incorporated by reference in its entirety.

Example 2: Evaluation of Cas9 Variants

Evaluation in CD34+ Hematopoietic Stem Cells

We evaluated 14 purified *Streptococcus pyogenes* Cas9 (SPyCas9) proteins by measuring their efficiency of knocking out the beta-2-microglobulin (B2M) gene in primary human hematopoietic stem cells (HSCs). These proteins were divided into 3 groups: the first group consisted of SPyCas9 variants with improved selectivity (Slaymaker et al. 2015, Science 351: 84 (e1.0, e1.1 and K855A); Kleinstiver et al. 2016, Nature 529: 490 (HF)). The second group consisted of wild type SPyCas9 with different numbers and/or positions of the SV40 nuclear localization signal (NLS) and the 6×Histidine (His6) (SEQ ID NO: 108) or 8×Histidine (His8) (SEQ ID NO: 109) tag with or without a cleavable TEV site, and a SPyCas9 protein with two cysteine substitutions (C80L, C574E), which have been reported to stabilize Cas9 for structural studies (Nishimasu et al. 2014, Cell 156:935). The third group consisted of the same recombinant SPyCas9 produced by different processes (FIG. 1). B2M knockout was determined by FACS and next generation sequencing (NGS).

Methods

Materials

1. Neon electroporation instrument (Invitrogen, MPK5000)
2. Neon electroporation kit (Invitrogen, MPK1025)
3. crRNA (comprising a targeting domain to B2M fused to SEQ ID NO: 79)
4. tracrRNA (SEQ ID NO: 65)
5. Cas9 storage buffer: 20 mM Tris-Cl, pH 8.0, 200 mM KCl, 10 mM $MgCl_2$
6. Bone marrow derived CD34+ HSCs (Lonza, 2M-101C)
7. Cell culture media (Stemcell Technologies, StemSpam SFEM II with StemSpam CC-100)
8. FACS wash buffer: 2% FCS in PBS
9. FACS block buffer: per mL PBS, add 0.5 ug mouse IgG, 150 ug Fc block, 20 uL FCS
10. Chelex suspension: 10% Chelex 100 (bioRad, Cat #142-1253) in $H_2O$
11. Anti-B2M antibody: Biolegend, cat #316304

Process

Thaw and grow the cells following Lonza's recommendations, add media every 2-3 days. On day 5, pellet the cells at 200×g for 15 min, wash once with PBS, resuspend the cells with T-buffer from NEON kit at $2×10^4$/uL, put on ice. Dilute Cas 9 protein with Cas9 storage buffer to 5 mg/ml. Reconstitute crRNA and tracrRNA to 100 uM with $H_2O$. The ribonucleoprotein (RNP) complex is made by mixing 0.8 uL each of CAS 9 protein, crRNA and tracrRNA with 0.6 uL of Cas9 storage buffer, incubate at room temperature for 10 min. Mix 7 uL of HSCs with RNP complex for two minutes and transfer the entire 10 uL into a Neon pipette tip, electroporate at 1700v, 20 ms and 1 pulse. After electroporation, immediately transfer cells into a well of 24-well plate containing 1 ml media pre-calibrated at 37° C., 5% $CO_2$. Harvest cells 72 hrs post-electroporation for FACS and NGS analysis.

FACS: take 250 uL of the cells from each well of 24-well plate, to wells of 96-well U-bottom plate and pellet the cells. Wash once with 2% FCS (fetal calf serum)-PBS. Add 50 uL FACS block buffer to the cells and incubate on ice for 10 minutes, add 1 uL FITC labeled B2M antibody and incubate for 30 minutes. Wash with 150 uL FACS wash buffer once followed by once more with 200 uL FACS wash buffer once. Cells were resuspended in 200 uL FACS buffer FACS analysis.

NGS sample prep: transfer 250 uL of cell suspension from each well of the 24-well plate to a 1.5 ml Eppendorf tube, add 1 mL PBS and pellet the cells. Add 100 uL of Chelex suspension, incubate at 99° C. for 8 minutes and vortex 10 seconds followed by incubating at 99° C. for 8 minutes, vortex 10 seconds. Pellet down the resin by centrifuging at 10,000×g for 3 minutes and the supernatant lysate is used for PCR. Take 4 uL lysate and do PCR reaction with primers flanking the B2M gRNA target sequence using Titanium kit (Clonetech, cat #639208) and follow the manufacturer's instruction. The following PCR conditions are used: 5 minutes at 98° C. for 1 cycle; 15 seconds at 95° C., 15 seconds at 62° C., and 1 minute at 72° C. for 30 cycles; and finally 3 minutes at 72° C. for 1 cycle. The PCR product was used for NGS.

Statistics: The percentage of B2M KO cells by FACS and the percentage of indels by NGS are used to evaluate the CAS 9 cleavage efficiency. The experiment was designed with Cas9 as fixed effect. Each experiment is nested within donors, as nested random effects. Therefore, the mixed linear model was applied for the analysis of FACS and NGS data.

Results

In order to normalize the experimental and donor variations, we graphed the relative activity of each protein to iProt105026, the original design with two SV40 NLS flanking the wild type SPyCas9 and the His6 tag (SEQ ID NO: 108) at the C-terminal of the protein (FIG. 1). The statistical analysis shows that compared with the reference Cas9 protein iProt105026, iProt106331, iProt106518, iProt106520 and iProt106521 are not significantly different in knocking out B2M in HSCs, while the other variants tested (PID426303, iProt106519, iProt106522, iProt106545, iProt106658, iProt106745, iProt106746, iProt106747, iProt106884) are highly significantly different from the reference iProt105026 in knocking out B2M in HSCs. We found that moving the His6 tag (SEQ ID NO: 108) from the C-terminal to N-terminal (iProt106520) did not affect the activity of the protein (FIG. 1). One NLS was sufficient to maintain activity only when it was placed at the C-terminal of the protein (iProt106521 vs. iProt106522, FIG. 1). Proteins purified from process 1 had consistent higher knockout efficiency than those from processes 2 and 3 (iProt106331 vs. iProt106545 & PID426303, FIG. 1). In general, the SPyCas9 variants with a reported improved selectivity were not as active as the wild type SPyCas9 (iProt106745, iProt106746 and iProt106747, FIG. 1). Interestingly iProt106884 did not cut the targeting site. This is consistent with the report by Kleinstiver et al that this variant failed to cut up to 20% of the legitimate targeting sites in mammalian cells (Kleinstiver et al. 2016, Nature 529: 490). Finally, the Cas9 variant with two cysteine substitutions (iProt106518) maintained high levels of enzymatic activity (FIG. 1).

Evaluation in T Cells

Methods

The different S *Pyogenes* Cas9 variants shown in Table 14 were used in these experiments. The structures are also shown in FIG. 1.

TABLE 14

Cas9 variants (NLS =SV40 NLS; Cas9 = S. Pyogenes Cas9 wild type, with any mutations indicated in parenthesis; Cas9e1.1 (as described in Slaymaker et al. 2015, Science 351: 84); GGS = glycine-glycine-serine).

| iprot | CAS9 (His6 disclosed as SEQ ID NO: 108) | Size (Daltons) | Conc (ug/ml) | Molar conc. [uM] |
|---|---|---|---|---|
| 106520 | His6-GGS-NLS-CAS9-NLS | 161696.22 | 6.2 | 38.34 |
| 106518 | NLS-CAS9(C80L, C574E)-NLS-His6 | 161531.04 | 6.5 | 40.24 |
| 106521 | NLS-CAS9-His6 | 160629.9 | 6 | 37.12 |
| 106745 | NLS-CAS9(K855A)-NLS-His6 | 161437.94 | 5.9 | 36.55 |
| 106747 | NLS-CAS9e1.1-NLS-His6 | 161295.74 | 6.5 | 40.3 |
| 106154 (also referred to as 105026) | NLS-CAS9-NLS-His6 | 161495.04 | 5.9 | 36.54 |

PBMC were isolated from human blood (obtained from Hemacare/ALL Cells) by using centrifugation method using Ficoll (GE Healthcare catalog #17-1440-03). Total T cells were isolated from these PBMC's using human Pan T Cell Isolation Kit (Miltenyi Biotec #130-096-535). These cells were aliquoted, frozen using CRYOSTOR CS10 media (Biolife Solution-210102), and stored in liquid nitrogen. These frozen cell aliquots were then thawed in a 37 degree C. water bath for 20 secs and then transferred to a 50 ml conical tube in 10 ml of pre-warmed T cell media and centrifuged at 300 rpm for 5-10 mins at 24 degrees C. to remove the freezing media and resuspended with prewarmed T cell media. These are then activated by using CD3/CD28 beads (DynaBeads Invitrogen Cat #111.41D) at a bead to cell ratio of 3:1 at keeping the cell concentration at 0.5 million/ml and activated using CD3/CD28 beads (Dyna-Beads Invitrogen Cat #111.41D) at bead to cell ratio of 3:1 at 0.5 million/ml concentration of cells.

On Day3 post bead activation, the 200,000 cells are used per electroporation. RNP complex used for T cell genome editing was formed using a 1:2 molar ratio of Cas9 protein to RNA (crRNA and tracRNA). 100 μM crRNA ([targeting domain]-[SEQ ID NO: 79]) and 100 M tracrRNA (SEQ ID NO: 65) were denatured separately at 95° C. for 2 min and cooled to room temperature. In a final volume of 5 μL, 1.4 μL of Cas9 proteins at a concentration of 5.9 μg/μL was mixed with 1.6 μL of reaction buffer (20 mM Tris, pH8.0; 200 mM KCL, 10 mM MgCl2) and mixed with 1 μL of 100 μM tracrRNA at room temperature. Next 1 μL of 100 μM crRNA was added, mixed and incubated for 10 min at 37° C. High efficiency gRNAs targeting TRAC and B2M were used. These RNP's at higher concentrations were used to generate samples of RNP serial dilutions. These RNP dilutions were then used to mix with 200,000 cells in 10 ul of T Buffer (neon transfection system 10 ul Kit). Electroporation was performed by Neon electroporator using Neon® Transfection System 10 uL Kit (MPK1096) at 1600V, 10 ms, 3 pulses. Cells were cultured in T cell media without antibiotics. Cells were taken from each sample pipetted to dissociate them from beads and beads were removed by using 96 welled plate magnet and centrifuged with 100 ul of FACS buffer (Miltenyi MACS buffer catalog #130-092-987 with 0.5% BSA (Miltenyi-catalog #130-091-376) to wash the cells. Cells were then incubated with different antibodies diluted in 100 ul FACS buffer for 30 mins on ice. Cells were then washed two times with 200 ul of FACS buffer. Cells are then resuspended in 150 ul of FACS buffer and run on BD 5 laser Fortessa. Expression of TCR was detected by using anti-CD3-PercpCy5.5 (Ebiosciences 45-0037-42) and expression of B2M was detected by using anti-B2M-APC (316312 Biolegend). Flow cytometry data was analyzed using FlowJo Software.

Results

Figure 2:
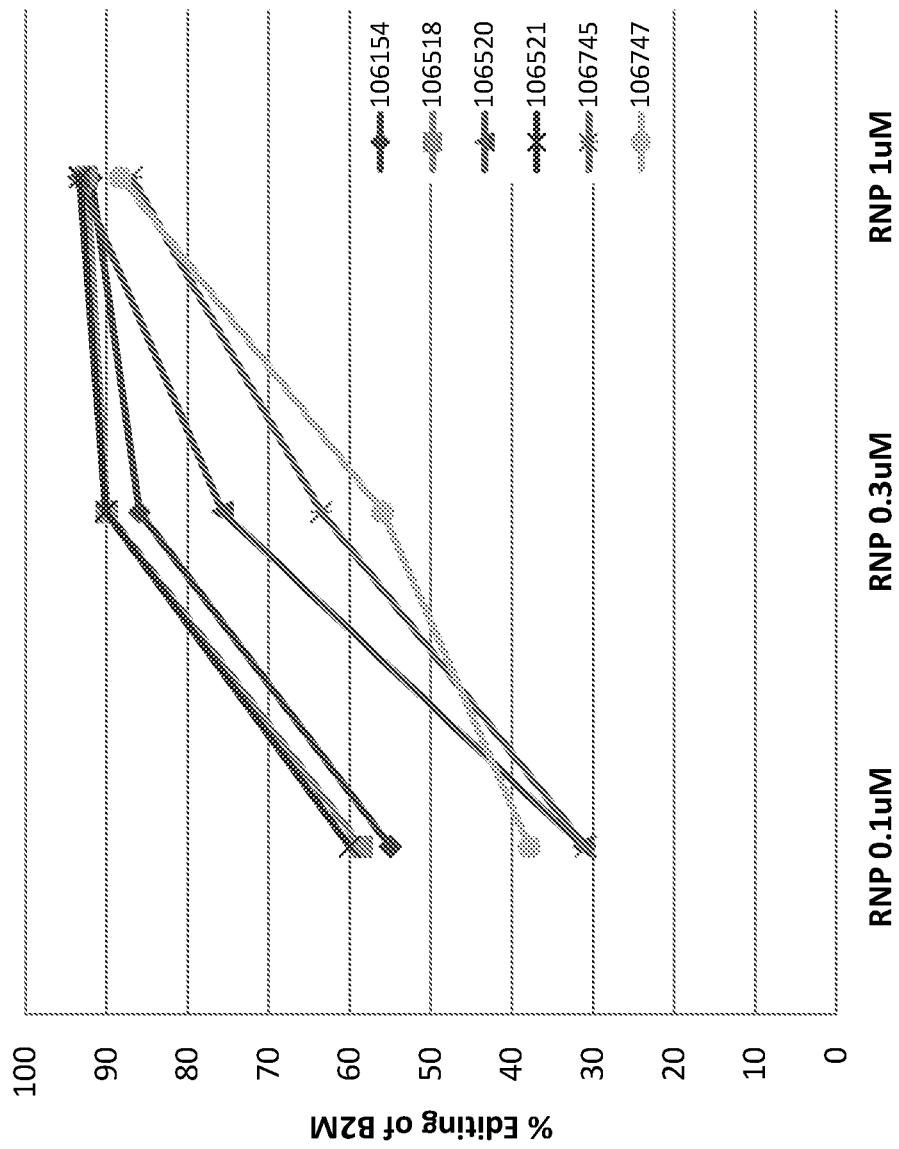
FIG. 2: Editing efficiency at targeted B2M locus in primary human T cells by different Cas9 variants and a range of concentrations, as measured by flow cytometry.
Figure 3:
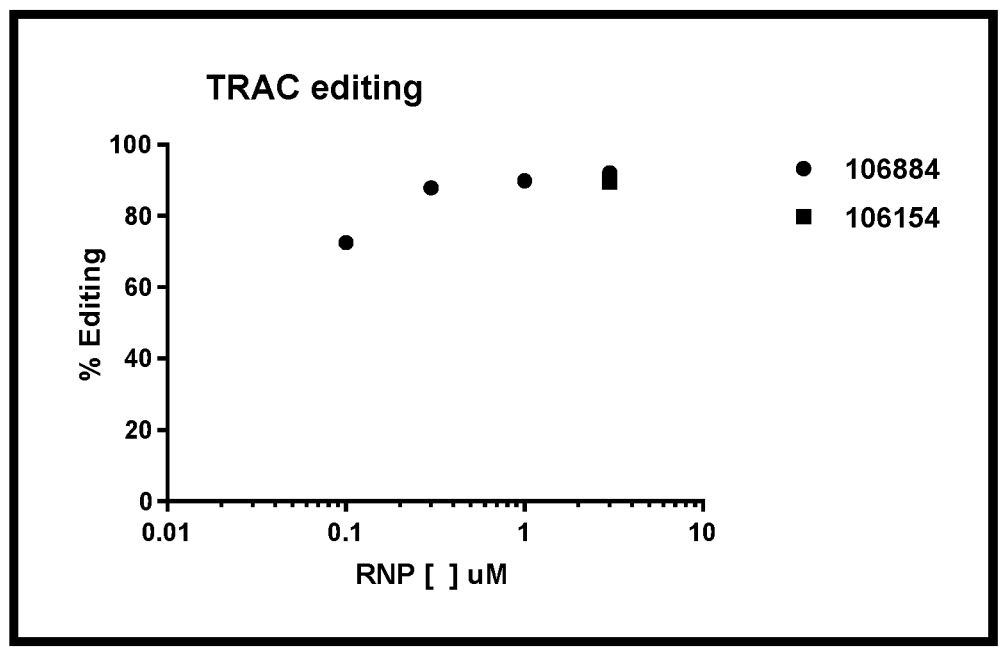
FIG. 3: Editing efficiency of two different Cas9 variants, at various concentrations, in primary human T cells using two different gRNAs targeting either B2M (left panel) or TRAC (right panel). Editing efficiency (% editing) was measured by flow cytometry by measuring the loss of cell surface expression of B2M (left panel) or TCR (right panel).
Figure 3:
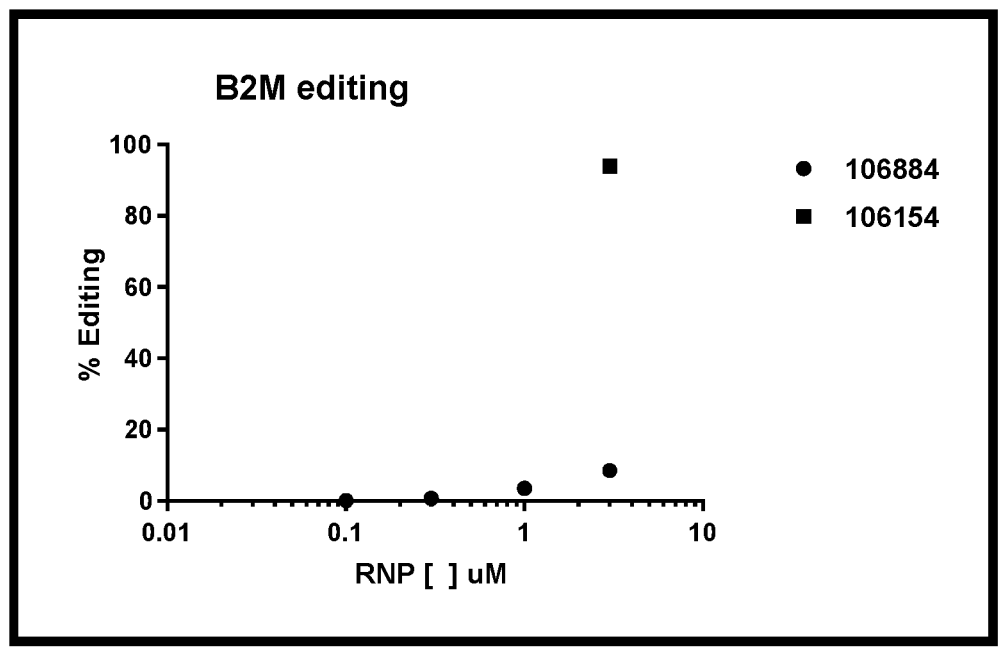

Generation of low concentrations of RNP, and highest editing efficiency, proceeded well when RNP was generated at high concentration, and then diluted to the desired concentrations. 6 different Cas9 proteins were tested for efficiency of editing using the B2M guide in primary T cells. Editing efficiency was measured using cell surface detection by flow cytometry of the B2M protein and the results are shown in FIG. 2 (Y-axis; % Editing of B2M) 3 days after RNP electroporation at the indicated concentrations of RNP (X-axis). The different Cas9 proteins tested are indicated by their "iprot" ID numbers (see FIG. 1 and Table 14). The results are shown in FIG. 2. These data indicate that all of these variants of Cas9 are active, but Cas9 proteins 106521, 106518, and 106154 (also referred to as 105026) show higher activity in T cells, as evidenced by their greater activity at lower concentrations of RNP. Next, two different Cas9 proteins, 106884 or 106154 (also referred to as 105026), as indicated, were tested for editing efficiency using the B2M targeting guide RNA (FIG. 3, left panel) or the TRAC targeting guide (FIG. 3, right panel) by using different concentrations of RNP as indicated on the X-axis. Editing efficiency (% editing) was measured by flow cytometry by measuring the loss of cell surface expression of B2M (FIG. 3, left panel) or TCR using CD3 epsilon antibody (FIG. 3, right panel).

Figure 4:
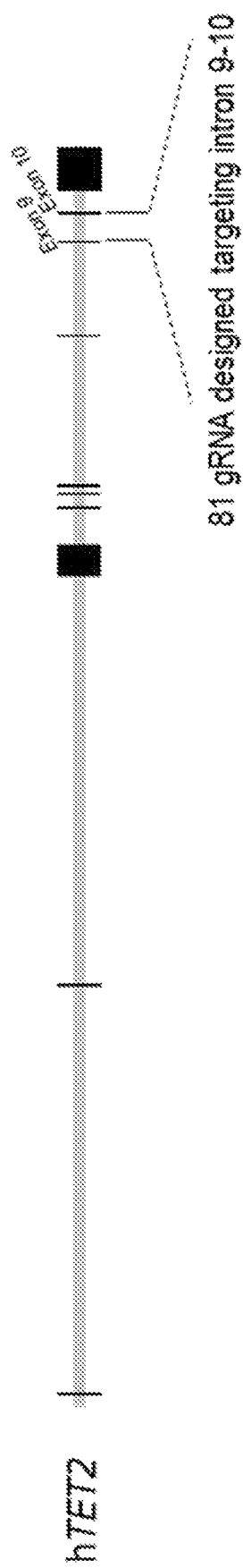
FIG. 4: Schematic for gRNA design targeting intron 9-10 (the intron between exon 9 and exon 10) of hTET2.

Example 3: Targeting EF1α-BCMA10-CAR at TET2 Intron 9-10 in Primary Human T Cells gRNA Design gRNAs for SPyCas9 targeting intron 9-10 of TET2 were designed (see, e.g., Table 1, Table 2). In some embodiments, these sequences may be synthesized as dgRNA. In some embodiments, these sequences may be synthesized as sgRNA.

gRNA molecules comprising targeting domains comprising SEQ ID NOs. 10148, 10149, 10290, 10209, 10224, 10212, 10317, 10318, 10225, 10184, 10185, 10188, 10187, 10292, 10151, 10509, 10281, or 10177 were synthesized in the dual gRNA format (crRNA) for screening cutting efficiency in primary human T cells. These gRNAs contained no repeat sequences more than 30 bp in length present within 200 bp of the 5' and 3' ends of the sgRNA targeting sites. See, e.g., FIG. 4.

gRNA Screening crRNAs were synthesized and reconstituted in ddH$_2$O at 100 uM. TracrRNA (GE/Dhamarcon, Cat # U-002005-20) was reconstituted in ddH$_2$O at 100 uM. 5×10$^6$ primary cryopreserved normal human peripheral blood CD3+ T lymphocytes (AllCells, Cat # PBOO9-1F) were thawed at day 0 and seeded at 1×10$^6$/ml in 6 well plate with X-VIVO15 medium (Lonza, cat #04-744Q) supplemented with 20 ng/ml IL2 (Cat #200-02-50 ug, PeproTech) and 2mMGlutaMax (35050-061, Gibco). Cells were activated with Dynabeads Human T-expander CD3/CD28 (Cat #11141D, Gibco) at 3:1 bead/cell ratio for 3 days.

On day 3, cells were washed and resuspend in T buffer (Neon electroporation buffer) at 2.5×10$^7$ cells/ml. RNP formation was performed by mixing 1 uL NLS-Spy(wt)Cas9-NLS-His6(SEQ ID NO: 111) ("His6" disclosed as SEQ ID NO: 108) (6.2 mg/ml, iProt106331), 1 uL crRNA (100 uM), and 1 uL TracrRNA (100 uM) and incubating at room temperature for 5 mins. 10 uL cells were mixed with 5 uL RNPs, and incubated at room temperature for 2-3 mins.

Electroporation was done by neon electroporator using Neon® Transfection System 100 μL Kit (MPK10096) at 1600V, 10 ms, 3 pulses. Cells were seeded at 1.6×10$^5$ cells/200 μL in a 96-well plate and cultured at 37° C. with 5% CO$_2$.

72 hr following electroporation, cells were debeaded magnetically. Approximately 100-150K cells were spun down, and cell lysate was extracted using approximately 50 μL lysis buffer (10 mMTris-HCL pH 8.0, 0.05% SDS) with proteinase K (100 ng/ml). 2 μL of the cell lysis extract was used to amplify the target sequence via primers and Titanium Taq polymerase (Cat #639242, Clontech), and then analyzed by NGS as described herein. The % editing and indel pattern analysis is described below in Table 22 and Table 23.

Results

Among the gRNAs screened, g1, g45 and g59 had the highest cutting efficiency. However over 30% of mutant alleles created by g59 were 1 nt indels whereas less than 20% created by g1 and less than 5% created by g45 were 1 nt indels. We hypothesized that larger than 1 nt indel pattern promotes homology directed repair (HDR) based on previous observations. Therefore we chose g1 and g45 for targeting the BCMA10 CAR construct.

Example 4: AAV Targeting Vector

Figure 5:
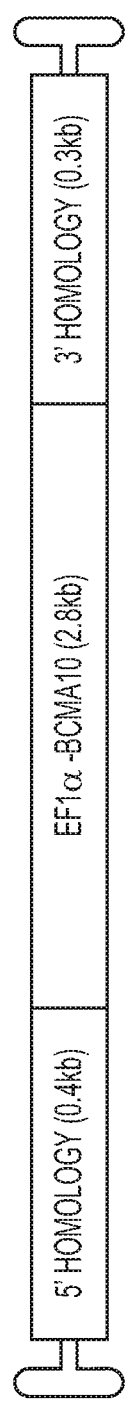
FIG. 5: Schematic for AAV targeting construct (not drawn to scale).

An AAV6-based targeting vector was designed. See, e.g., FIG. 5. The sequence of the knock-in (KI) construct is shown below (SEQ ID NO: 126), with 5' and 3' homology sequences underlined.

<u>gaattcctgttgcaaagtgacctgctttggcataactagcactctcatgataggttggcacattagttt</u>

<u>cctgtcaattgtgttgacaagcacatgagaatcatggaaatccttggtgttaatctaaaccagtgacta</u>

<u>tgcattgccagttacagttaacttccaggaaaatctcaaaattcagtgccagttacctggtagattgta</u>

<u>atcagttaagcaaaaagccaaatacaagccattcaccttacagagagagaagcatattccacctacaga</u>

<u>gagagaagcataaatgagaaacacatcatcattgtcacagtaactgtggtaacctattgtaaaagattc</u>

<u>acagtgcaaaagagcctgactacatattacagtgggtaaaatggatcggtcttgta</u>accggtgcctaga gaaggtggcgcggggtaaactgggaaagtgatgtcgtgtactggctccgccttttcccgagggtgggg gagaaccgtatataagtgcagtagtcgccgtgaacgttctttttcgcaacggggtttgccgccagaacac aggtaagtgccgtgtgtggttcccgcgggcctggcctctttacgggttatggcccttgcgtgccttgaa ttacttccacctggctgcagtacgtgattcttgatcccgagcttcggggttggaagtgggtgggagagtt cgaggccttgcgcttaaggagccccttcgcctcgtgcttgagttgaggcctggcctgggcgctggggcc gccgcgtgcgaatctggtggcaccttcgcgcctgtctcgctgctttcgataagtctctagccatttaaa attttttgatgacctgctgcgacgctttttttctggcaagatagtcttgtaaatgcgggccaagatctgc acactggtatttcggttttttggggccgcgggcggcgacgggcccgtgcgtcccagcgcacatgttcgg cgaggcggggcctgcgagcgcggccaccgagaatcggacgggggtagtctcaagctggccggcctgctc tggtgcctggcctcgcgccgccgtgtatcgccccgccctgggcggcaaggctggcccggtcggcaccag ttgcgtgagcggaaagatggccgcttcccggccctgctgcagggagctcaaaatggaggacgcggcgct cgggagagcgggcgggtgagtcacccacacaaaggaaaagggcctttccgtcctcagccgtcgcttcat gtgactccactgagtaccgggcgccgtccaggcacctcgattagttctcgagcttttggagtacgtcgt ctttaggttggggggagggttttatgcgatggagtttccccacactgagtgggtggagactgaagtta ggccagcttggcacttgatgtaattctccttggaatttgccttttttgagtttggatcttggttcattc tcaagcctcagacagtggttcaaagttttttttcttccatttcaggtgtcgtgatctagaggatccatgg ccctccctgtcaccgccctgctgcttccgctggctcttctgctccacgccgctcggcccgaagtgcaat tggtggaatcaggggggaggacttgtgcagcctggaggatcgctgagactgtcatgtgccgtgtccggct ttgccctgtccaaccacgggatgtcctgggtccgccgcgcgcctggaaagggcctcgaatgggtgtcgg gtattgtgtacagcggtagcacctactatgccgcatccgtgaagggggagattcaccatcagccgggaca actccaggaacactctgtacctccaaatgaattcgctgaggccagaggacactgccatctactactgct ccgcgcatggcggagagtccgacgtctggggacaggggaccaccgtgaccgtgtctagcgcgtccggcg gaggcggcagcgggggtcgggcatcaggggggcggcggatcggacatccagctcacccagtccccgagct cgctgtccgcctccgtgggagatcgggtcaccatcacgtgccgcgccagccagtcgatttcctcctacc tgaactggtaccaacagaagcccggaaaagccccgaagcttctcatctacgccgcctcgagcctgcagt caggagtgccctcacggttctccggctccggttccggtactgatttcaccctgaccatttcctccctgc aaccggaggacttcgctacttactactgccagcagtcgtactccacccctacactttcggacaaggca ccaaggtcgaaatcaagaccactaccccagcaccgaggccacccaccccggctcctaccatcgcctccc agcctctgtccctgcgtccggaggcatgtagaccccgcagctggtggggccgtgcatacccggggtcttg -continued

```
acttcgcctgcgatatctacatttgggcccctctggctggtacttgcggggtcctgctgctttcactcg tgatcactctttactgtaagcgcggtcggaagaagctgctgtacatctttaagcaacccttcatgaggc ctgtgcagactactcaagaggaggacggctgttcatgccggttcccagaggaggaggaaggcggctgcg aactgcgcgtgaaattcagccgcagcgcagatgctccagcctaccagcaggggcagaaccagctctaca acgaactcaatcttggtcggagagaggagtacgacgtgctggacaagcggagaggacgggacccagaaa tgggcgggaagccgcgcagaaagaatccccaagagggcctgtacaacgagctccaaaaggataagatgg cagaagcctatagcgagattggtatgaaaggggaacgcagaagaggcaaaggccacgacggactgtacc agggactcagcaccgccaccaaggacacctatgacgctcttcacatgcaggccctgccgcctcggtaag tcgacgcctcgactgtgccttctagttgccagccatctgttgtttgcccctccccgtgccttccttga ccctggaaggtgccactcccactgtcctttcctaataaaatgaggaaattgcatcgcattgtctgagta ggtgtcattctattctggggggtgggtggggcaggacagcaagggggaggattgggaagacaatagca ggcatgctggggatgcggtgggctctatgggatgaggggaaaatagatacatgttatatatatatat atatatatgttctataccaacaaagggttcagggtataattttgcatgtaaaggggtgacccagagt agagataaagaacaaaatattctgttgaaaaaactatgaatcaatcaacctaatgaattatcaacatgg atgtaggtgtagttgaagaagatggtcagtgagaatatggaaacagatatcaggaattaaagtcatatt ctagggcagaaaagcattcatggaggtattagatgatagctgaagtaatttgaagaagctggtgtgaa
```

The AAV6 virus was generated with a titer of 1.12E+13VG/ml (lot #1935). 5×10⁶ primary cryopreserved normal human peripheral blood CD3+ T lymphocytes (AllCells, Cat # PB009-1F) were thawed at day 0 and seeded at 0.5×10⁶/ml in 6 well plate with X-VIVO15 medium (Lonza, cat #04-744Q) supplemented with 5% heat inactivated pooled human Male AB serum (IPLA_SERAB, Innovative Research), 2 mM of GlutaMax (Cat #35050-061, Gibco), and 5 ng/ml IL2 (Cat #200-02-50 ug PeproTech). Cells were activated with Dynabeads Human T-expander CD3/CD28 (11141D, Gibco) at 1:1 bead/cell ratio for 3 days as explained above.

On day 3, cells were debeaded magnetically, washed with 1×PBS once, and resuspended in T buffer (Neon electroporation buffer) at 2.5×10⁷ cells/ml.

Full-length 100mer sgRNA-g1 and sgRNA-g45 were synthesized. RNP formation was performed by mixing 0.325 uL NLS-Spy(wt)Cas9-NLS-His6 (SEQ ID NO: 111) ("His6" disclosed as SEQ ID NO: 108) (5.9 mg/ml, iProt109296), 0.25 uL sgRNA (100 uM), 4.4 µL buffer (20 mM Tris-Cl pH 8.0, 200 mM KCl, 10 mM MgCl2), and incubating at room temperature for 5-10 mins. 10 uL cells were mixed with 5 uL RNPs, and incubated at room temperature for 2-3 mins.

Electroporation was done by neon electroporator using Neon® Transfection System 100 µL Kit (MPK10096) at 1600V, 10 ms, 3 pulses.

Cells were rested with 160 ul of culture medium in a 96-well plate for an hour at 30° C. with 5% $CO_2$. AAV6 virus was added at a MOI of 2.7×10⁶ viral genome (vg)/cell and incubated at 30° C. for 24 hr., then incubated at 37° C. with 5% $CO_2$.

Fresh culture medium was replenished every 2 to 3 days to maintain the cell density at <0.5-1 million/ml.

Approximately 100-150K cells were taken at Day 7, 10 and 15 for FACS staining and FACS analysis was performed on Fortessa-I10513 using the reagents listed in Table 15.

TABLE 15

| | Cat # | Clone # | Vendor |
|---|---|---|---|
| Human TruStain FcX | 422302 | | BioLegend |
| Cell Staining Buffer | 420201 | | BioLegend |
| BV421 anti-human CD3 | 317344 | OKT3 | BioLegend |
| BV650 anti-human CD4 | 317435 | OKT4 | BioLegend |
| BUV395 anti-human CD8 | 563795 | RPA-T8 | BD Horizon |
| Biotin-Protein L | M00097 | | GenScript |
| R-Phycoerythrin conjugated Streptavidin | 016-110-084 | | Jackson Immuno-Research |
| Live and dead fixable near IR dye | L34975 | | Molecular Probe |

Figure 6:
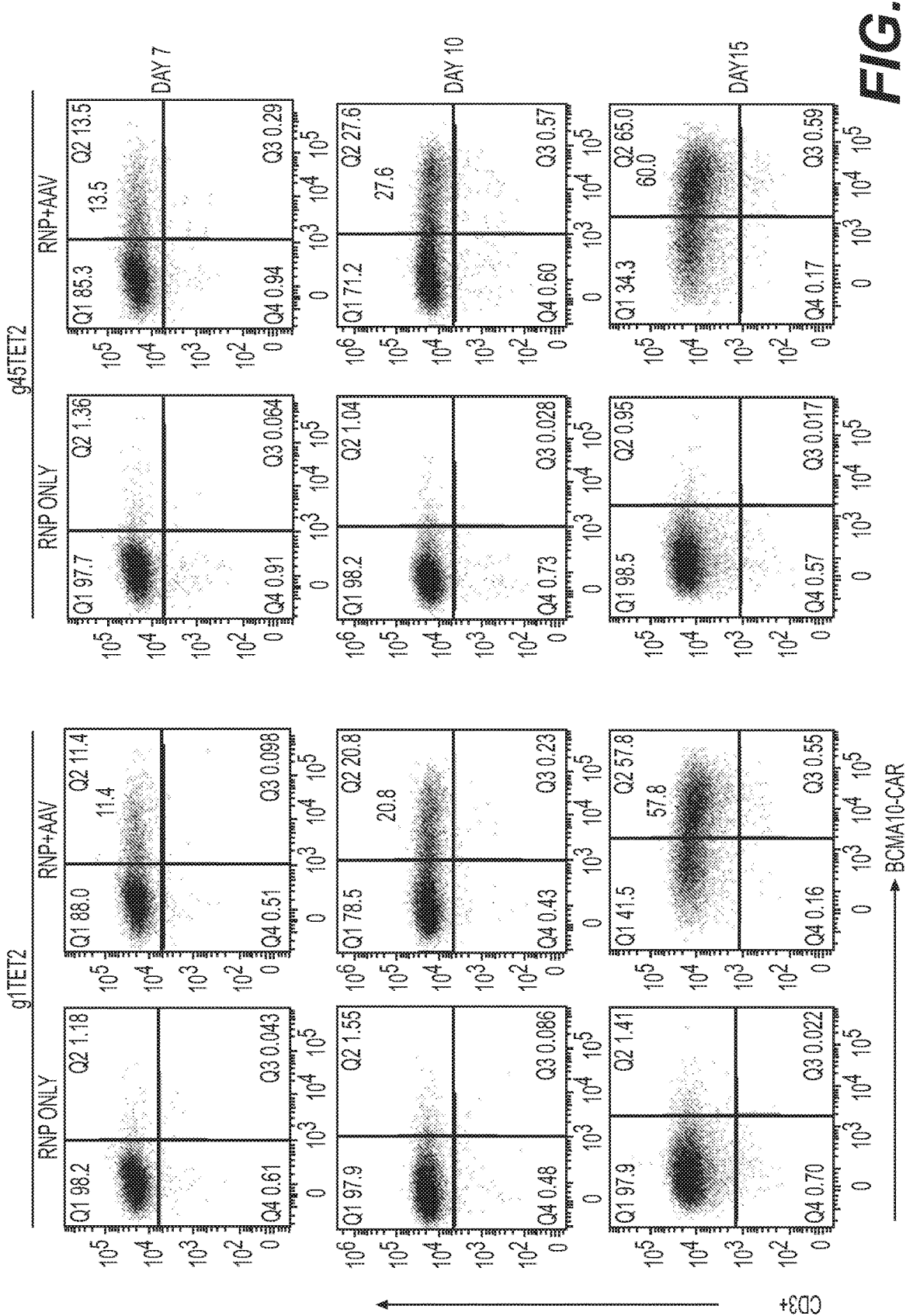
FIG. 6: FACS staining shows that 11.4% of CD3+ cells were BCMA10_CAR+ using g1-RNA and 13.5% using g45-RNA at day 7. The percentage of BCMA10_CAR+ cells increased over time.

Results 11.4% of CD3+ cells were BCMA10_CAR+ using g1-RNA and 13.5% using g45-RNA at day 7. As shown in FIG. 6, the percentage of BCMA10_CAR+ cells increased over time.

Figure 7:
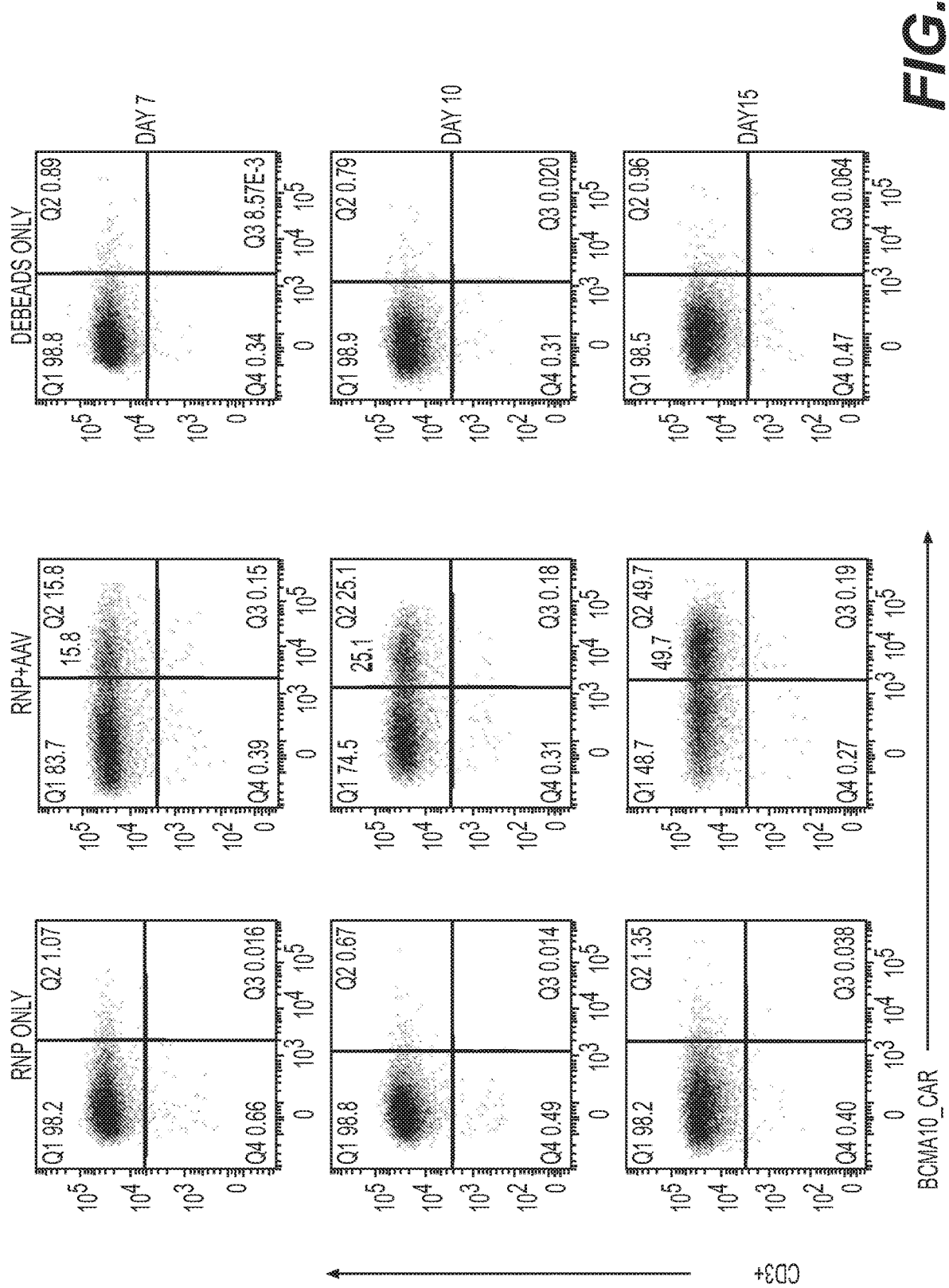
FIG. 7: FACS staining shows CD3+ cells that were BCMA10_CAR+ using g45 and a different donor than used in FIG. 6. The percentage of BCMA10_CAR+ cells increased over time.

The T cell experiment was repeated from a different donor using g45. As shown in FIG. 7, the percentage of BCMA10_CAR+ cells increased over time.

Figure 8:
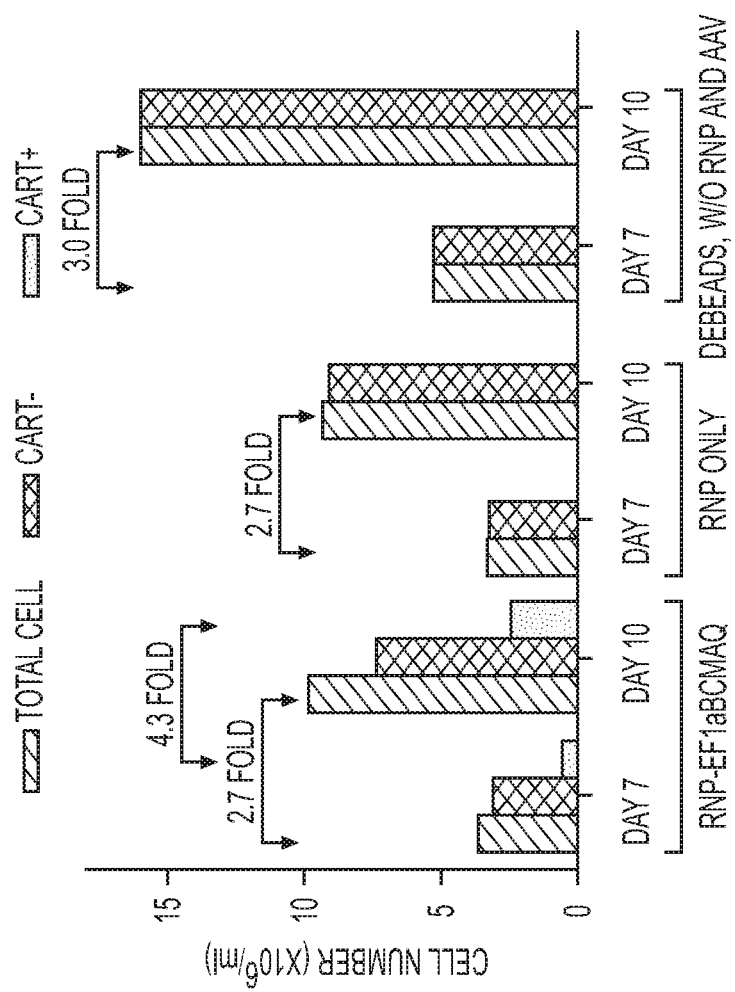
FIG. 8: The total cell fold change is shown for RNP-AAV treated, RNP treated, and debeaded only groups. The expansion of BCMA-CAR+ cells from day 7 to day 10 was slightly faster than the total population (4.3 vs 2.7 fold)

The cell expansion fold change was measured from day 7 to day 10. The total cell fold expansion for RNP-AAV treated, RNP treated, and debeaded only groups were 2.7, 2.7 and 3.0 respectively. There were no dramatic differences between the groups. The expansion of BCMA-CAR+ cells from day 7 to day 10 was slightly faster than the total population (4.3 vs 2.7 fold) (FIG. 8).

PCR Primers

Figure 9:
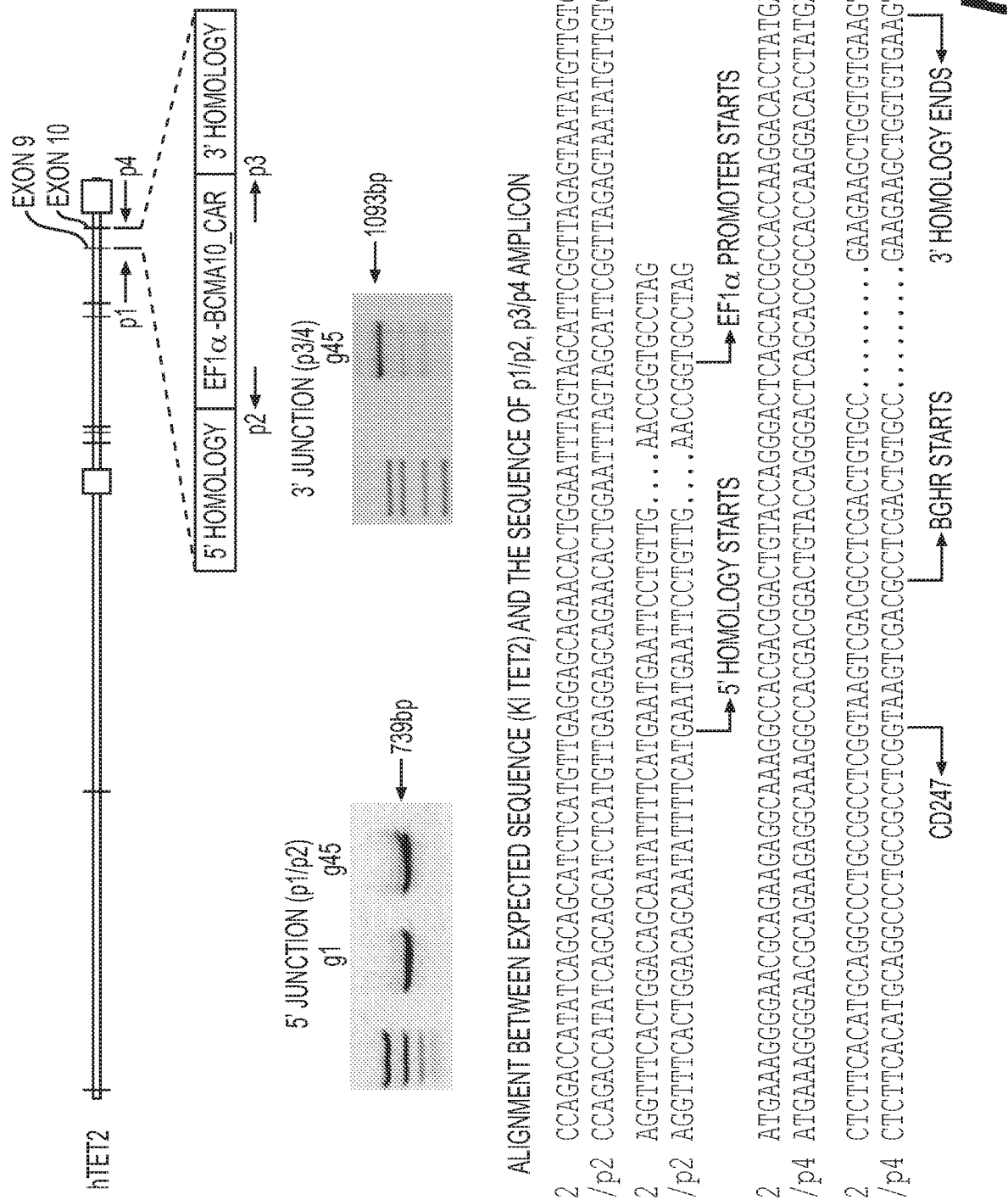
FIG. 9: Schematic of PCR primers designed to amplify from outside of the homology region to the BCMA10_CAR insert in order to confirm correct integration at both 5' and 3' sites (SEQ ID NOS 10557-10558, 10557-10558, 10559-10560, and 10559-10560, respectively, in order of appearance).

To confirm correct integration at both 5' and 3' sites, PCR primers were designed to amplify from outside of the homology region to the BCMA10_CAR insert as shown in FIG. 9. The sequences of the primers are listed in Table 16:

TABLE 16

| Primer | Sequence | PCR amplicon length (bp) |
|---|---|---|
| p1 | 5'-acacagccagaccatatcagcag (SEQ ID NO: 10518) | 739 |
| p2 | 5'-aaggcacgcaagggccataacc (SEQ ID NO: 10519) | |
| P3 | 5'-gaggcctgtgcagactactc (SEQ ID NO: 10520) | 1093 |
| p4 | 5'-acagaaatcctatgtggcctgc (SEQ ID NO: 10521) | |

Cells were harvested at day 10 and lysed in 50-100 ul of cell lysate buffer (10 mMTris-HCL PH=8.0, 0.05% SDS) with proteinase K (100 ng/ml). PCR was performed using Phusion High Fidelity PCR kit (Cat # F553L, ThermoFisher). The PCR conditions are shown below in Table 17 and Table 18:

TABLE 17

| Component | 50 μL reaction |
|---|---|
| ddH$_2$O | 34.5 μL |
| 5× Phusion HF buffer | 10 μL |
| 10 mM dNTP | 1 μL |
| 10 μM primer a | 1 μL |
| 10 μM primer b | 1 μL |
| Cell lysate | 2 μL |
| Phusion DNA Polymerase | 0.5 μL |

TABLE 18

| Cycle step | Temp | Time | Cycles |
|---|---|---|---|
| Initial denaturation | 98° C. | 30 s | 1 |
| Denaturation | 98° C. | 5 s | |
| Annealing | 68° C. | 20 s | 35 |
| Extension | 72° C. | 20 s | |
| Final extension | 72° C. | 1 min | |
| Final step | 14° C. | Hold | |

7 μL of the PCR product was run on a 2% E-gel to confirm the presence of the expected PCR band. Unpurified PCR product was sequenced with both primers.

Example 5: Guide Screening in Human CD3+ T Cells

T cells were first enriched from a leukopak using a commercially available kit (e.g., EasySep™ Human T Cell Isolation Kit, Stem Cell Technology). Enriched T cells are aliquoted and frozen down (at 10×10$^6$/vial) for future use. Vials are subsequently thawed as needed, and activated by addition of 3:1 ratio of CD3/CD28 beads (Dynabeads, Life Technologies, Cat #111.41D) in T cell media (RPMI 1640, FBS, L-glutamine, non-essential amino acids, sodium pyruvate, HEPES buffer, 2-mercaptoethanol and optionally IL2). On day 3 after bead activation, cells were removed from culture for electroporation with RNPs. RNPs are generated as described herein, and are added to ~50,000-100,000 CD3+ T cells resuspended in P3 buffer and nucleofected using the Amaxa nucleofection program EO-115. T cell media is added to cells immediately post-nucleofection and cultured for 48 h prior to cell lysis for NGS analysis.

RNP complex used for T cell genome editing was formed using a 1:2 molar ratio of Cas9 protein to RNA (crRNA and tracRNA). 100 μM crRNA and 100 μM tracrRNA were denatured separately at 95° C. for 2 min and cooled to room temperature. In a final volume of 5 μL, 1.4 μL of Spy Cas9 protein at a concentration of 5.9 μg/μL (Cas9-NLS) was mixed with 1.6 μL of Cas9 buffer (20 mM Tris, pH8.0; 200 mM KCL, 10 mM MgCL2) and mixed with 1 L of 100 μM tracrRNA at room temperature. Next 1 μL of 100 μM crRNA was added, mixed and incubated for 10 min at 37° C. The assembled RNPs were then mixed with 100,000 cells in 20 ul of P3 Buffer and nucleofected using the Amaxa nucleofection program EO-115. T cell media is added to cells immediately post-nucleofection and cultured for 48 h prior to cell lysis for NGS analysis. Two biological replicates with at least 3 technical replicates per run were performed for each guide.

To evaluate the editing frequency, genomic DNA was isolated and subjected to sequencing as described in Example 1. Four positive control guides were included in the experiment. The results are provided below in Table 19.

TABLE 19

| Target | Guide ID | Coordinate | Strand | gRNA targeting domain sequence | SEQ ID NO: | Average edit (%) | SD (%) |
|---|---|---|---|---|---|---|---|
| Tet2 | CR007665 | chr4: 105271340-105271360 | + | GAAGUAGUAAAUGAUAACUG | 10191 | 45.3% | 17.0% |
| Tet2 | CR007697 | chr4: 105270694-105270714 | + | UAUAUGUUCUAUACCAACAA | 10153 | 42.9% | 27.0% |
| Tet2 | CR007626 | chr4: 105270624-105270643 | + | UGGAUCGGUCUUGUAAUUGG | 10148 | 42.3% | 10.2% |
| Tet2 | CR007671 | chr4: 105270350-105270370 | − | ACUGGUUUAGAUUAACACCA | 10259 | 39.3% | 10.0% |
| Tet2 | CR007684 | chr4: 105272182-105272202 | − | UGUGAAGCCUCUUCAAAAAC | 10314 | 35.6% | 9.5% |
| Tet2 | CR007633 | chr4: 105271863-105271883 | + | UUUCAGAGUACCCACUUAUA | 10206 | 27.1% | 6.3% |
| Tet2 | CR007677 | chr4: 105271203-105271223 | − | AGUUAGGAAACCAGAACCUA | 10515 | 26.8% | 6.7% |

TABLE 19-continued

| Target | Guide ID | Coordinate | Strand | gRNA targeting domain sequence | SEQ ID NO: | Average edit (%) | SD (%) |
|---|---|---|---|---|---|---|---|
| Tet2 | CR007691 | chr4: 105272465-105272485 | + | ACACAAAUCUGAAUACUGAG | 10234 | 26.7% | 14.2% |
| Tet2 | CR007634 | chr4: 105270695-105270715 | + | AUAUGUUCUAUACCAACAAA | 10154 | 25.9% | 17.1% |
| Tet2 | CR007706 | chr4: 105272324-105272344 | + | GAUAGACUCAGAGAAAGGGU | 10225 | 23.9% | 11.1% |
| Tet2 | CR007703 | chr4: 105271526-105271546 | + | UAUGUAUGGGAAAAGUAACA | 10203 | 23.4% | 9.1% |
| Tet2 | CR007675 | chr4: 105270268-105270288 | + | AUAACUAGCACUCUCAUGAU | 10136 | 20.7% | 14.2% |
| Tet2 | CR007667 | chr4: 105270426-105270446 | - | AUUACAAUCUACCAGGUAAC | 10263 | 20.5% | 8.9% |
| Tet2 | CR007680 | chr4: 105272320-105272340 | + | UCCUGAUAGACUCAGAGAAA | 10223 | 20.3% | 17.2% |
| Tet2 | CR007655 | chr4: 105270144-105270164 | + | CAUGUUGAGGAGCAGAACAC | 10131 | 20.0% | 7.0% |
| Tet2 | CR007632 | chr4: 105272436-105272456 | + | GUCACUGAUCUGGAUCAACU | 10233 | 19.3% | 5.5% |
| Tet2 | CR007648 | chr4: 105271924-105271944 | + | GGUUUGACAGAGUACAAAGG | 10209 | 18.6% | 9.2% |
| Tet2 | CR007637 | chr4: 105270594-105270614 | + | AGCCUGACUACAUAUUACAG | 10143 | 18.5% | 8.8% |
| Tet2 | CR007709 | chr4: 105272323-105272343 | + | UGAUAGACUCAGAGAAAGGG | 10224 | 18.0% | 0.9% |
| Tet2 | CR007695 | chr4: 105271450-105271470 | + | AUUUGCCUCUGAUAGAGCAU | 10196 | 17.9% | 7.2% |
| Tet2 | CR007685 | chr4: 105270330-105270350 | + | AUGAGAAUCAUGGAAAUCCU | 10139 | 16.9% | 5.1% |
| Tet2 | CR007710 | chr4: 105270630-105270649 | + | GGUCUUGUAAUUGGAGGCAG | 10149 | 16.3% | 7.5% |
| Tet2 | CR007636 | chr4: 105271921-105271941 | + | UUAGGUUUGACAGAGUACAA | 10208 | 16.2% | 16.6% |
| Tet2 | CR007676 | chr4: 105270194-105270214 | + | AUGUUGUCUGCAGGUUUCAC | 10134 | 15.8% | 5.2% |
| Tet2 | CR007687 | chr4: 105270809-105270829 | - | AUCCAUGUUGAUAAUUCAUU | 10274 | 15.4% | 7.9% |
| Tet2 | CR007629 | chr4: 105272562-105272582 | - | CUCUAGUGAGAGUGCAUACC | 10489 | 15.2% | 3.9% |
| Tet2 | CR007640 | chr4: 105271855-105271875 | - | GGUACUCUGAAAAGGGUAAG | 10303 | 14.9% | 3.0% |
| Tet2 | CR007627 | chr4: 105271184-105271204 | + | CUGUGAGGCACAUUAGCCGU | 10184 | 14.6% | 7.3% |
| Tet2 | CR007630 | chr4: 105270595-105270615 | + | GCCUGACUACAUAUUACAGU | 10144 | 13.6% | 2.3% |
| Tet2 | CR007650 | chr4: 105270309-105270329 | - | UGCUUGUCAACACAAUUGAC | 10258 | 13.5% | 4.9% |
| Tet2 | CR007699 | chr4: 105272102-105272122 | + | GUGUUCAGAAGUAUGAGAUG | 10213 | 13.4% | 4.1% |
| Tet2 | CR007702 | chr4: 105271378-105271398 | + | AUAUAACCAUGUUUCAUUCC | 10192 | 13.4% | 9.9% |

TABLE 19-continued

| Target | Guide ID | Coordinate | Strand | gRNA targeting domain sequence | SEQ ID NO: | Average edit (%) | SD (%) |
|---|---|---|---|---|---|---|---|
| Tet2 | CR007678 | chr4: 105270433-105270453 | − | UUAACUGAUUACAAUCUACC | 10264 | 13.1% | 2.1% |
| Tet2 | CR007701 | chr4: 105269733-105269753 | + | AUGGCAGCACAUUGGUAAGU | 10102 | 13.0% | No SD |
| Tet2 | CR007638 | chr4: 105272557-105272577 | − | GUGAGAGUGCAUACCUGGUA | 10488 | 12.4% | 3.6% |
| Tet2 | CR007659 | chr4: 105270620-105270640 | + | AAAUGGAUCGGUCUUGUAAU | 10147 | 11.1% | 1.8% |
| Tet2 | CR007705 | chr4: 105271498-105271518 | + | CACUAGAUAAGAACUGAAUA | 10200 | 10.7% | 12.0% |
| Tet2 | CR007641 | chr4: 105270702-105270722 | + | CUAUACCAACAAAGGGUUCA | 10156 | 10.6% | 5.2% |
| Tet2 | CR007679 | chr4: 105272319-105272339 | + | UUCCUGAUAGACUCAGAGAA | 10222 | 10.5% | 1.5% |
| Tet2 | CR007686 | chr4: 105271862-105271882 | − | AUAAGUGGGUACUCUGAAAA | 10306 | 9.9% | 8.3% |
| Tet2 | CR007647 | chr4: 105272515-105272535 | + | UUCUUUGGGACCUGUAGUUG | 10237 | 9.7% | 8.5% |
| Tet2 | CR007635 | chr4: 105270272-105270292 | + | CUAGCACUCUCAUGAUAGGU | 10137 | 9.5% | 3.8% |
| Tet2 | CR007698 | chr4: 105270804-105270824 | + | AACCUAAUGAAUUAUCAACA | 10160 | 9.4% | 3.4% |
| Tet2 | CR007700 | chr4: 105270125-105270145 | − | GAGAUGCUGCUGAUAUGGUC | 10508 | 9.4% | 8.5% |
| Tet2 | CR007661 | chr4: 105272558-105272578 | − | AGUGAGAGUGCAUACCUGGU | 10494 | 8.7% | 3.8% |
| Tet2 | CR007649 | chr4: 105270599-105270619 | − | ACCCACUGUAAUAUGUAGUC | 10270 | 8.5% | 13.3% |
| Tet2 | CR007674 | chr4: 105271512-105271532 | + | UGAAUAGGGUUAAAUAUGUA | 10201 | 8.4% | 9.1% |
| Tet2 | CR007690 | chr4: 105271338-105271358 | + | CAGAAGUAGUAAAUGAUAAC | 10189 | 7.9% | 4.4% |
| Tet2 | CR007670 | chr4: 105270244-105270264 | + | UGUUGCAAAGUGACCUGCUU | 10135 | 6.9% | 10.4% |
| Tet2 | CR007662 | chr4: 105272232-105272252 | + | GCAAGAGAGUGCUUCAUUUU | 10217 | 6.8% | 1.3% |
| Tet2 | CR007643 | chr4: 105270368-105270388 | − | AACUGGCAAUGCAUAGUCAC | 10260 | 6.6% | 3.5% |
| Tet2 | CR007681 | chr4: 105272324-105272344 | − | ACCCUUUCUCUGAGUCUAUC | 10318 | 6.1% | 2.4% |
| Tet2 | CR007657 | chr4: 105270710-105270730 | − | UUAUACCCUGAACCCUUUGU | 10271 | 6.1% | 4.4% |
| Tet2 | CR007683 | chr4: 105272462-105272482 | − | AGUAUUCAGAUUUGUGUUGG | 10322 | 5.5% | 15.5% |
| Tet2 | CR007672 | chr4: 105270131-105270151 | + | AUCAGCAGCAUCUCAUGUUG | 10130 | 5.4% | 2.4% |
| Tet2 | CR007639 | chr4: 105272465-105272485 | − | CUCAGUAUUCAGAUUUGUGU | 10323 | 5.4% | 5.3% |
| Tet2 | CR007642 | chr4: 105270412-105270432 | + | AAAAUUCAGUGCCAGUUACC | 10141 | 5.4% | 3.7% |

TABLE 19-continued

| Target | Guide ID | Coordinate | Strand | gRNA targeting domain sequence | SEQ ID NO: | Average edit (%) | SD (%) |
|---|---|---|---|---|---|---|---|
| Tet2 | CR007651 | chr4: 105270161-105270181 | + | CACUGGAAUUUAGUAGCAUU | 10132 | 5.0% | 4.3% |
| Tet2 | CR007654 | chr4: 105272057-105272077 | + | AACAGAGAGAGUUAGGUGUC | 10212 | 5.0% | 8.5% |
| Tet2 | CR007694 | chr4: 105270464-105270484 | − | UAAGGUGAAUGGCUUGUAUU | 10265 | 4.9% | 9.1% |
| Tet2 | CR007692 | chr4: 105270829-105270849 | + | GUAGGUGUAGUUGAAGAAGA | 10162 | 4.7% | 2.4% |
| Tet2 | CR007653 | chr4: 105270385-105270405 | − | UCCUGGAAGUUAACUGUAAC | 10261 | 4.7% | 1.9% |
| Tet2 | CR007628 | chr4: 105271773-105271793 | − | UACUACAAUUACACUAGCUU | 10297 | 4.6% | 0.8% |
| Tet2 | CR007689 | chr4: 105271863-105271883 | − | UAUAAGUGGGUACUCUGAAA | 10307 | 4.5% | 1.3% |
| Tet2 | CR007707 | chr4: 105271295-105271315 | + | AGCACCUGCUCAUUAUUAGG | 10188 | 4.3% | 3.3% |
| Tet2 | CR007669 | chr4: 105271449-105271469 | + | AAUUUGCCUCUGAUAGAGCA | 10195 | 4.3% | 5.2% |
| Tet2 | CR007658 | chr4: 105270381-105270401 | + | GCCAGUUACAGUUAACUUCC | 10140 | 3.8% | 2.3% |
| Tet2 | CR007696 | chr4: 105271056-105271076 | + | UUAGGGACUGCAGGCCACAU | 10177 | 3.8% | 1.4% |
| Tet2 | CR007712 | chr4: 105271172-105271192 | − | CCUCACAGCUUGUGUUUGUA | 10509 | 3.7% | 1.5% |
| Tet2 | CR007664 | chr4: 105272231-105272251 | + | AGCAAGAGAGUGCUUCAUUU | 10216 | 3.6% | 1.5% |
| Tet2 | CR007688 | chr4: 105272233-105272253 | + | CAAGAGAGUGCUUCAUUUUG | 10218 | 3.5% | 3.1% |
| Tet2 | CR007704 | chr4: 105271256-105271276 | − | AUUUUAGAUGUUGGGGUGGU | 10283 | 3.5% | 3.7% |
| Tet2 | CR007631 | chr4: 105270701-105270721 | + | UCUAUACCAACAAAGGGUUC | 10155 | 3.3% | 1.9% |
| Tet2 | CR007652 | chr4: 105270130-105270150 | − | AACAUGAGAUGCUGCUGAUA | 10522 | 3.0% | 0.9% |
| Tet2 | CR007666 | chr4: 105271458-105271478 | − | CAGAACCCAUGCUCUAUCAG | 10292 | 2.9% | 1.4% |
| Tet2 | CR007708 | chr4: 105271292-105271312 | + | CUCAGCACCUGCUCAUUAUU | 10187 | 2.5% | 4.5% |
| Tet2 | CR007660 | chr4: 105270245-105270265 | − | AAAGCAGGUCACUUUGCAAC | 10256 | 2.5% | 5.9% |
| Tet2 | CR007693 | chr4: 105272528-105272548 | − | GACAUUACAGCCUCAACUAC | 10324 | 2.0% | 1.1% |
| Tet2 | CR007682 | chr4: 105272403-105272423 | + | UAACAGGUAGGAUGGUUUUA | 10231 | 1.9% | 1.3% |
| Tet2 | CR007668 | chr4: 105271081-105271101 | + | UUCUGUCACAUUGUUUGGUG | 10181 | 1.9% | 1.0% |
| Tet2 | CR007656 | chr4: 105270260-105270280 | − | AGUGCUAGUUAUGCCAAAGC | 10257 | 1.8% | 1.3% |
| Tet2 | CR007663 | chr4: 105270722-105270742 | + | GGGUAUAAUUUUGCAUGUAA | 10157 | 1.7% | 1.8% |

TABLE 19-continued

| Target | Guide ID | Coordinate | Strand | gRNA targeting domain sequence | SEQ ID NO: | Average edit (%) | SD (%) |
|---|---|---|---|---|---|---|---|
| Tet2 | CR007625 | chr4: 105271190-105271210 | + | GGCACAUUAGCCGUAGGUUC | 10185 | 1.6% | 0.9% |
| Tet2 | CR007644 | chr4: 105272309-105272329 | − | CUAUCAGGAACAGUUAGCUG | 10317 | 1.6% | 1.3% |
| Tet2 | CR007711 | chr4: 105270635-105270655 | + | GUAAUUGGAGGCAGUGGUGA | 10151 | 1.3% | 1.5% |
| Tet2 | CR007673 | chr4: 105272395-105272415 | + | UUCAUUAAUAACAGGUAGGA | 10230 | 1.2% | 1.4% |
| Tet2 | CR007645 | chr4: 105270185-105270205 | + | UAGAGUAAUAUGUUGUCUGC | 10133 | 0.8% | 0.5% |
| Tet2 | CR007646 | chr4: 105269740-105269760 | + | CACAUUGGUAAGUUGGGCUG | 10104 | N/A | N/A |
| Control 1 | CR001261 | chr1: 55039271-55039291 | − | | | 19.6% | 2.5% |
| Control 2 | CR003187 | chr6: 43770821-43770841 | − | | | 8.4% | 6.9% |
| Control 3 | CR005017 | chr11: 116827093-116827113 | − | | | 18.8% | 3.5% |
| Control 4 | CR005025 | chr2: 176122949-176122969 | − | | | 35.8% | 8.5% |

Figure 10A:
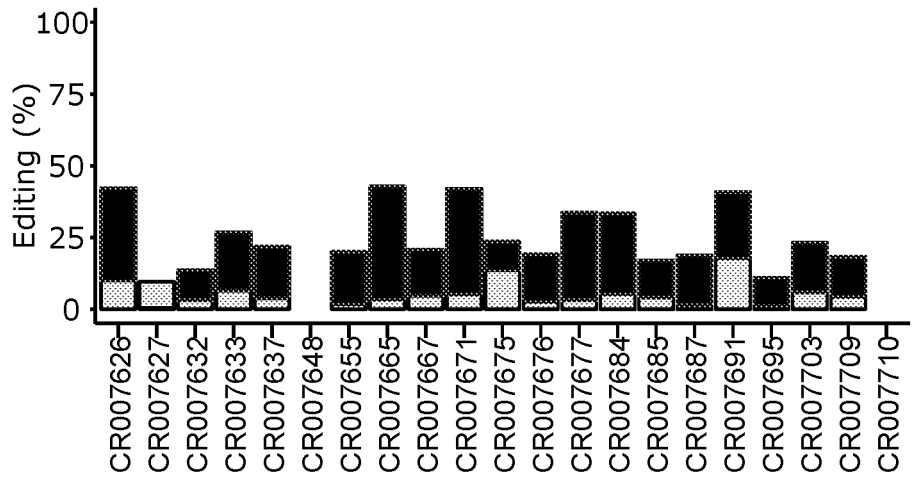
FIG. 10A and FIG. 10B: Exemplary guides were evaluated in CD3+ T cells. For each target site, two sets of primers were designed to amplify each locus. The total percent editing, the percent of insertion and the deletion at each target sequence was determined using NGS.
Figure 10B:
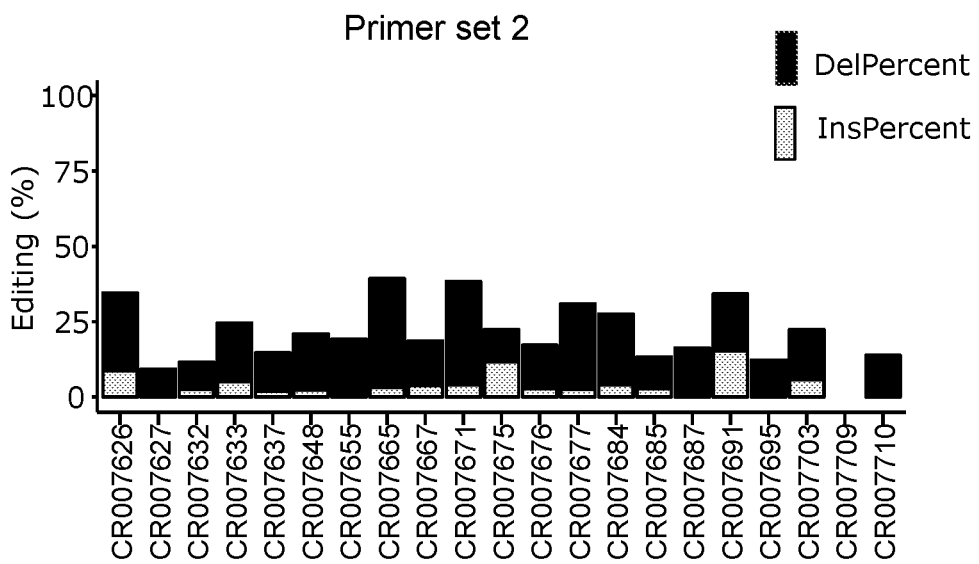

"SD" = standard deviation;
"No SD" = no standard deviation due to only data from one replicate only;
"N/A" = data not available due to technical error Following the initial screen, a subset of the guides in Table 19 were evaluated again in CD3+ T cells, as described in this Example. In this analysis, in addition to total percent editing, the percent of insertion and deletion at each target sequence was determined using NGS. For each target site, two sets of primers were designed to amplify each locus. The results are plotted in FIG. 10A and FIG. 10B.

Example 6: Validation Screen of Insertion and Deletion Percentages by Guide

Figure 11:
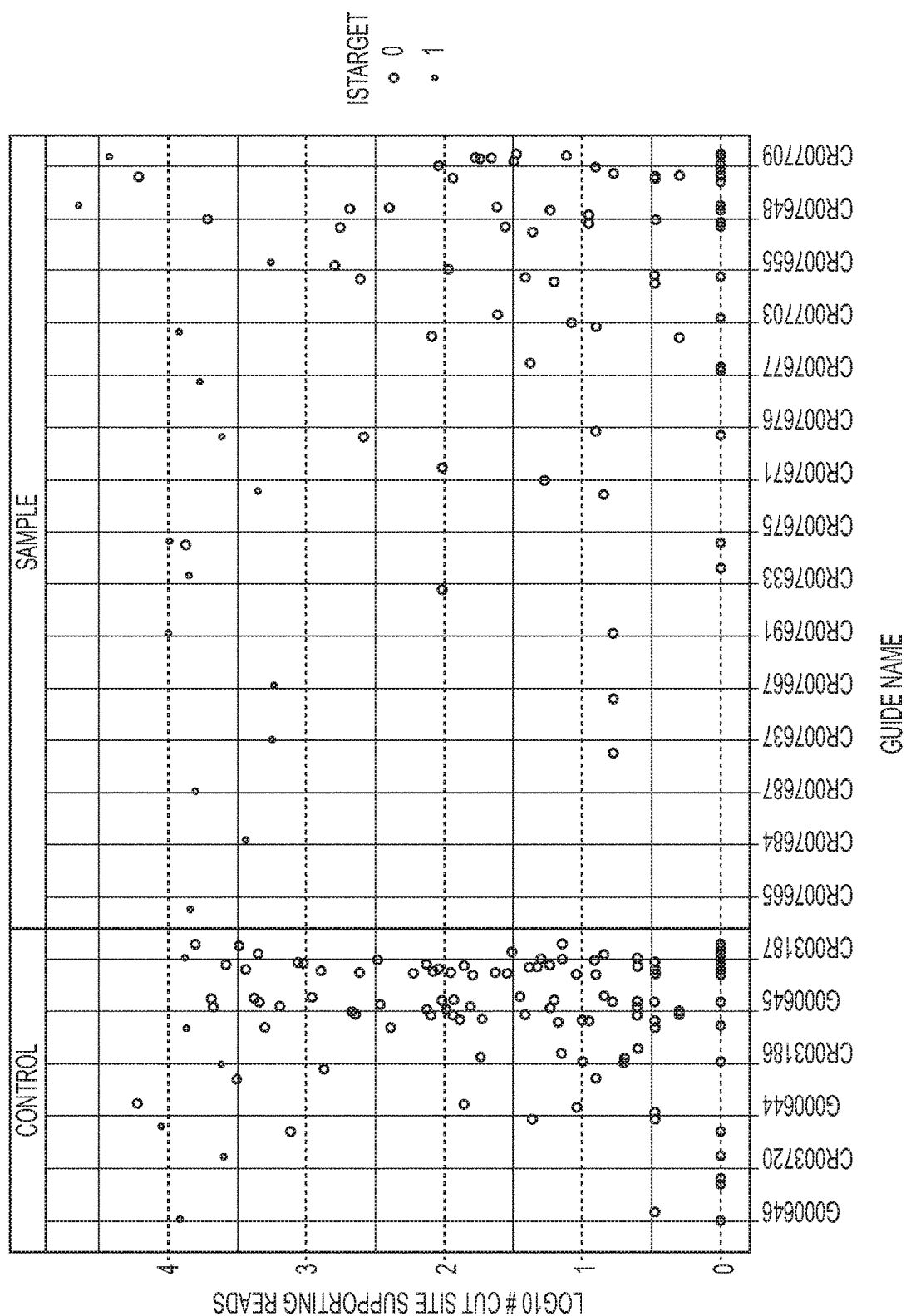
FIG. 11: An oligo insertion-based assay (see, e.g., Tsai et al., Nature Biotechnology. 33, 187-197; 2015) was used to determine potential off-target genomic sites cleaved by Cas9 targeting TET2. Exemplary gRNAs targeting TET2 and control guides were screened in Cas9-expressing HEK293 cells. High-efficiency editing at the expected target sequences, potential off-targets for some of the guides, and no off-targets for three of the guides were detected.

An oligo insertion based assay (see, e.g., Tsai et al., Nature Biotechnology. 33, 187-197; 2015) was used to determine potential off-target genomic sites cleaved by Cas9 targeting TET2. A total of 15 guide RNAs (dual guide RNAs comprising the indicated targeting domain) targeting TET2 and six control guides were screened in the Cas9-expressing HEK293 cells described above in Example 1, and the results are plotted in FIG. 11. The assay detected high-efficiency editing at the expected target sequences, potential off-targets for some of the guides, and no off-targets for three of the guides.

Following the insertional analysis, the potential off-target sites that were identified were further evaluated in the Cas9-expressing HEK293 cells using NGS. In this experiment, the cells were transfected with target crRNAs in a 1:1 ratio with stock trRNA. The transfection was mediated using lipofection technology according to manufacturer's protocol (DharmaFECT Duo, GE LifeSciences; or RNAiMax, LifeTechnologies). Transfected cells were lysed 48 h following lipofection and editing (e.g., cleavage) was detected within lysates with next generation sequencing. Two sets of primers were designed for each site, and the resulting amplicons were sequenced, e.g., as described in Example 1. The results are provided below in Table 20.

TABLE 20

| Guide ID | Site | Coordinate | Strand | primer set | Editing % (average) | SD (%) |
|---|---|---|---|---|---|---|
| CR007633 | ONT | chr4:105271863-105271883 | + | set1 | 32.8 | 7.3 |
| CR007633 | ONT | chr4:105271863-105271883 | + | set2 | 32.2 | 7.2 |
| CR007633 | OT 01 | chrX:8560771-8560791 | + | set1 | 0.1 | 0.1 |
| CR007633 | OT 01 | chrX:8560771-8560791 | + | set2 | 0.1 | 0.1 |
| CR007633 | OT 02 | chr6:109987282-109987302 | − | set1 | 0.1 | 0.0 |
| CR007633 | OT 02 | chr6:109987282-109987302 | − | set2 | 0.1 | 0.0 |
| CR007637 | ONT | chr4:105270594-105270614 | + | set1 | 24.4 | 7.7 |
| CR007637 | ONT | chr4:105270594-105270614 | + | set2 | 26.7 | 8.4 |
| CR007637 | OT 01 | chrX:28732099-28732119 | + | set1 | 0.0 | 0.1 |
| CR007637 | OT 01 | chrX:28732099-28732119 | + | set2 | 0.0 | 0.0 |
| CR007648 | ONT | chr4:105271924-105271944 | + | set1 | 24.3 | 9.1 |
| CR007648 | ONT | chr4:105271924-105271944 | + | set2 | N/A | N/A |

TABLE 20-continued

| Guide ID | Site | Coordinate | Strand | primer set | Editing % (average) | SD (%) |
|---|---|---|---|---|---|---|
| CR007648 | OT 01 | chr1:62607266-62607286 | − | set1 | 0.1 | 0.0 |
| CR007648 | OT 01 | chr1:62607266-62607286 | − | set2 | 0.2 | 0.0 |
| CR007648 | OT 02 | chr12:6968835-6968855 | − | set1 | 0.1 | 0.0 |
| CR007648 | OT 02 | chr12:6968835-6968855 | − | set2 | 0.1 | 0.0 |
| CR007648 | OT 03 | chr17:34641080-34641100 | + | set1 | 0.1 | 0.1 |
| CR007648 | OT 03 | chr17:34641080-34641100 | + | set2 | 0.1 | 0.1 |
| CR007648 | OT 04 | chr8:142442835-142442855 | + | set1 | 0.1 | 0.0 |
| CR007648 | OT 04 | chr8:142442835-142442855 | + | set2 | 0.4 | 0.3 |
| CR007648 | OT 05 | chr1:44389438-44389458 | + | set1 | 0.1 | 0.0 |
| CR007648 | OT 05 | chr1:44389438-44389458 | + | set2 | 0.1 | 0.1 |
| CR007648 | OT 06 | chr16:57756563-57756583 | + | set1 | 0.0 | 0.1 |
| CR007648 | OT 06 | chr16:57756563-57756583 | + | set2 | 0.0 | 0.0 |
| CR007648 | OT 07 | chr20:37957777-37957797 | + | set1 | 0.1 | 0.1 |
| CR007648 | OT 07 | chr20:37957777-37957797 | + | set2 | 0.0 | 0.1 |
| CR007648 | OT 08 | chr5:94847524-94847544 | + | set1 | 0.1 | 0.0 |
| CR007648 | OT 08 | chr5: 94847524-94847544 | + | set2 | 0.0 | 0.1 |
| CR007648 | OT 09 | chr1:149886640-149886660 | + | set1 | 0.1 | 0.1 |
| CR007648 | OT 09 | chr1:149886640-149886660 | + | set2 | 0.2 | 0.0 |
| CR007648 | OT 10 | chr12:79666166-79666186 | + | set1 | 0.1 | 0.0 |
| CR007648 | OT 10 | chr12:79666166-79666186 | + | set2 | 0.1 | 0.1 |
| CR007648 | OT 11 | chr3:157114059-157114079 | + | set1 | 0.0 | 0.0 |
| CR007648 | OT 11 | chr3:157114059-157114079 | + | set2 | 0.0 | 0.0 |
| CR007648 | OT 12 | chr10:43309580-43309600 | + | set1 | 0.0 | 0.1 |
| CR007648 | OT 12 | chr10:43309580-43309600 | + | set2 | 0.0 | 0.1 |
| CR007648 | OT 13 | chr10:81383942-81383962 | − | set1 | 0.0 | 0.0 |
| CR007648 | OT 13 | chr10:81383942-81383962 | − | set2 | N/A | N/A |
| CR007648 | OT 14 | chr6:146406425-146406445 | + | set1 | 0.1 | 0.1 |
| CR007648 | OT 14 | chr6:146406425-146406445 | + | set2 | 0.1 | 0.1 |
| CR007648 | OT 15 | chrX:129530239-129530259 | + | set1 | 0.1 | 0.1 |
| CR007648 | OT 15 | chrX:129530239-129530259 | + | set2 | 0.0 | 0.1 |
| CR007655 | ONT | chr4:105270144-105270164 | + | set1 | 26.5 | 25.0 |
| CR007655 | ONT | chr4:105270144-105270164 | + | set2 | 26.5 | 25.0 |
| CR007655 | OT 01 | chr2:7990552-7990572 | − | set1 | 0.1 | 0.1 |
| CR007655 | OT 01 | chr2:7990552-7990572 | − | set2 | 0.1 | 0.1 |
| CR007655 | OT 02 | chr6:129507282-129507302 | + | set1 | 0.0 | 0.1 |
| CR007655 | OT 02 | chr6:129507282-129507302 | + | set2 | 0.0 | 0.1 |
| CR007655 | OT 03 | chr8:63331060-63331080 | − | set1 | 2.0 | 2.1 |
| CR007655 | OT 03 | chr8:63331060-63331080 | − | set2 | 2.1 | 2.1 |
| CR007655 | OT 04 | chr19:34034589-34034609 | + | set1 | 4.0 | 3.9 |
| CR007655 | OT 04 | chr19:34034589-34034609 | + | set2 | 4.4 | 4.2 |
| CR007655 | OT 05 | chr2:19636770-19636790 | + | set1 | 0.0 | 0.1 |
| CR007655 | OT 05 | chr2: 19636770-19636790 | + | set2 | 0.0 | 0.0 |
| CR007655 | OT 06 | chr21:41298867-41298887 | + | set1 | 0.1 | 0.2 |
| CR007655 | OT 06 | chr21:41298867-41298887 | + | set2 | 0.1 | 0.1 |
| CR007655 | OT 07 | chr1:239287261-239287281 | − | set1 | N/A | N/A |
| CR007655 | OT 07 | chr1:239287261-239287281 | − | set2 | 0.1 | 0.1 |
| CR007655 | OT 08 | chr16:750824-750844 | − | set1 | 0.1 | 0.1 |
| CR007655 | OT 08 | chr16:750824-750844 | − | set2 | 0.1 | 0.1 |
| CR007665 | ONT | chr4:105271340-105271360 | + | set1 | 44.9 | 11.6 |
| CR007665 | ONT | chr4:105271340-105271360 | + | set2 | 46.1 | 11.4 |
| CR007667 | ONT | chr4:105270426-105270446 | − | set1 | 20.5 | 2.3 |
| CR007667 | ONT | chr4:105270426-105270446 | − | set2 | 20.3 | 1.2 |
| CR007667 | OT 01 | chr9:129294818-129294838 | − | set1 | 0.1 | 0.1 |
| CR007667 | OT 01 | chr9:129294818-129294838 | − | set2 | 0.1 | 0.0 |
| CR007671 | ONT | chr4:105270350-105270370 | − | set1 | 24.8 | 2.0 |
| CR007671 | ONT | chr4:105270350-105270370 | − | set2 | 28.2 | 2.9 |
| CR007671 | OT 01 | chr2:224983888-224983908 | − | set1 | 0.1 | 0.1 |
| CR007671 | OT 01 | chr2:224983888-224983908 | − | set2 | 0.1 | 0.0 |
| CR007671 | OT 02 | chr1:34852545-34852565 | + | set1 | N/A | N/A |
| CR007671 | OT 02 | chr1:34852545-34852565 | + | set2 | N/A | N/A |
| CR007671 | OT 03 | chr17:81589930-81589950 | + | set1 | 5.4 | 0.5 |
| CR007671 | OT 03 | chr17:81589930-81589950 | + | set2 | 3.2 | 1.5 |
| CR007675 | ONT | chr4:105270268-105270288 | + | set1 | 33.8 | 4.4 |
| CR007675 | ONT | chr4:105270268-105270288 | + | set2 | 33.0 | 2.8 |
| CR007675 | OT 01 | chrX:7078173-7078193 | − | set1 | 1.6 | 0.2 |
| CR007675 | OT 01 | chrX:7078173-7078193 | − | set2 | 1.6 | 0.1 |
| CR007675 | OT 02 | chr13:33934878-33934898 | + | set1 | 0.0 | 0.1 |
| CR007675 | OT 02 | chr13:33934878-33934898 | + | set2 | 0.0 | 0.0 |
| CR007676 | ONT | chr4:105270194-105270214 | + | set1 | 29.2 | 5.4 |
| CR007676 | ONT | chr4:105270194-105270214 | + | set2 | 30.8 | 5.0 |
| CR007676 | OT 01 | chr1:47907842-47907862 | + | set1 | 0.1 | 0.1 |
| CR007676 | OT 01 | chr1:47907842-47907862 | + | set2 | 0.1 | 0.1 |
| CR007676 | OT 02 | chr12:93080467-93080487 | + | set1 | 0.1 | 0.1 |
| CR007676 | OT 02 | chr12:93080467-93080487 | + | set2 | 0.1 | 0.0 |
| CR007676 | OT 03 | chrX:39677001-39677021 | + | set1 | 0.0 | 0.1 |
| CR007676 | OT 03 | chrX:39677001-39677021 | + | set2 | 0.1 | 0.0 |
| CR007677 | ONT | chr4:105271203-105271223 | − | set1 | 25.1 | 3.5 |

TABLE 20-continued

| Guide ID | Site | Coordinate | Strand | primer set | Editing % (average) | SD (%) |
|---|---|---|---|---|---|---|
| CR007677 | ONT | chr4:105271203-105271223 | − | set2 | 26.3 | 2.9 |
| CR007677 | OT 01 | chr22:43125757-43125777 | + | set1 | 0.1 | 0.1 |
| CR007677 | OT 01 | chr22:43125757-43125777 | + | set2 | 0.1 | 0.1 |
| CR007677 | OT 02 | chr1:175060841-175060861 | − | set1 | 0.1 | 0.1 |
| CR007677 | OT 02 | chr1:175060841-175060861 | − | set2 | N/A | N/A |
| CR007677 | OT 03 | chr11:63558842-63558862 | − | set1 | 0.1 | 0.0 |
| CR007677 | OT 03 | chr11:63558842-63558862 | − | set2 | 0.0 | 0.1 |
| CR007684 | ONT | chr4:105272182-105272202 | − | set1 | 20.5 | 8.8 |
| CR007684 | ONT | chr4:105272182-105272202 | − | set2 | 21.1 | 6.4 |
| CR007687 | ONT | chr4:105270809-105270829 | − | set1 | 40.2 | 12.9 |
| CR007687 | ONT | chr4:105270809-105270829 | − | set2 | 41.5 | 12.6 |
| CR007691 | ONT | chr4:105272465-105272485 | + | set1 | 37.8 | 0.9 |
| CR007691 | ONT | chr4:105272465-105272485 | + | set2 | 38.0 | 1.6 |
| CR007691 | OT 01 | chr5:167581554-167581574 | − | set1 | 0.0 | 0.1 |
| CR007691 | OT 01 | chr5:167581554-167581574 | − | set2 | 0.1 | 0.1 |
| CR007703 | ONT | chr4:105271526-105271546 | + | set1 | 43.8 | 10.1 |
| CR007703 | ONT | chr4:105271526-105271546 | + | set2 | 43.5 | 10.8 |
| CR007703 | OT 01 | chr6:152567788-152567808 | + | set1 | N/A | N/A |
| CR007703 | OT 01 | chr6:152567788-152567808 | + | set2 | 0.1 | 0.1 |
| CR007703 | OT 02 | chrX:147775642-147775662 | − | set1 | 0.1 | 0.0 |
| CR007703 | OT 02 | chrX:147775642-147775662 | − | set2 | 0.3 | 0.1 |
| CR007703 | OT 03 | chr1:73224987-73225007 | + | set1 | 0.2 | 0.1 |
| CR007703 | OT 03 | chr1:73224987-73225007 | + | set2 | 0.3 | 0.0 |
| CR007703 | OT 04 | chrX:86735755-86735775 | + | set1 | 0.1 | 0.1 |
| CR007703 | OT 04 | chrX:86735755-86735775 | + | set2 | 0.0 | 0.1 |
| CR007703 | OT 05 | chr1:185142055-185142075 | + | set1 | 0.1 | 0.0 |
| CR007703 | OT 05 | chr1:185142055-185142075 | + | set2 | 0.1 | 0.1 |
| CR007703 | OT 06 | chr5:24716285-24716305 | + | set1 | 0.1 | 0.1 |
| CR007703 | OT 06 | chr5:24716285-24716305 | + | set2 | 0.0 | 0.1 |
| CR007709 | ONT | chr4:105272323-105272343 | + | set1 | 16.6 | 1.9 |
| CR007709 | ONT | chr4:105272323-105272343 | + | set2 | 17.5 | 1.5 |
| CR007709 | OT 01 | chr2:129192151-129192171 | − | set1 | 0.1 | 0.1 |
| CR007709 | OT 01 | chr2:129192151-129192171 | − | set2 | 0.1 | 0.0 |
| CR007709 | OT 02 | chr2:227643116-227643136 | − | set1 | 0.6 | 0.1 |
| CR007709 | OT 02 | chr2:227643116-227643136 | − | set2 | 0.4 | 0.1 |
| CR007709 | OT 03 | chr5:138393430-138393450 | − | set1 | 1.8 | 0.2 |
| CR007709 | OT 03 | chr5:138393430-138393450 | − | set2 | 2.3 | 0.7 |
| CR007709 | OT 04 | chr1:112957752-112957772 | + | set1 | 0.1 | 0.1 |
| CR007709 | OT 04 | chr1:112957752-112957772 | + | set2 | 0.1 | 0.0 |
| CR007709 | OT 05 | chr12:68577045-68577065 | − | set1 | 0.1 | 0.1 |
| CR007709 | OT 05 | chr12:68577045-68577065 | − | set2 | 0.1 | 0.1 |
| CR007709 | OT 06 | chr3:81269842-81269862 | + | set1 | 0.0 | 0.1 |
| CR007709 | OT 06 | chr3:81269842-81269862 | + | set2 | 0.1 | 0.1 |
| CR007709 | OT 07 | chr4:99925790-99925810 | + | set1 | 0.0 | 0.1 |
| CR007709 | OT 07 | chr4:99925790-99925810 | + | set2 | 0.0 | N/A |
| CR007709 | OT 08 | chr4:12791779-12791799 | + | set1 | 0.1 | 0.1 |
| CR007709 | OT 08 | chr4:12791779-12791799 | + | set2 | 0.0 | 0.1 |
| CR007709 | OT 09 | chr6:31568852-31568872 | − | set1 | 0.1 | 0.0 |
| CR007709 | OT 09 | chr6:31568852-31568872 | − | set2 | 0.2 | 0.1 |
| CR007709 | OT 10 | chr7:54279191-54279211 | + | set1 | N/A | N/A |
| CR007709 | OT 10 | chr7:54279191-54279211 | + | set2 | 0.2 | 0.1 |
| CR007709 | OT 11 | chr7:19117788-19117808 | − | set1 | 1.2 | 1.3 |
| CR007709 | OT 11 | chr7:19117788-19117808 | − | set2 | 1.0 | 0.4 |
| CR007709 | OT 12 | chr8:116368538-116368558 | − | set1 | 0.1 | 0.0 |
| CR007709 | OT 12 | chr8:116368538-116368558 | − | set2 | 0.0 | 0.1 |
| CR007709 | OT 13 | chr8:96115257-96115277 | − | set1 | 0.2 | 0.1 |
| CR007709 | OT 13 | chr8:96115257-96115277 | − | set2 | N/A | N/A |
| CR007709 | OT 14 | chrX:139885150-139885170 | − | set1 | 0.1 | 0.0 |
| CR007709 | OT 14 | chrX:139885150-139885170 | − | set2 | 0.1 | 0.0 |
| CR007709 | OT 15 | chrX:14227411-14227431 | + | set1 | 0.1 | 0.0 |
| CR007709 | OT 15 | chrX:14227411-14227431 | + | set2 | 0.1 | 0.1 |
| CR007709 | OT 16 | chr2:54814529-54814549 | − | set1 | 0.1 | 0.1 |
| CR007709 | OT 16 | chr2:54814529-54814549 | − | set2 | N/A | N/A |
| CR007709 | OT 17 | chr9:101349182-101349202 | + | set1 | 0.1 | 0.1 |
| CR007709 | OT 17 | chr9:101349182-101349202 | + | set2 | N/A | N/A |
| CR007709 | OT 18 | chr10:93489165-93489185 | − | set1 | 0.0 | 0.0 |
| CR007709 | OT 18 | chr10:93489165-93489185 | − | set2 | N/A | N/A |
| CR007709 | OT 19 | chr21:20954203-20954223 | − | set1 | 2.4 | 0.1 |
| CR007709 | OT 19 | chr21:20954203-20954223 | − | set2 | 2.2 | 0.3 |
| CR007709 | OT 20 | chr4:5568958-5568978 | − | set1 | 0.0 | 0.0 |
| CR007709 | OT 20 | chr4:5568958-5568978 | − | set2 | 0.0 | 0.0 |

"ONT" = on-target site; "OT" = off-target site; "N/A" = no data due to technical error; "SD" = standard deviation

Example 7: In Silico Off-Target Analysis

Potential off-target loci for the TET2 gRNAs comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, g60, TI-7 (6900), and TI-8 (7600) were identified using the Cas-OFFinder algorithm (Bae et al 2014, PMID: 24463181). For each gRNA, the 20 nucleotide gRNA targeting domain sequence was analyzed against the human genome reference sequence (build GRCh38) identifying all sites with up to 5 nucleotide mismatches that are 5' adjacent to the Cas9 canonical 5'-NGG-3' PAM sequence (i.e. 5'-off-target locus-PAM-3'). Sites identified with 5 mismatches were filtered against RefSeq gene annotations (Pruitt et al, 2014, PMID: 24259432) to only include loci annotated as exons. Counts of the potential off-target loci identified for the TET2 gRNAs are shown in Table 21.

TABLE 21

Counts of in silico off-target loci identified for the TET2 gRNAs CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, g60, TI-7 (6900), and TI-8 (7600) with 0, 1, 2, 3 and 4 nucleotide mismatches and 5 nucleotide mismatches in RefSeq exons are shown.

| gRNA name | 0 | 1 | 2 | 3 | 4 | 5 in Ref Seq exons | Total sites |
|---|---|---|---|---|---|---|---|
| CR007626 (g1) | 0 | 0 | 0 | 1 | 37 | 46 | 84 |
| CR007633 | 0 | 0 | 0 | 7 | 120 | 36 | 163 |
| CR007710 (g45) | 0 | 0 | 1 | 16 | 165 | 104 | 286 |
| CR007665 | 0 | 0 | 1 | 14 | 223 | 69 | 307 |
| CR007677 | 0 | 0 | 0 | 15 | 177 | 79 | 271 |
| CR007703 | 0 | 0 | 0 | 16 | 285 | 87 | 388 |
| CR007671 | 0 | 0 | 0 | 10 | 128 | 49 | 187 |
| CR007675 | 0 | 0 | 1 | 6 | 63 | 26 | 96 |
| CR007684 | 0 | 0 | 1 | 15 | 143 | 102 | 261 |
| CR007691 | 0 | 0 | 0 | 19 | 188 | 82 | 289 |
| g59 | 0 | 0 | 1 | 19 | 196 | 128 | 344 |
| CR007632 (g10) | 0 | 0 | 0 | 6 | 85 | 64 | 155 |
| CR007648 (g20) | 0 | 0 | 0 | 9 | 132 | 68 | 209 |
| CR007709 (g34) | 0 | 0 | 1 | 16 | 294 | 118 | 429 |
| g21 | 0 | 0 | 1 | 12 | 190 | 98 | 301 |
| g22 | 0 | 0 | 0 | 8 | 95 | 60 | 163 |
| g23 | 0 | 0 | 0 | 15 | 141 | 72 | 228 |
| g55 | 0 | 0 | 0 | 29 | 313 | 111 | 453 |
| CR007627 (g2) | 0 | 0 | 0 | 2 | 48 | 52 | 102 |
| g4 | 0 | 0 | 0 | 1 | 25 | 38 | 64 |
| g17 | 0 | 0 | 0 | 7 | 78 | 58 | 143 |
| g25 | 0 | 0 | 0 | 8 | 141 | 90 | 239 |
| g42 | 0 | 0 | 0 | 9 | 94 | 67 | 170 |
| g54 | 0 | 0 | 5 | 28 | 344 | 221 | 598 |
| g58 | 0 | 0 | 5 | 29 | 659 | 111 | 804 |
| g60 | 0 | 0 | 0 | 29 | 231 | 138 | 398 |
| TI-7 (6900) | 0 | 1 | 9 | 115 | 1255 | 429 | 1809 |
| TI-8 (7600) | 0 | 2 | 4 | 53 | 546 | 254 | 859 |

Potential off-target sites will require validation in genome edited T-cells using targeted NGS analysis.

Top Indels for TET2 gRNAs

Primary human T cells were prepared as described in Example 3, and indel frequency (Table 23) and indel pattern (Table 22) assessed as described.

TABLE 22

Top five editing repair pattern variants generated by editing T-cells with dual gRNA moleculess comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, and g60 are shown. Variant size, variant type (Ins = insertion, Del = deletion), reference allele, variant allele, variant start and end position relative to chromosome 4 reference genome build GRCh38, and representative allele frequencies are shown.

| gRNA name | Size (bp) | Type | Reference allele | SEQ ID NO: | Variant allele | Variant start and end position | Allele frequency |
|---|---|---|---|---|---|---|---|
| CR7626 (g1) | 1 | Ins | T | | TT | 105270640-105270641 | 10.73% |
| | -1 | Del | AT | | A | 105270639-105270640 | 9.48% |
| | -15 | Del | CGGTCTTGTAATTGGA | 10523 | C | 105270629-105270644 | 4.04% |
| | -17 | Del | ATGGATCGGTCTTGTAAT | 10524 | A | 105270623-105270640 | 4.01% |
| | -6 | Del | TTGTAAT | | T | 105270634-105270640 | 3.82% |

TABLE 22-continued

Top five editing repair pattern variants generated by editing T-cells with dual gRNA moleculess comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, and g60 are shown. Variant size, variant type (Ins = insertion, Del = deletion), reference allele, variant allele, variant start and end position relative to chromosome 4 reference genome build GRCh38, and representative allele frequencies are shown.

| gRNA name | Size (bp) | Type | Reference allele | SEQ ID NO: | Variant allele | Variant start and end position | Allele frequency |
|---|---|---|---|---|---|---|---|
| CR0077 10 (g45) | -9 | Del | GAGGCAGTGG | 10525 | G | 105270643-105270652 | 8.60% |
|  | -11 | Del | GCAGTGGTGAGG | 10526 | G | 105270646-105270657 | 4.82% |
|  | -6 | Del | GCAGTGG |  | G | 105270646-105270652 | 4.75% |
|  | -4 | Del | GGCAG |  | G | 105270645-105270649 | 4.15% |
|  | -1 | Del | GG |  | G | 105270645-105270646 | 3.51% |
| CR007633 | -28 | Del | AGTACCCACTTATAT GGTCATATTTCAGA | 10527 | A | 105271870-105271898 | 17.79% |
|  | 1 | Ins | T |  | TT | 105271880-105271881 | 16.86% |
|  | -1 | Del | TT |  | T | 105271879-105271880 | 3.88% |
|  | -2 | Del | CTT |  | C | 105271878-105271880 | 3.33% |
|  | -2 | Del | TAT |  | T | 105271880-105271882 | 3.17% |
| CR007665 | -1 | Del | AA |  | A | 105271356-105271357 | 10.91% |
|  | 1 | Ins | A |  | AA | 105271357-105271358 | 6.84% |
|  | -22 | Del | TAAATGATAACTG GGGCTATAGT | 10528 | T | 105271348-105271370 | 6.51% |
|  | -2 | Del | TAA |  | T | 105271355-105271357 | 5.71% |
|  | -7 | Del | ATGATAAC |  | A | 105271351-105271358 | 5.56% |
| CR007677 | -1 | Del | AG |  | A | 105271205-105271206 | 12.15% |
|  | -16 | Del | CGTAGGTTCTGGT TTCC | 10529 | C | 105271202-105271218 | 9.79% |
|  | 1 | Ins | G |  | GG | 105271206-105271207 | 5.29% |
|  | -2 | Del | GGT |  | G | 105271206-105271208 | 4.08% |
|  | -4 | Del | CGTAG |  | C | 105271202-105271206 | 3.11% |
| CR007703 | 1 | Ins | A |  | AA | 105271543-105271544 | 22.22% |
|  | -7 | Del | GTAACAAG |  | G | 105271541-105271548 | 6.11% |
|  | -1 | Del | TA |  | T | 105271542-105271543 | 5.55% |
|  | -2 | Del | AAC |  | A | 105271543-105271545 | 4.56% |
|  | -13 | Del | GGGAAAAGTAACAA | 10530 | G | 105271534-105271547 | 3.76% |
| CR007671 | -2 | Del | GTG |  | G | 105270353-105270355 | 30.10% |
|  | 1 | Ins | G |  | GT | 105270353-105270354 | 14.16% |
|  | -2 | Del | TGG |  | T | 105270351-105270353 | 5.08% |
|  | -13 | Del | AAATCCTTGGTGTT | 10531 | A | 105270344-105270357 | 4.91% |

TABLE 22-continued

Top five editing repair pattern variants generated by editing T-cells with dual gRNA moleculess comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, and g60 are shown. Variant size, variant type (Ins = insertion, Del = deletion), reference allele, variant allele, variant start and end position relative to chromosome 4 reference genome build GRCh38, and representative allele frequencies are shown.

| gRNA name | Size (bp) | Type | Reference allele | SEQ ID NO: | Variant allele | Variant start and end position | Allele frequency |
|---|---|---|---|---|---|---|---|
| | -3 | Del | GTGT | | G | 105270353-105270356 | 3.42% |
| CR007675 | 1 | Ins | T | | TT | 105270285-105270286 | 50.24% |
| | -19 | Del | CTCTCATGATAGGTTGGCAC | 10532 | C | 105270279-105270298 | 10.90% |
| | -28 | Del | TTTGGCATAACTAGCACTCTCATGATAGG | 10533 | T | 105270263-105270291 | 2.74% |
| | -14 | Del | CTAGCACTCTCATGA | 10534 | C | 105270273-105270287 | 1.95% |
| | -1 | Del | CA | | C | 105270283-105270284 | 1.12% |
| CR007684 | -1 | Del | TT | | T | 105272184-105272185 | 21.58% |
| | -2 | Del | GTT | | G | 105272183-105272185 | 12.80% |
| | 1 | Ins | T | | TT | 105272185-105272186 | 8.54% |
| | -16 | Del | CCTGTTTTTGAAGAGGC | 10535 | C | 105272180-105272196 | 4.55% |
| | -3 | Del | TTTT | | T | 105272185-105272188 | 3.54% |
| CR007691 | 1 | Ins | T | | TT | 105272482-105272483 | 46.22% |
| | -1 | Del | AC | | A | 105272480-105272481 | 14.29% |
| | 2 | Ins | T | | TTT | 105272482-105272484 | 4.38% |
| | -1 | Del | CT | | C | 105272481-105272482 | 2.64% |
| | -7 | Del | TGAATACT | | T | 105272475-105272482 | 1.55% |
| g59 | 1 | Ins | T | | TT | 105271390-105271391 | 18.08% |
| | -1 | Del | GT | | G | 105271389-105271390 | 15.12% |
| | -7 | Del | TGTTTCAT | | T | 105271388-105271395 | 7.29% |
| | -12 | Del | ATGTTTCATTCCA | 10536 | A | 105271387-105271399 | 4.36% |
| | -2 | Del | TTT | | T | 105271390-105271392 | 1.50% |
| CR007632 (g10) | 1 | Ins | A | | AA | 105272453-105272454 | 4.74% |
| | -1 | Del | CA | | C | 105272452-105272453 | 4.54% |
| | -10 | Del | GATCAACTAGG | 10537 | G | 105272449-105272459 | 1.97% |
| | -9 | Del | TCTGGATCAA | 10538 | T | 105272445-105272454 | 1.21% |
| | -2 | Del | AAC | | A | 105272453-105272455 | 1.00% |
| CR007648 (g20) | -1 | Del | AA | | A | 105271940-105271941 | 11.98% |
| | -15 | Del | GTACAAAGGAGGAGAG | 10539 | G | 105271936-105271951 | 2.76% |

TABLE 22-continued

Top five editing repair pattern variants generated by editing T-cells with dual gRNA moleculess comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, and g60 are shown. Variant size, variant type (Ins = insertion, Del = deletion), reference allele, variant allele, variant start and end position relative to chromosome 4 reference genome build GRCh38, and representative allele frequencies are shown.

| gRNA name | Size (bp) | Type | Reference allele | SEQ ID NO: | Variant allele | Variant start and end position | Allele frequency |
|---|---|---|---|---|---|---|---|
| | -10 | Del | AGAGTACAAAG | 10540 | A | 105271933-105271943 | 2.47% |
| | -2 | Del | CAA | | C | 105271939-105271941 | 2.07% |
| | 1 | Ins | A | | AA | 105271941-105271942 | 2.01% |
| CR007709 (g34) | -1 | Del | AA | | A | 105272339-105272340 | 6.79% |
| | 1 | Ins | A | | AA | 105272340-105272341 | 4.22% |
| | -2 | Del | AAA | | A | 105272338-105272340 | 2.50% |
| | -6 | Del | AGAAAGG | | A | 105272336-105272342 | 1.85% |
| | -6 | Del | AGAGAAA | | A | 105272334-105272340 | 1.22% |
| g21 | 1 | Ins | T | | TT | 105272074-105272075 | 2.42% |
| | -7 | Del | TGTCAGGT | | T | 105272074-105272081 | 0.92% |
| | -7 | Del | AGTTAGGT | | A | 105272067-105272074 | 0.64% |
| | -2 | Del | GGT | | G | 105272072-105272074 | 0.40% |
| | -11 | Del | AGGTGTCAGGTA | 10541 | A | 105272071-105272082 | 0.16% |
| g22 | -2 | Del | GCT | | G | 105272312-105272314 | 3.01% |
| | -1 | Del | GC | | G | 105272312-105272313 | 1.65% |
| | -3 | Del | ACAG | | A | 105272309-105272312 | 1.11% |
| | -19 | Del | GAACAAGGGTCACCACAGCT | 10542 | G | 105272295-105272314 | 0.89% |
| | -10 | Del | CACCACAGCTA | 10543 | C | 105272305-105272315 | 0.80% |
| g23 | 1 | Ins | T | | TA | 105272327-105272328 | 6.43% |
| | -4 | Del | ATAGA | | A | 105272326-105272330 | 4.90% |
| | -8 | Del | TGATAGACT | | T | 105272324-105272332 | 1.49% |
| | -2 | Del | TAG | | T | 105272327-105272329 | 1.17% |
| | -10 | Del | ATAGACTCAGA | 10544 | A | 105272326-105272336 | 0.80% |
| g55 | -1 | Del | AG | | A | 105272340-105272341 | 7.20% |
| | -2 | Del | AAG | | A | 105272339-105272341 | 4.11% |
| | -3 | Del | AAAG | | A | 105272338-105272341 | 2.00% |
| | -7 | Del | AGAGAAAG | | A | 105272334-105272341 | 1.63% |
| | -2 | Del | GGG | | G | 105272341-105272343 | 1.41% |

TABLE 22-continued

Top five editing repair pattern variants generated by editing T-cells with dual gRNA moleculess comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, and g60 are shown. Variant size, variant type (Ins = insertion, Del = deletion), reference allele, variant allele, variant start and end position relative to chromosome 4 reference genome build GRCh38, and representative allele frequencies are shown.

| gRNA name | Size (bp) | Type | Reference allele | SEQ ID NO: | Variant allele | Variant start and end position | Allele frequency |
|---|---|---|---|---|---|---|---|
| CR007627 (g2) | -6 | Del | GCCGTAG | | G | 105271200-105271206 | 6.43% |
| | -1 | Del | GC | | G | 105271200-105271201 | 4.18% |
| | -15 | Del | GAGGCACATTAGCCGT | 10545 | G | 105271189-105271204 | 3.69% |
| | -2 | Del | AGC | | A | 105271199-105271201 | 2.02% |
| | -7 | Del | ACATTAGC | | A | 105271194-105271201 | 1.54% |
| g4 | -6 | Del | GTTCTGG | | G | 105271207-105271213 | 0.73% |
| | -2 | Del | AGG | | A | 105271205-105271207 | 0.37% |
| | -1 | Del | GG | | G | 105271206-105271207 | 0.27% |
| | -10 | Del | TAGGTTCTGGT | 10546 | T | 105271204-105271214 | 0.14% |
| | -16 | Del | CGTAGGTTCTGGTTTCC | 10547 | C | 105271202-105271218 | 0.11% |
| g17 | -1 | Del | TT | | T | 105271311-105271312 | 9.67% |
| | 1 | Ins | T | | TT | 105271312-105271313 | 6.24% |
| | -15 | Del | TGCTCATTATTAGGAG | 10548 | T | 105271302-105271317 | 4.65% |
| | -20 | Del | TCATTATTAGGAGGCTATGCT | 10549 | T | 105271305-105271325 | 3.10% |
| | -2 | Del | ATT | | A | 105271310-105271312 | 2.89% |
| g25 | -3 | Del | CATT | | C | 105271306-105271309 | 4.39% |
| | -1 | Del | TT | | T | 105271308-105271309 | 1.50% |
| | 1 | Ins | T | | TT | 105271309-105271310 | 1.05% |
| | -15 | Del | TCATTATTAGGAGGCT | 10550 | T | 105271305-105271320 | 0.65% |
| | -4 | Del | TTATT | | T | 105271308-105271312 | 0.45% |
| g42 | 1 | Ins | G | | GA | 105271461-105271462 | 13.54% |
| | -13 | Complex | GAAGAATTTGCCTCTGATAGA | 10551 | AAGAATTT | 105271446-105271466 | 2.47% |
| | -12 | Del | CCTCTGATAGAGC | 10552 | C | 105271456-105271468 | 2.44% |
| | -4 | Del | GATAG | | G | 105271461-105271465 | 2.39% |
| | -17 | Del | GATAGAGCATGGGTTCTG | 10553 | G | 105271461-105271478 | 1.45% |
| g54 | -3 | Del | GTGG | | G | 105270649-105270652 | 0.99% |
| | 1 | Ins | G | | GT | 105270652-105270653 | 0.91% |
| | -7 | Del | GTGAGGGG | | G | 105270652-105270659 | 0.89% |
| | -11 | Del | GGAGGCAGTGGT | 10554 | G | 105270642-105270653 | 0.85% |
| | -1 | Del | GG | | G | 105270651-105270652 | 0.74% |

TABLE 22-continued

Top five editing repair pattern variants generated by editing T-cells with dual gRNA moleculess comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, and g60 are shown. Variant size, variant type (Ins = insertion, Del = deletion), reference allele, variant allele, variant start and end position relative to chromosome 4 reference genome build GRCh38, and representative allele frequencies are shown.

| gRNA name | Size (bp) | Type | Reference allele | SEQ ID NO: | Variant allele | Variant start and end position | Allele frequency |
|---|---|---|---|---|---|---|---|
| g58 | 1 | Ins | C | | CA | 105271175-105271176 | 10.79% |
| | -4 | Del | CAAAC | | C | 105271175-105271179 | 4.01% |
| | -1 | Del | CA | | C | 105271175-105271176 | 1.91% |
| | -6 | Del | CAAACAC | | C | 105271175-105271181 | 1.42% |
| | -8 | Del | ATACAAACA | | A | 105271172-105271180 | 1.14% |
| g60 | -3 | Del | AGAA | | A | 105271232-105271235 | 0.73% |
| | -7 | Del | AGAACAAA | | A | 105271235-105271242 | 0.11% |
| | -8 | Del | AGAAGAACA | | A | 105271232-105271240 | 0.10% |
| | -1 | Del | AG | | A | 105271235-105271236 | 0.09% |
| | 1 | Ins | A | | AA | 105271235-105271236 | 0.07% |

TABLE 23

Typical indel frequencies generated by editing T-cells with gRNA molecules comprising the targeting domains of CR007626 (g1), CR007710 (g45), CR007633, CR007665, CR007677, CR007703, CR007671, CR007675, CR007684, CR007691, g59, CR007632 (g10), CR007648 (g20), CR007709 (g34), g21, g22, g23, g55, CR007627 (g2), g4, g17, g25, g42, g54, g58, and g60 are shown.

| gRNA name | Typical % indel |
|---|---|
| CR007626 (g1) | 58.20% |
| CR007710 (g45) | 59.85% |
| CR007633 | 75.37% |
| CR007665 | 82.05% |
| CR007677 | 79.38% |
| CR007703 | 84.81% |
| CR007671 | 86.77% |
| CR007675 | 84.71% |
| CR007684 | 84.31% |
| CR007691 | 81.79% |
| g59 | 64.84% |
| CR007632 (g10) | 22.62% |
| CR007648 (g20) | 35.21% |
| CR007709 (g34) | 35.59% |
| g21 | 4.74% |
| g22 | 14.32% |
| g23 | 23.62% |
| g55 | 35.59% |
| CR007627 (g2) | 35.51% |
| g4 | 2.12% |
| g17 | 51.26% |
| g25 | 11.69% |
| g42 | 44.30% |
| g54 | 9.51% |
| g58 | 30.32% |
| g60 | 1.75% |

Methods for On-Target Analysis

NGS Library Preparation and Sequencing of Amplicons

PCR amplicons were purified using 1.8× Agencourt AmpureXP beads (Beckman Coulter) following the manufactures recommendations. Amplicons were quantified using the Quant-iT PicoGreen dsDNA assay (Life Technologies) following the manufactures recommendations. Illumina sequencing libraries were generated using the Nextera DNA Library Prep Kit (Illumina) following the manufactures recommendations with the following changes. Tagmentation was performed in a final volume of 5 ul using 5 ng of purified PCR product, 0.15 ul of Nextera tagment enzyme and tagmentation buffer previously described by Wang et al (PMID: 24071908). Tagmented amplicons were then PCR amplified in a final volume of 50 ul using a final concentration of 0.2 mM dNTP (Life Technologies), 0.2 uM Illumina index PCR primers (Integrated DNA Technologies), 1x Phusion DNA polymerase buffer (New England Biolabs) and 1U of Phusion DNA polymerase (New England Biolabs). PCR cycling conditions used were as follows: 72° C. for 3 min, 98° C. for 2 min and 15 cycles of 98° C. for 10 sec, 63° C. for 30 sec, and 72° C. for 3 min. Sequencing libraries were then purified using 1.0× Agencourt AmpureXP beads (Beckman Coulter) following the manufactures recommendations. Sequencing libraries were quantified using the Quant-iT PicoGreen dsDNA assay (Life Technologies) following the manufactures recommendations and pooled equimolar for sequencing. Sequencing libraries were sequenced with 150 base paired-end reads on a MiSeq sequencer following the manufactures recommendations (Illumina). A minimum of a 1000-fold sequencing coverage was generated per amplicon.

NGS Sequencing Data QC and Variant Analysis

Using default parameters, the Illumina MiSeq analysis software (MiSeq reporter, version 2.6.2, Illumina) was used to generate amplicon specific FASTQ sequencing data files (Cock et al, Nucleic Acids Res. 2010, 38(6):1767-71, PMID: 20015970). FASTQ files were then processed through an internally developed variant analysis pipeline consisting of a series of public domain software packages joined together using a standard Perl script wrapper. The workflow used was divided into five stages.

Stage 1, PCR Primer and On- and Off-Target Sequence QC:

The 20 nucleotide gRNA targeting domain sequence plus PAM sequence and target specific PCR primer sequences were aligned to the human genome reference sequence (build GRCh38) using a BLAST search (version 2.2.29+, Altschul et al, J Mol Biol., 1990, 215(3):403-10, PMID: 2231712). Sequences with multiple genomic locations were flagged.

Stage 2, Sequencer File Decompression:

Illumina sequencer generated FASTQ.GZ files were decompressed to FASTQ files using the gzip script (version 1.3.12) and number of reads per file was calculated. Files with no reads were excluded from further analysis.

Stage 3, Sequence Read Alignment and Quality Trimming:

Sequencing reads in FASTQ files were aligned to the human genome reference sequence (build GRCh38) using the BWA-MEM aligner (version 0.7.4-r385, Li and Durbin, Bioinformatics, 2009, 25(14):1754-60, PMID: 19451168) using 'hard-clipping' to trim 3' ends of reads of Illumina sequences and low quality bases. Resulting aligned reads, in the BAM file format (Li et al, Bioinformatics, 2009 25(16):2078-9, PMID: 19505943), were converted to FASTQ files using the SAMtools script (version 0.1.19-44428cd, Li et al, Bioinformatics, 2009 25(16):2078-9, PMID: 19505943). FASTQ files were then aligned again to the human genome reference sequence (build GRCh38) using the BWA-MEM aligner, this time without 'hard-clipping'.

Stage 4, Variant (SNP and Indel) Analysis:

BAM files of aligned reads were processed using the VarDict variant caller (version 1.0 'Cas9 aware' modified by developer ZhongWu Lai, Lai et al, Nucleic Acids Res., 2016, 44(11):e108, PMID: 27060149) with allele frequency detection limit set at >=0.0001 to identify variants (SNPs and indels). The Cas9 aware VarDict caller is based on a public domain package but able to move ambiguous variant calls, generated due to repetitive sequences in the alignment region of the variant events, toward the potential Cas9 nuclease cut site in the gRNA targeting domain sequence located 3 bases 5' of the PAM sequence. The SAMtools script was used to calculate read coverage per sample amplicon to determine whether the target sites were covered at >1000-fold sequence coverage. Sites with <1000-fold sequence coverage were flagged for rework.

Stage 5, dbSNP Filtering and Treated/Untreated Differential Analysis:

Variants identified were filtered for known variants (SNPs and indels) found in dbSNP (build 142, Shery et al, Nucleic Acids Res. 2001, 29(1):308-11, PMID: 11125122). Variants in the treated samples were further filtered to exclude: 1) variants identified in the unedited mock control samples; 2) variants with a VarDict strand bias of 2:1 (where forward and reverse read counts supporting the reference sequence are balanced but imbalanced for the non-reference variant call); 3) variants located >5 bp either side of the potential Cas9 cut site; 4) single nucleotide variants; 5) Variants not seen in both technical PCR replicates of each treatment group.

The present disclosure is not to be limited in scope by the exemplified constructs, since the exemplified embodiments are intended to illustrate only certain aspects of the disclosure and any constructs that are functionally equivalent are within the scope of this disclosure. Various modifications of the disclosure in addition to those shown and described herein will become apparent to those skilled in the art from the foregoing description and fall within the scope of the appended claims.

It is understood that the application of the teachings of the present disclosure to a specific problem or situation will be within the capabilities of one having ordinary skill in the art in light of the teachings contained herein.

The disclosures of each and every citation in the specification are expressly incorporated herein by reference.

To the extent there are any discrepancies between a sequence listing and any sequence recited in the specification, the sequence recited in the specification should be considered the correct sequence. Unless otherwise indicated, all genomic locations are according to hg38.

SEQUENCE LISTING (10563 sequences)

SEQ ID NO: 1 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 2 - protein, 21 aa, Artificial Sequence
  source: /note="Description of Artificial Sequence: Synthetic peptide"
MALPVTALLLPLALLLHAARP

SEQ ID NO: 3 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 4 - DNA, 63 bp, Artificial Sequence
  source: /note="Description of Artificial Sequence: Synthetic oligonucleotide"
atggccctccctgtcaccgccctgctgcttccgctggctcttctgctccacgccgctcggccc

SEQ ID NO: 5 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 6 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 7 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 8 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 9 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 10 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 11 - protein, 10 aa, Artificial Sequence
  source: /note="Description of Artificial Sequence: Synthetic peptide"
GGGGSGGGGS

SEQ ID NO: 12 - DNA, 30 bp, Artificial Sequence
  source: /note="Description of Artificial Sequence: Synthetic oligonucleotide"
ggtggcggaggttctggaggtggaggttcc

SEQ ID NO: 13 - protein, 24 aa, Artificial Sequence
  source: /note="Description of Artificial Sequence: Synthetic peptide"
IYIWAPLAGTCGVLLLSLVITLYC

SEQ ID NO: 14 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 15 - DNA, 72 bp, Artificial Sequence
  source: /note="Description of Artificial Sequence: Synthetic oligonucleotide"
atctacatttgggcccctctggctggtacttgcggggtcctgctgctttcactcgtgatcactctttactgt

SEQ ID NO: 16 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 17 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 18 - DNA, 126 bp, Artificial Sequence
  source: /note="Description of Artificial Sequence: Synthetic polynucleotide"
aagcgcggtcggaagaagctgctgtacatctttaagcaacccttcatgaggcctgtgcagactactcaagaggaggacggctgttcatgccggttcccagaggaggaggaaggcggctgcgaactg

SEQ ID NO: 19 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 20 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 21 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 22 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 23 - DNA, 336 bp, Artificial Sequence
  source: /note="Description of Artificial Sequence: Synthetic polynucleotide"
cgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 24 - protein, 112 aa, Artificial Sequence
  source: /note="Description of Artificial Sequence: Synthetic polypeptide"
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 25 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 26 - protein, 5 aa, Artificial Sequence
  source: /note="Description of Artificial Sequence: Synthetic peptide"
  source: /note="See specification as filed for detailed description of substitutions and preferred embodiments"
GGGGS

SEQ ID NO: 27 - skipped

SEQ ID NO: 28 - protein, 150 aa, Artificial Sequence [sequence omitted]

SEQ ID NO: 29 - DNA, 450 bp, Artificial Sequence
  source: /note="Description of Artificial Sequence: Synthetic polynucleotide"
cccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtc

SEQ ID NO: 30 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 31 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 32 - protein, 40 aa, Artificial Sequence
  source: /note="Description of Artificial Sequence: Synthetic polypeptide"
  MISC_FEATURE (1)..(40): /note="This sequence may encompass 1-10 'Gly Gly Gly Ser' repeating units"
  source: /note="See specification as filed for detailed description of substitutions and preferred embodiments"
GGGSGGGSGGGSGGGSGGGSGGGSGGGSGGGSGGGSGGGS

SEQ ID NO: 33 - protein, 50 aa, Artificial Sequence
  source: /note="Description of Artificial Sequence: Synthetic polypeptide"
GGGGSGGGGSGGGGSGGGGSGGGGSGGGGSGGGGSGGGGSGGGGSGGGGS

SEQ ID NO: 34 - protein, 20 aa, Artificial Sequence
  source: /note="Description of Artificial Sequence: Synthetic peptide"
GGGGSGGGGSGGGGSGGGGS

SEQ ID NO: 35 - protein, 15 aa, Artificial Sequence
  source: /note="Description of Artificial Sequence: Synthetic peptide"
GGGGSGGGGSGGGGS

SEQ ID NO: 36 - protein, 4 aa, Artificial Sequence
  source: /note="Description of Artificial Sequence: Synthetic peptide"
GGGS

SEQ ID NO: 37 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 38 - protein, 18 aa, Artificial Sequence
  source: /note="Description of Artificial Sequence: Synthetic peptide"
GSTSGSGKPGSGEGSTKG

SEQ ID NO: 39-49 - skipped (11 entries)

SEQ ID NO: 50 - RNA, 12 nt, Artificial Sequence
  source: /note="Description of Artificial Sequence: Synthetic oligonucleotide"
guuuuagagcua

SEQ ID NO: 51 - RNA, 12 nt, Artificial Sequence
  source: /note="Description of Artificial Sequence: Synthetic oligonucleotide"
guuuaagagcua

SEQ ID NO: 52 - RNA, 4 nt, Artificial Sequence
  source: /note="Description of Artificial Sequence: Synthetic oligonucleotide"
gaaa

SEQ ID NO: 53 - RNA, 60 nt, Artificial Sequence
  source: /note="Description of Artificial Sequence: Synthetic oligonucleotide"
uagcaaguuaaaauaaggcuaguccguuaucaacuugaaaaaguggcaccgagucggugc

SEQ ID NO: 54 - RNA, 60 nt, Artificial Sequence
  source: /note="Description of Artificial Sequence: Synthetic oligonucleotide"
uagcaaguuuaaauaaggcuaguccguuaucaacuugaaaaaguggcaccgagucggugc

SEQ ID NO: 55 - RNA, 5 nt, Artificial Sequence
  source: /note="Description of Artificial Sequence: Synthetic oligonucleotide"
ugcug

SEQ ID NO: 56 - RNA, 5 nt, Artificial Sequence
  source: /note="Description of Artificial Sequence: Synthetic oligonucleotide"
cagca

SEQ ID NO: 57 - RNA, 5 nt, Artificial Sequence
  source: /note="Description of Artificial Sequence: Synthetic oligonucleotide"
uuuug

SEQ ID NO: 58 - RNA, 10 nt, Artificial Sequence
  source: /note="Description of Artificial Sequence: Synthetic oligonucleotide"
  misc_feature (1)..(10): /note="This sequence may encompass 1-10 nucleotides"
uuuuuuuuuu

SEQ ID NO: 59 - DNA, 10 bp, Artificial Sequence
  source: /note="Description of Artificial Sequence: Synthetic oligonucleotide"
  misc_feature (1)..(10): /note="This sequence may encompass 1-10 nucleotides"
aaaaaaaaaa

SEQ ID NO: 60 - skipped

SEQ ID NO: 61 - RNA, 13 nt, Artificial Sequence
  source: /note="Description of Artificial Sequence: Synthetic oligonucleotide"
uagcaaguuaaaa

SEQ ID NO: 62 - RNA, 13 nt, Artificial Sequence
  source: /note="Description of Artificial Sequence: Synthetic oligonucleotide"
uagcaaguuuaaa

SEQ ID NO: 63 - RNA, 47 nt, Artificial Sequence
  source: /note="Description of Artificial Sequence: Synthetic oligonucleotide"
uaaggcuaguccguuaucaacuugaaaaaguggcaccgagucggugc

SEQ ID NO: 64 - RNA, 51 nt, Artificial Sequence
  source: /note="Description of Artificial Sequence: Synthetic oligonucleotide"
uaaggcuaguccguuaucaacuugaaaaaguggcaccgagucggugcuuuu

SEQ ID NO: 65 - RNA, 74 nt, Artificial Sequence
  source: /note="Description of Artificial Sequence: Synthetic oligonucleotide"
aacagcauagcaaguuaaaauaaggcuaguccguuaucaacuugaaaaaguggcaccgagucggugcuuuuuuu

SEQ ID NO: 66 - RNA, 36 nt, Artificial Sequence
  source: /note="Description of Artificial Sequence: Synthetic oligonucleotide"
  modified_base (1)..(20): a, c, u, g, unknown or other
  source: /note="See specification as filed for detailed description of substitutions and preferred embodiments"
nnnnnnnnnnnnnnnnnnnnguuuuagagcuaugcu

SEQ ID NO: 67 - RNA, 74 nt, Artificial Sequence; identical to SEQ ID NO: 65
  source: /note="Description of Artificial Sequence: Synthetic oligonucleotide"

SEQ ID NO: 68 - RNA, 42 nt, Artificial Sequence
  source: /note="Description of Artificial Sequence: Synthetic oligonucleotide"
  modified_base (1)..(20): a, c, u, g, unknown or other
  source: /note="See specification as filed for detailed description of substitutions and preferred embodiments"
nnnnnnnnnnnnnnnnnnnnguuuuagagcuaugcuguuuug

SEQ ID NO: 69 - RNA, 100 nt, Artificial Sequence
  source: /note="Description of Artificial Sequence: Synthetic polynucleotide"
  modified_base (1)..(20): a, c, u, g, unknown or other
  source: /note="See specification as filed for detailed description of substitutions and preferred embodiments"
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 70 - RNA, 100 nt, Artificial Sequence; identical to SEQ ID NO: 69
  source: /note="Description of Artificial Sequence: Synthetic polynucleotide"
  modified_base (1)..(20): a, c, u, g, unknown or other
  source: /note="See specification as filed for detailed description of substitutions and preferred embodiments"

SEQ ID NO: 71 - RNA, 76 nt, Artificial Sequence
  source: /note="Description of Artificial Sequence: Synthetic oligonucleotide"
guuuuagagcuagaaauagcaaguuaaaauaaggcuaguccguuaucaacuugaaaaaguggcaccgagucggugc

SEQ ID NO: 72 - RNA, 76 nt, Artificial Sequence
  source: /note="Description of Artificial Sequence: Synthetic oligonucleotide"
guuuaagagcuagaaauagcaaguuuaaauaaggcuaguccguuaucaacuugaaaaaguggcaccgagucggugc

SEQ ID NO: 73 - RNA, 86 nt, Artificial Sequence
  source: /note="Description of Artificial Sequence: Synthetic oligonucleotide"
guuuuagagcuaugcuggaaacagcauagcaaguuaaaauaaggcuaguccguuaucaacuugaaaaaguggcaccgagucggugc

SEQ ID NO: 74 - RNA, 86 nt, Artificial Sequence
  source: /note="Description of Artificial Sequence: Synthetic oligonucleotide"
guuuaagagcuaugcuggaaacagcauagcaaguuuaaauaaggcuaguccguuaucaacuugaaaaaguggcaccgagucggugc

SEQ ID NO: 75 - RNA, 80 nt, Artificial Sequence
  source: /note="Description of Artificial Sequence: Synthetic oligonucleotide"
guuuuagagcuagaaauagcaaguuaaaauaaggcuaguccguuaucaacuugaaaaaguggcaccgagucggugcuuuu

SEQ ID NO: 76 - RNA, 90 nt, Artificial Sequence
  source: /note="Description of Artificial Sequence: Synthetic oligonucleotide"
guuuaagagcuaugcuggaaacagcauagcaaguuuaaauaaggcuaguccguuaucaacuugaaaaaguggcaccgagucggugcuuuu

SEQ ID NO: 77 - RNA, 17 nt, Artificial Sequence
  source: /note="Description of Artificial Sequence: Synthetic oligonucleotide"
guuuuagagcuaugcug

SEQ ID NO: 78 - RNA, 17 nt, Artificial Sequence
  source: /note="Description of Artificial Sequence: Synthetic oligonucleotide"
guuuaagagcuaugcug

SEQ ID NO: 79 - RNA, 22 nt, Artificial Sequence
  source: /note="Description of Artificial Sequence: Synthetic oligonucleotide"
guuuuagagcuaugcuguuuug

SEQ ID NO: 80 - RNA, 22 nt, Artificial Sequence
  source: /note="Description of Artificial Sequence: Synthetic oligonucleotide"
guuuaagagcuaugcuguuuug

SEQ ID NO: 81 - RNA, 16 nt, Artificial Sequence
  source: /note="Description of Artificial Sequence: Synthetic oligonucleotide"
guuuuagagcuaugcu

SEQ ID NO: 82 - RNA, 65 nt, Artificial Sequence
  source: /note="Description of Artificial Sequence: Synthetic oligonucleotide"
cagcauagcaaguuaaaauaaggcuaguccguuaucaacuugaaaaaguggcaccgagucggugc

SEQ ID NO: 83 - RNA, 65 nt, Artificial Sequence
  source: /note="Description of Artificial Sequence: Synthetic oligonucleotide"
cagcauagcaaguuuaaauaaggcuaguccguuaucaacuugaaaaaguggcaccgagucggugc

SEQ ID NO: 84 - RNA, 74 nt, Artificial Sequence
  source: /note="Description of Artificial Sequence: Synthetic oligonucleotide"
aacagcauagcaaguuuaaauaaggcuaguccguuaucaacuugaaaaaguggcaccgagucggugcuuuuuuu

SEQ ID NO: 85 - RNA, 67 nt, Artificial Sequence
  source: /note="Description of Artificial Sequence: Synthetic oligonucleotide"
agcauagcaaguuaaaauaaggcuaguccguuaucaacuugaaaaaguggcaccgagucggugcuuu

SEQ ID NO: 86 - RNA, 85 nt, Artificial Sequence
  source: /note="Description of Artificial Sequence: Synthetic oligonucleotide"
guuggaaccauucaaaacagcauagcaaguuaaaauaaggcuaguccguuaucaacuugaaaaaguggcaccgagucggugcuuu

SEQ ID NO: 87 - RNA, 67 nt, Artificial Sequence
  source: /note="Description of Artificial Sequence: Synthetic oligonucleotide"
aacagcauagcaaguuaaaauaaggcuaguccguuaucaacuugaaaaaguggcaccgagucggugc

SEQ ID NO: 88-89 - skipped (2 entries)

SEQ ID NO: 90 - protein, 1368 aa, Streptococcus pyogenes [sequence omitted]

SEQ ID NO: 91 - protein, 7 aa, Simian virus 40
PKKKRKV

SEQ ID NO: 92 - protein, 16 aa, Unknown
  source: /note="Description of Unknown: Nucleoplasmin bipartite NLS sequence"
KRPAATKKAGQAKKKK

SEQ ID NO: 93 - protein, 9 aa, Unknown
  source: /note="Description of Unknown: C-myc NLS sequence"
PAAKRVKLD

SEQ ID NO: 94 - protein, 11 aa, Unknown
  source: /note="Description of Unknown: C-myc NLS sequence"
RQRRNELKRSP

SEQ ID NO: 95 - protein, 38 aa, Homo sapiens
NQSSNFGPMKGGNFGGRSSGPYGGGGQYFAKPRNQGGY

SEQ ID NO: 96 - protein, 42 aa, Unknown
  source: /note="Description of Unknown: IBB domain from importin-alpha sequence"
RMRIZFKNKGKDTAELRRRRVEVSVELRKAKKDEQILKRRNV

SEQ ID NO: 97 - protein, 8 aa, Unknown
  source: /note="Description of Unknown: Myoma T protein sequence"
VSRKRPRP

SEQ ID NO: 98 - protein, 8 aa, Unknown
  source: /note="Description of Unknown: Myoma T protein sequence"
PPKKARED

SEQ ID NO: 99 - protein, 8 aa, Homo sapiens
PQPKKKPL

SEQ ID NO: 100 - protein, 12 aa, Mus musculus
SALIKKKKKMAP

SEQ ID NO: 101 - protein, 5 aa, Influenza virus
DRLRR

SEQ ID NO: 102 - protein, 7 aa, Influenza virus
PKQKKRK

SEQ ID NO: 103 - protein, 10 aa, Hepatitis delta virus
RKLKKKIKKL

SEQ ID NO: 104 - protein, 10 aa, Mus musculus
REKKKFLKRR

SEQ ID NO: 105 - protein, 20 aa, Homo sapiens
KRKGDEVDGVDEVAKKKSKK

SEQ ID NO: 106 - protein, 17 aa, Homo sapiens
RKCLQAGMNLEARKTKK

SEQ ID NO: 107 - protein, 10 aa, Artificial Sequence
  source: /note="Description of Artificial Sequence: Synthetic His tag"
  MISC_FEATURE (1)..(10): /note="This sequence may encompass 3-10 residues"
  source: /note="See specification as filed for detailed description of substitutions and preferred embodiments"
HHHHHHHHHH

SEQ ID NO: 108 - protein, 6 aa, Artificial Sequence
  source: /note="Description of Artificial Sequence: Synthetic 6xHis tag"
HHHHHH

SEQ ID NO: 109 - protein, 8 aa, Artificial Sequence
  source: /note="Description of Artificial Sequence: Synthetic 8xHis tag"
HHHHHHHH

SEQ ID NO: 110 - protein, 7 aa, Tobacco etch virus
ENLYFQG

SEQ ID NO: 111 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 112 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRILYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIEEFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 113 - protein, 1399 aa, Artificial Sequence
  source: /note="Description of Artificial Sequence: Synthetic polypeptide"
MGSSHHHHHHHHENLYFQGSMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSPKKKRKV

SEQ ID NO: 114 - protein, 1396 aa, Artificial Sequence
  source: /note="Description of Artificial Sequence: Synthetic polypeptide"
MAHHHHHHGGSPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 115 - protein, 1386 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADHHHHHH

SEQ ID NO: 116 - protein, 1389 aa, Artificial Sequence
  source: /note="Description of Artificial Sequence: Synthetic polypeptide"
MAHHHHHHGGSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 117 - protein, 1399 aa, Artificial Sequence; identical to SEQ ID NO: 113
  source: /note="Description of Artificial Sequence: Synthetic polypeptide"

SEQ ID NO: 118 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNAVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 119 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEALYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 120 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 121 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 122 - DNA, 4107 bp, Artificial Sequence
  source: /note="Description of Artificial Sequence: Synthetic polynucleotide"
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 123 - protein, 1386 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRILYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIEEFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADHHHHHH

SEQ ID NO: 124 - DNA, 401 bp, Artificial Sequence
  source: /note="Description of Artificial Sequence: Synthetic polynucleotide"
gaattcctgttgcaaagtgacctgctttggcataactagcactctcatgataggttggcacattagtttcctgtcaattgtgttgacaagcacatgagaatcatggaaatccttggtgttaatctaaaccagtgactatgcattgccagttacagttaacttccaggaaaatctcaaaattcagtgccagttacctggtagattgtaatcagttaagcaaaaagccaaatacaagccattcaccttacagagagagaagcatattcaccttacagagagagaagcataaatgagaaacacatcatcattgtcacagtaactgtggtaacctattgtaaaagattcacagtgcaaaagagcctgactacatattacagtgggtaaaatggatcggtcttgta

SEQ ID NO: 125 - DNA, 312 bp, Artificial Sequence
  source: /note="Description of Artificial Sequence: Synthetic polynucleotide"
tgaggggaaaatagatacatgttatatatatatatatatatatatatgttctataccaacaaagggttcagggtataattttgcatgtaaaggggtgacccagagtagagataaagaacaaaatattctgttgaaaaaactatgaatcaatcaacctaatgaattatcaacatggatgtaggtgtagttgaagaagatggtcagtgagaatatggaaacagatatcaggaattaaagtcatattctagggcagaaaagcattcatggaggtattagatgatagctgaagtaatttgaagaagctggtgtgaa

SEQ ID NO: 126 - DNA, 3518 bp, Artificial Sequence
  source: /note="Description of Artificial Sequence: Synthetic polynucleotide"
gaattcctgttgcaaagtgacctgctttggcataactagcactctcatgataggttggcacattagtttcctgtcaattgtgttgacaagcacatgagaatcatggaaatccttggtgttaatctaaaccagtgactatgcattgccagttacagttaacttccaggaaaatctcaaaattcagtgccagttacctggtagattgtaatcagttaagcaaaaagccaaatacaagccattcaccttacagagagagaagcatattcaccttacagagagagaagcataaatgagaaacacatcatcattgtcacagtaactgtggtaacctattgtaaaagattcacagtgcaaaagagcctgactacatattacagtgggtaaaatggatcggtcttgtaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccactgagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgatctagaggatccatggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaagtcgacgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggatgaggggaaaatagatacatgttatatatatatatatatatatatatgttctataccaacaaagggttcagggtataattttgcatgtaaaggggtgacccagagtagagataaagaacaaaatattctgttgaaaaaactatgaatcaatcaacctaatgaattatcaacatggatgtaggtgtagttgaagaagatggtcagtgagaatatggaaacagatatcaggaattaaagtcatattctagggcagaaaagcattcatggaggtattagatgatagctgaagtaatttgaagaagctggtgtgaa

SEQ ID NO: 127-129 - skipped (3 entries)

SEQ ID NO: 130 - protein, 21 aa, Artificial Sequence
  source: /note="Description of Artificial Sequence: Synthetic peptide"
  VARIANT (1)..(3): /replace=" "
  misc_feature (1)..(21): /note="Variant residues given in the sequence have no preference with respect to those in the annotations for variant positions"
GSGEGRGSLLTCGDVEENPGP

SEQ ID NO: 131 - protein, 22 aa, Artificial Sequence
  source: /note="Description of Artificial Sequence: Synthetic peptide"
  VARIANT (1)..(3): /replace=" "
  misc_feature (1)..(22): /note="Variant residues given in the sequence have no preference with respect to those in the annotations for variant positions"
GSGATNFSLLKQAGDVEENPGP

SEQ ID NO: 132 - protein, 23 aa, Artificial Sequence
  source: /note="Description of Artificial Sequence: Synthetic peptide"
  VARIANT (1)..(3): /replace=" "
  misc_feature (1)..(23): /note="Variant residues given in the sequence have no preference with respect to those in the annotations for variant positions"
GSGQCTNYALLKLAGDVESNPGP

SEQ ID NO: 133 - protein, 25 aa, Artificial Sequence
  source: /note="Description of Artificial Sequence: Synthetic peptide"
  VARIANT (1)..(3): /replace=" "
  misc_feature (1)..(25): /note="Variant residues given in the sequence have no preference with respect to those in the annotations for variant positions"
GSGVKQTLNFDLLKLAGDVESNPGP

SEQ ID NO: 134-149 - skipped (16 entries)

SEQ ID NO: 150 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 151 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 152 - skipped

SEQ ID NO: 153 - protein, 243 aa, Artificial Sequence
  source: /note="Description of Artificial Sequence: Synthetic polypeptide"
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 154 - protein, 245 aa, Artificial Sequence
  source: /note="Description of Artificial Sequence: Synthetic polypeptide"
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 155 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 156 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 157 - protein, 336 aa, Artificial Sequence
  source: /note="Description of Artificial Sequence: Synthetic polypeptide"
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 158 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 159 - skipped

SEQ ID NO: 160 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 161 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 162 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 163 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 164 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 165 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 166 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 167 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 168 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 169 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 170 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 171 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 172 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 173 - protein, 119 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 174 - protein, 111 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 175 - protein, 248 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGSTSGSGKPGSGEGSTKGELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 176 - protein, 10 aa, Artificial Sequence
  source: /note="Description of Artificial Sequence: Synthetic peptide"
GVSLPDYGVS

SEQ ID NO: 177 - protein, 16 aa, Artificial Sequence
  source: /note="Description of Artificial Sequence: Synthetic peptide"
VIWGSETTYYNSALKS

SEQ ID NO: 178 - protein, 16 aa, Artificial Sequence
  source: /note="Description of Artificial Sequence: Synthetic peptide"
VIWGSETTYYSSSLKS

SEQ ID NO: 179 - protein, 16 aa, Artificial Sequence
  source: /note="Description of Artificial Sequence: Synthetic peptide"
VIWGSETTYYQSSLKS

SEQ ID NO: 180 - protein, 16 aa, Artificial Sequence
  source: /note="Description of Artificial Sequence: Synthetic peptide"
VIWGSETTYYNSSLKS

SEQ ID NO: 181 - protein, 12 aa, Artificial Sequence
  source: /note="Description of Artificial Sequence: Synthetic peptide"
HYYYGGSYAMDY

SEQ ID NO: 182 - protein, 11 aa, Artificial Sequence
  source: /note="Description of Artificial Sequence: Synthetic peptide"
RASQDISKYLN

SEQ ID NO: 183 - protein, 7 aa, Artificial Sequence
  source: /note="Description of Artificial Sequence: Synthetic peptide"
HTSRLHS

SEQ ID NO: 184 - protein, 9 aa, Artificial Sequence
  source: /note="Description of Artificial Sequence: Synthetic peptide"
QQGNTLPYT

SEQ ID NO: 185 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 186 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 187 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 188 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 189 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 190 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 191 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 192 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 193 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 194 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 195 - protein, 491 aa, Artificial Sequence; identical to SEQ ID NO: 194
  source: /note="Description of Artificial Sequence: Synthetic polypeptide"

SEQ ID NO: 196 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 197 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 198-238 - skipped (41 entries)

SEQ ID NO: 239 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 240 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 241 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 242 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 243 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 244 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 245 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 246 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 247 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 248 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 249 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 250 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 251 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 252 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 253 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 254 - DNA, 738 bp, Artificial Sequence
  source: /note="Description of Artificial Sequence: Synthetic polynucleotide"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 255 - DNA, 732 bp, Artificial Sequence
  source: /note="Description of Artificial Sequence: Synthetic polynucleotide"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 256 - DNA, 729 bp, Artificial Sequence
  source: /note="Description of Artificial Sequence: Synthetic polynucleotide"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 257 - DNA, 747 bp, Artificial Sequence
  source: /note="Description of Artificial Sequence: Synthetic polynucleotide"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 258 - DNA, 738 bp, Artificial Sequence
  source: /note="Description of Artificial Sequence: Synthetic polynucleotide"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 259 - DNA, 741 bp, Artificial Sequence
  source: /note="Description of Artificial Sequence: Synthetic polynucleotide"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 260 - DNA, 714 bp, Artificial Sequence
  source: /note="Description of Artificial Sequence: Synthetic polynucleotide"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 261 - DNA, 717 bp, Artificial Sequence
  source: /note="Description of Artificial Sequence: Synthetic polynucleotide"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 262 - DNA, 723 bp, Artificial Sequence
  source: /note="Description of Artificial Sequence: Synthetic polynucleotide"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 263 - DNA, 717 bp, Artificial Sequence
  source: /note="Description of Artificial Sequence: Synthetic polynucleotide"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 264 - DNA, 717 bp, Artificial Sequence
  source: /note="Description of Artificial Sequence: Synthetic polynucleotide"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 265 - DNA, 738 bp, Artificial Sequence
  source: /note="Description of Artificial Sequence: Synthetic polynucleotide"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 266 - DNA, 717 bp, Artificial Sequence
  source: /note="Description of Artificial Sequence: Synthetic polynucleotide"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 267 - DNA, 720 bp, Artificial Sequence
  source: /note="Description of Artificial Sequence: Synthetic polynucleotide"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 268 - DNA, 723 bp, Artificial Sequence
  source: /note="Description of Artificial Sequence: Synthetic polynucleotide"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 269 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 270 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 271 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 272 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 273 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 274 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 275 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 276 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 277 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 278 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 279 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 280 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 281 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 282 - protein, 115 aa, Artificial Sequence; identical to SEQ ID NO: 276
  source: /note="Description of Artificial Sequence: Synthetic polypeptide"

SEQ ID NO: 283 - protein, 115 aa, Artificial Sequence; identical to SEQ ID NO: 279
  source: /note="Description of Artificial Sequence: Synthetic polypeptide"

SEQ ID NO: 284 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 285 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 286 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 287 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 288 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 289 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 290 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 291 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 292 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 293 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 294 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 295 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 296 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 297 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 298 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 299-328 - skipped (30 entries)

SEQ ID NO: 329 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 330 - protein, 245 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 331 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 332 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 333 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 334 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 335 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 336 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 337 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 338 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 339 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 340 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 341 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 342 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 343 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 344 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 345 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 346 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 347 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 348 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 349 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 350 - DNA, 729 bp, Artificial Sequence
  source: /note="Description of Artificial Sequence: Synthetic polynucleotide"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 351 - DNA, 735 bp, Artificial Sequence
  source: /note="Description of Artificial Sequence: Synthetic polynucleotide"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 352 - DNA, 738 bp, Artificial Sequence
  source: /note="Description of Artificial Sequence: Synthetic polynucleotide"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 353 - DNA, 720 bp, Artificial Sequence
  source: /note="Description of Artificial Sequence: Synthetic polynucleotide"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 354 - DNA, 723 bp, Artificial Sequence
  source: /note="Description of Artificial Sequence: Synthetic polynucleotide"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 355 - DNA, 735 bp, Artificial Sequence
  source: /note="Description of Artificial Sequence: Synthetic polynucleotide"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 356 - DNA, 759 bp, Artificial Sequence
  source: /note="Description of Artificial Sequence: Synthetic polynucleotide"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 357 - DNA, 744 bp, Artificial Sequence
  source: /note="Description of Artificial Sequence: Synthetic polynucleotide"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 358 - DNA, 738 bp, Artificial Sequence
  source: /note="Description of Artificial Sequence: Synthetic polynucleotide"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 359 - DNA, 723 bp, Artificial Sequence
  source: /note="Description of Artificial Sequence: Synthetic polynucleotide"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 360 - DNA, 744 bp, Artificial Sequence
  source: /note="Description of Artificial Sequence: Synthetic polynucleotide"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 361 - DNA, 744 bp, Artificial Sequence
  source: /note="Description of Artificial Sequence: Synthetic polynucleotide"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 362 - DNA, 717 bp, Artificial Sequence
  source: /note="Description of Artificial Sequence: Synthetic polynucleotide"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 363 - DNA, 738 bp, Artificial Sequence
  source: /note="Description of Artificial Sequence: Synthetic polynucleotide"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 364 - DNA, 723 bp, Artificial Sequence
  source: /note="Description of Artificial Sequence: Synthetic polynucleotide"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 365 - DNA, 726 bp, Artificial Sequence
  source: /note="Description of Artificial Sequence: Synthetic polynucleotide"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 366 - DNA, 744 bp, Artificial Sequence
  source: /note="Description of Artificial Sequence: Synthetic polynucleotide"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 367 - DNA, 732 bp, Artificial Sequence
  source: /note="Description of Artificial Sequence: Synthetic polynucleotide"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 368 - DNA, 733 bp, Artificial Sequence
  source: /note="Description of Artificial Sequence: Synthetic polynucleotide"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 369 - DNA, 753 bp, Artificial Sequence
  source: /note="Description of Artificial Sequence: Synthetic polynucleotide"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 370 - DNA, 739 bp, Artificial Sequence
  source: /note="Description of Artificial Sequence: Synthetic polynucleotide"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 371 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 372 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 373 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 374 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 375 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 376 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 377 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 378 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 379 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 380 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 381 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 382 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 383 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 384 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 385 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 386 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 387 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 388 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 389 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 390 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 391 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 392 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 393 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 394 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 395 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 396 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 397 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 398 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 399 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 400 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 401 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 402 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 403 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 404 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 405 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 406 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 407 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 408 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 409 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 410 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 411 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 412 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 413-454 - skipped (42 entries)

SEQ ID NO: 455 - protein, 122 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 456 - protein, 117 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 457 - protein, 117 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 458 - protein, 117 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 459 - protein, 107 aa, Artificial Sequence
  source: /note="Description of Artificial Sequence: Synthetic polypeptide"
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 460 - protein, 111 aa, Artificial Sequence
  source: /note="Description of Artificial Sequence: Synthetic polypeptide"
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 461 - protein, 111 aa, Artificial Sequence
  source: /note="Description of Artificial Sequence: Synthetic polypeptide"
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 462 - protein, 111 aa, Artificial Sequence; identical to SEQ ID NO: 461
  source: /note="Description of Artificial Sequence: Synthetic polypeptide"

SEQ ID NO: 463 - protein, 244 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 464 - protein, 249 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 465 - protein, 243 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 466 - protein, 243 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 467-583 - skipped (117 entries)

SEQ ID NO: 584 - protein, 5 aa, Artificial Sequence
  source: /note="Description of Artificial Sequence: Synthetic peptide"
NYAMS

SEQ ID NO: 585 - protein, 5 aa, Artificial Sequence
  source: /note="Description of Artificial Sequence: Synthetic peptide"
DYAMH

SEQ ID NO: 586 - protein, 5 aa, Artificial Sequence
  source: /note="Description of Artificial Sequence: Synthetic peptide"
NHGMS

SEQ ID NO: 587 - protein, 5 aa, Artificial Sequence
  source: /note="Description of Artificial Sequence: Synthetic peptide"
NFGIN

SEQ ID NO: 588 - protein, 5 aa, Artificial Sequence
  source: /note="Description of Artificial Sequence: Synthetic peptide"
SDAMT

SEQ ID NO: 589 - protein, 5 aa, Artificial Sequence
  source: /note="Description of Artificial Sequence: Synthetic peptide"
NYGIT

SEQ ID NO: 590 - protein, 5 aa, Artificial Sequence
  source: /note="Description of Artificial Sequence: Synthetic peptide"
NHGMS

SEQ ID NO: 591 - protein, 5 aa, Artificial Sequence
  source: /note="Description of Artificial Sequence: Synthetic peptide"
NHGMS

SEQ ID NO: 592 - protein, 5 aa, Artificial Sequence
  source: /note="Description of Artificial Sequence: Synthetic peptide"
NHGMS

SEQ ID NO: 593 - protein, 5 aa, Artificial Sequence
  source: /note="Description of Artificial Sequence: Synthetic peptide"
DYYMS

SEQ ID NO: 594 - protein, 5 aa, Artificial Sequence
  source: /note="Description of Artificial Sequence: Synthetic peptide"
NHGMS

SEQ ID NO: 595 - protein, 5 aa, Artificial Sequence
  source: /note="Description of Artificial Sequence: Synthetic peptide"
DYYMS

SEQ ID NO: 596 - protein, 5 aa, Artificial Sequence
  source: /note="Description of Artificial Sequence: Synthetic peptide"
NHGMS

SEQ ID NO: 597 - protein, 5 aa, Artificial Sequence
  source: /note="Description of Artificial Sequence: Synthetic peptide"
NHGMS

SEQ ID NO: 598 - protein, 5 aa, Artificial Sequence
  source: /note="Description of Artificial Sequence: Synthetic peptide"
NHGMS

SEQ ID NO: 599 - protein, 7 aa, Artificial Sequence
  source: /note="Description of Artificial Sequence: Synthetic peptide"
SSYYYWG

SEQ ID NO: 600 - protein, 7 aa, Artificial Sequence
  source: /note="Description of Artificial Sequence: Synthetic peptide"
TSGMCVS

SEQ ID NO: 601 - protein, 5 aa, Artificial Sequence
  source: /note="Description of Artificial Sequence: Synthetic peptide"
SYSMN

SEQ ID NO: 602 - protein, 5 aa, Artificial Sequence
  source: /note="Description of Artificial Sequence: Synthetic peptide"
DYYMS

SEQ ID NO: 603 - protein, 5 aa, Artificial Sequence
  source: /note="Description of Artificial Sequence: Synthetic peptide"
SHYIH

SEQ ID NO: 604 - protein, 7 aa, Artificial Sequence
  source: /note="Description of Artificial Sequence: Synthetic peptide"
SGGYYWS

SEQ ID NO: 605 - protein, 5 aa, Artificial Sequence
  source: /note="Description of Artificial Sequence: Synthetic peptide"
SYAIS

SEQ ID NO: 606 - protein, 7 aa, Artificial Sequence
  source: /note="Description of Artificial Sequence: Synthetic peptide"
SNSAAWN

SEQ ID NO: 607 - protein, 5 aa, Artificial Sequence
  source: /note="Description of Artificial Sequence: Synthetic peptide"
SYAMS

SEQ ID NO: 608 - protein, 5 aa, Artificial Sequence
  source: /note="Description of Artificial Sequence: Synthetic peptide"
RYPMS

SEQ ID NO: 609 - protein, 5 aa, Artificial Sequence
  source: /note="Description of Artificial Sequence: Synthetic peptide"
SYAMS

SEQ ID NO: 610 - protein, 5 aa, Artificial Sequence
  source: /note="Description of Artificial Sequence: Synthetic peptide"
SYAMS

SEQ ID NO: 611 - protein, 5 aa, Artificial Sequence
  source: /note="Description of Artificial Sequence: Synthetic peptide"
DYAMH

SEQ ID NO: 612 - protein, 5 aa, Artificial Sequence
  source: /note="Description of Artificial Sequence: Synthetic peptide"
DYAMH

SEQ ID NO: 613 - protein, 5 aa, Artificial Sequence
  source: /note="Description of Artificial Sequence: Synthetic peptide"
SYAMS

SEQ ID NO: 614 - protein, 5 aa, Artificial Sequence
  source: /note="Description of Artificial Sequence: Synthetic peptide"
SYAMS

SEQ ID NO: 615 - protein, 5 aa, Artificial Sequence
  source: /note="Description of Artificial Sequence: Synthetic peptide"
SYAMS

SEQ ID NO: 616 - protein, 5 aa, Artificial Sequence
  source: /note="Description of Artificial Sequence: Synthetic peptide"
SYAMS

SEQ ID NO: 617 - protein, 5 aa, Artificial Sequence
  source: /note="Description of Artificial Sequence: Synthetic peptide"
SYAMS

SEQ ID NO: 618 - protein, 5 aa, Artificial Sequence
  source: /note="Description of Artificial Sequence: Synthetic peptide"
SYAMS

SEQ ID NO: 619 - protein, 5 aa, Artificial Sequence
  source: /note="Description of Artificial Sequence: Synthetic peptide"
SYAMS

SEQ ID NO: 620 - protein, 5 aa, Artificial Sequence
  source: /note="Description of Artificial Sequence: Synthetic peptide"
NFGMN

SEQ ID NO: 621 - protein, 5 aa, Artificial Sequence
  source: /note="Description of Artificial Sequence: Synthetic peptide"
DYSIN

SEQ ID NO: 622 - protein, 5 aa, Artificial Sequence
  source: /note="Description of Artificial Sequence: Synthetic peptide"
HYSMN

SEQ ID NO: 623 - protein, 5 aa, Artificial Sequence
  source: /note="Description of Artificial Sequence: Synthetic peptide"
HYSMN

SEQ ID NO: 624 - protein, 17 aa, Artificial Sequence
  source: /note="Description of Artificial Sequence: Synthetic peptide"
GISRSGENTYYADSVKG

SEQ ID NO: 625 - protein, 17 aa, Artificial Sequence
  source: /note="Description of Artificial Sequence: Synthetic peptide"
GISWNSGSIGYADSVKG

SEQ ID NO: 626 - protein, 16 aa, Artificial Sequence
  source: /note="Description of Artificial Sequence: Synthetic peptide"
GIVYSGSTYYAASVKG

SEQ ID NO: 627 - protein, 17 aa, Artificial Sequence
  source: /note="Description of Artificial Sequence: Synthetic peptide"
WINPKNNNTNYAQKFQG

SEQ ID NO: 628 - protein, 17 aa, Artificial Sequence
  source: /note="Description of Artificial Sequence: Synthetic peptide"
VISGSGGTTYYADSVKG

SEQ ID NO: 629 - protein, 17 aa, Artificial Sequence
  source: /note="Description of Artificial Sequence: Synthetic peptide"
WISAYNGNTNYAQKFQG

SEQ ID NO: 630 - protein, 16 aa, Artificial Sequence
  source: /note="Description of Artificial Sequence: Synthetic peptide"
GIVYSGSTYYAASVKG

SEQ ID NO: 631 - protein, 16 aa, Artificial Sequence
  source: /note="Description of Artificial Sequence: Synthetic peptide"
GIVYSGSTYYAASVKG

SEQ ID NO: 632 - protein, 16 aa, Artificial Sequence
  source: /note="Description of Artificial Sequence: Synthetic peptide"
GIVYSGSTYYAASVKG

SEQ ID NO: 633 - protein, 17 aa, Artificial Sequence
  source: /note="Description of Artificial Sequence: Synthetic peptide"
YISSSGSTIYYADSVKG

SEQ ID NO: 634 - protein, 16 aa, Artificial Sequence
  source: /note="Description of Artificial Sequence: Synthetic peptide"
GIVYSGSTYYAASVKG

SEQ ID NO: 635 - protein, 17 aa, Artificial Sequence
  source: /note="Description of Artificial Sequence: Synthetic peptide"
YISSSGNTIYYADSVKG

SEQ ID NO: 636 - protein, 16 aa, Artificial Sequence
  source: /note="Description of Artificial Sequence: Synthetic peptide"
GIVYSGSTYYAASVKG

SEQ ID NO: 637 - protein, 16 aa, Artificial Sequence
  source: /note="Description of Artificial Sequence: Synthetic peptide"
GIVYSGSTYYAASVKG

SEQ ID NO: 638 - protein, 16 aa, Artificial Sequence
  source: /note="Description of Artificial Sequence: Synthetic peptide"
GIVYSGSTYYAASVKG

SEQ ID NO: 639 - protein, 16 aa, Artificial Sequence
  source: /note="Description of Artificial Sequence: Synthetic peptide"
SIYYSGSAYYNPSLKS

SEQ ID NO: 640 - protein, 16 aa, Artificial Sequence
  source: /note="Description of Artificial Sequence: Synthetic peptide"
RIDWDEDKFYSTSLKT

SEQ ID NO: 641 - protein, 17 aa, Artificial Sequence
  source: /note="Description of Artificial Sequence: Synthetic peptide"
SISSSSSYIYYADSVKG

SEQ ID NO: 642 - protein, 17 aa, Artificial Sequence
  source: /note="Description of Artificial Sequence: Synthetic peptide"
YISSSGSTIYYADSVKG

SEQ ID NO: 643 - protein, 17 aa, Artificial Sequence
  source: /note="Description of Artificial Sequence: Synthetic peptide"
MINPSGGVTAYSQTLQG

SEQ ID NO: 644 - protein, 16 aa, Artificial Sequence
  source: /note="Description of Artificial Sequence: Synthetic peptide"
YIYYSGSTYYNPSLKS

SEQ ID NO: 645 - protein, 17 aa, Artificial Sequence
  source: /note="Description of Artificial Sequence: Synthetic peptide"
GIIPIFGTANYAQKFQG

SEQ ID NO: 646 - protein, 18 aa, Artificial Sequence
  source: /note="Description of Artificial Sequence: Synthetic peptide"
RTYYRSKWYSFYAISLKS

SEQ ID NO: 647 - protein, 17 aa, Artificial Sequence
  source: /note="Description of Artificial Sequence: Synthetic peptide"
AISGSGGSTYYADSVKG

SEQ ID NO: 648 - protein, 17 aa, Artificial Sequence
  source: /note="Description of Artificial Sequence: Synthetic peptide"
GISDSGVSTYYADSAKG

SEQ ID NO: 649 - protein, 17 aa, Artificial Sequence
  source: /note="Description of Artificial Sequence: Synthetic peptide"
AISGSGGSTYYADSVKG

SEQ ID NO: 650 - protein, 17 aa, Artificial Sequence
  source: /note="Description of Artificial Sequence: Synthetic peptide"
AISGSGGSTYYADSVKG

SEQ ID NO: 651 - protein, 17 aa, Artificial Sequence
  source: /note="Description of Artificial Sequence: Synthetic peptide"
GISWNSGSIGYADSVKG

SEQ ID NO: 652 - protein, 17 aa, Artificial Sequence
  source: /note="Description of Artificial Sequence: Synthetic peptide"
SINWKGNSLAYGDSVKG

SEQ ID NO: 653 - protein, 17 aa, Artificial Sequence
  source: /note="Description of Artificial Sequence: Synthetic peptide"
AISGSGGSTYYADSVKG

SEQ ID NO: 654 - protein, 17 aa, Artificial Sequence
  source: /note="Description of Artificial Sequence: Synthetic peptide"
AISGSGGSTYYADSVKG

SEQ ID NO: 655 - protein, 17 aa, Artificial Sequence
  source: /note="Description of Artificial Sequence: Synthetic peptide"
AISGSGGSTYYADSVKG

SEQ ID NO: 656 - protein, 17 aa, Artificial Sequence
  source: /note="Description of Artificial Sequence: Synthetic peptide"
AISGSGGSTYYADSVKG

SEQ ID NO: 657 - protein, 17 aa, Artificial Sequence
  source: /note="Description of Artificial Sequence: Synthetic peptide"
AISGSGGSTYYADSVKG

SEQ ID NO: 658 - protein, 17 aa, Artificial Sequence
  source: /note="Description of Artificial Sequence: Synthetic peptide"
AISGSGGSTYYADSVKG

SEQ ID NO: 659 - protein, 17 aa, Artificial Sequence
  source: /note="Description of Artificial Sequence: Synthetic peptide"
AISGSGGSTYYADSVKG

SEQ ID NO: 660 - protein, 17 aa, Artificial Sequence
  source: /note="Description of Artificial Sequence: Synthetic peptide"
WINTYTGESYFADDFKG

SEQ ID NO: 661 - protein, 17 aa, Artificial Sequence
  source: /note="Description of Artificial Sequence: Synthetic peptide"
WINTETREPAYAYDFRG

SEQ ID NO: 662 - protein, 17 aa, Artificial Sequence
  source: /note="Description of Artificial Sequence: Synthetic peptide"
RINTESGVPIYADDFKG

SEQ ID NO: 663 - protein, 17 aa, Artificial Sequence
  source: /note="Description of Artificial Sequence: Synthetic peptide"
RINTETGEPLYADDFKG

SEQ ID NO: 664 - protein, 11 aa, Artificial Sequence
  source: /note="Description of Artificial Sequence: Synthetic peptide"
SPAHYYGGMDV

SEQ ID NO: 665 - protein, 6 aa, Artificial Sequence
  source: /note="Description of Artificial Sequence: Synthetic peptide"
HSFLAY

SEQ ID NO: 666 - protein, 7 aa, Artificial Sequence
  source: /note="Description of Artificial Sequence: Synthetic peptide"
HGGESDV

SEQ ID NO: 667 - protein, 11 aa, Artificial Sequence
  source: /note="Description of Artificial Sequence: Synthetic peptide"
GPYYYQSYMDV

SEQ ID NO: 668 - protein, 14 aa, Artificial Sequence
  source: /note="Description of Artificial Sequence: Synthetic peptide"
LDSSGYYYARGPRY

SEQ ID NO: 669 - protein, 9 aa, Artificial Sequence
  source: /note="Description of Artificial Sequence: Synthetic peptide"
GPYYYYMDV

SEQ ID NO: 670 - protein, 7 aa, Artificial Sequence
  source: /note="Description of Artificial Sequence: Synthetic peptide"
HGGESDV

SEQ ID NO: 671 - protein, 7 aa, Artificial Sequence
  source: /note="Description of Artificial Sequence: Synthetic peptide"
HGGESDV

SEQ ID NO: 672 - protein, 7 aa, Artificial Sequence
  source: /note="Description of Artificial Sequence: Synthetic peptide"
HGGESDV

SEQ ID NO: 673 - protein, 8 aa, Artificial Sequence
  source: /note="Description of Artificial Sequence: Synthetic peptide"
ESGDGMDV

SEQ ID NO: 674 - protein, 7 aa, Artificial Sequence
  source: /note="Description of Artificial Sequence: Synthetic peptide"
HGGESDV

SEQ ID NO: 675 - protein, 8 aa, Artificial Sequence
  source: /note="Description of Artificial Sequence: Synthetic peptide"
STMVREDY

SEQ ID NO: 676 - protein, 7 aa, Artificial Sequence
  source: /note="Description of Artificial Sequence: Synthetic peptide"
HGGESDV

SEQ ID NO: 677 - protein, 7 aa, Artificial Sequence
  source: /note="Description of Artificial Sequence: Synthetic peptide"
HGGESDV

SEQ ID NO: 678 - protein, 7 aa, Artificial Sequence
  source: /note="Description of Artificial Sequence: Synthetic peptide"
HGGESDV

SEQ ID NO: 679 - protein, 11 aa, Artificial Sequence
  source: /note="Description of Artificial Sequence: Synthetic peptide"
HWQEWPDAFDI

SEQ ID NO: 680 - protein, 13 aa, Artificial Sequence
  source: /note="Description of Artificial Sequence: Synthetic peptide"
SGAGGTSATAFDI

SEQ ID NO: 681 - protein, 10 aa, Artificial Sequence
  source: /note="Description of Artificial Sequence: Synthetic peptide"
TIAAVYAFDI

SEQ ID NO: 682 - protein, 8 aa, Artificial Sequence
  source: /note="Description of Artificial Sequence: Synthetic peptide"
DLRGAFDI

SEQ ID NO: 683 - protein, 11 aa, Artificial Sequence
  source: /note="Description of Artificial Sequence: Synthetic peptide"
EGSGSGWYFDF

SEQ ID NO: 684 - protein, 13 aa, Artificial Sequence
  source: /note="Description of Artificial Sequence: Synthetic peptide"
AGIAARLRGAFDI

SEQ ID NO: 685 - protein, 20 aa, Artificial Sequence
  source: /note="Description of Artificial Sequence: Synthetic peptide"
RGGYQLLRWDVGLLRSAFDI

SEQ ID NO: 686 - protein, 13 aa, Artificial Sequence
  source: /note="Description of Artificial Sequence: Synthetic peptide"
SSPEGLFLYWFDP

SEQ ID NO: 687 - protein, 9 aa, Artificial Sequence
  source: /note="Description of Artificial Sequence: Synthetic peptide"
VEGSGSLDY

SEQ ID NO: 688 - protein, 9 aa, Artificial Sequence
  source: /note="Description of Artificial Sequence: Synthetic peptide"
RAGSEASDI

SEQ ID NO: 689 - protein, 15 aa, Artificial Sequence
  source: /note="Description of Artificial Sequence: Synthetic peptide"
ATYKRELRYYYGMDV

SEQ ID NO: 690 - protein, 15 aa, Artificial Sequence
  source: /note="Description of Artificial Sequence: Synthetic peptide"
ATYKRELRYYYGMDV

SEQ ID NO: 691 - protein, 8 aa, Artificial Sequence
  source: /note="Description of Artificial Sequence: Synthetic peptide"
VGKAVPDV

SEQ ID NO: 692 - protein, 13 aa, Artificial Sequence
  source: /note="Description of Artificial Sequence: Synthetic peptide"
HQGVAYYNYAMDV

SEQ ID NO: 693 - protein, 8 aa, Artificial Sequence
  source: /note="Description of Artificial Sequence: Synthetic peptide"
VVRDGMDV

SEQ ID NO: 694 - protein, 9 aa, Artificial Sequence
  source: /note="Description of Artificial Sequence: Synthetic peptide"
IPQTGTFDY

SEQ ID NO: 695 - protein, 15 aa, Artificial Sequence
  source: /note="Description of Artificial Sequence: Synthetic peptide"
ANYKRELRYYYGMDV

SEQ ID NO: 696 - protein, 11 aa, Artificial Sequence
  source: /note="Description of Artificial Sequence: Synthetic peptide"
ALVGATGAFDI

SEQ ID NO: 697 - protein, 8 aa, Artificial Sequence
  source: /note="Description of Artificial Sequence: Synthetic peptide"
WFGEGFDP

SEQ ID NO: 698 - protein, 17 aa, Artificial Sequence
  source: /note="Description of Artificial Sequence: Synthetic peptide"
VGYDSSGYYRDYYGMDV

SEQ ID NO: 699 - protein, 13 aa, Artificial Sequence
  source: /note="Description of Artificial Sequence: Synthetic peptide"
MGWSSGYLGAFDI

SEQ ID NO: 700 - protein, 13 aa, Artificial Sequence
  source: /note="Description of Artificial Sequence: Synthetic peptide"
GEIYYGYDGGFAY

SEQ ID NO: 701 - protein, 8 aa, Artificial Sequence
  source: /note="Description of Artificial Sequence: Synthetic peptide"
DYSYAMDY

SEQ ID NO: 702 - protein, 8 aa, Artificial Sequence
  source: /note="Description of Artificial Sequence: Synthetic peptide"
DYLYSLDF

SEQ ID NO: 703 - protein, 8 aa, Artificial Sequence
  source: /note="Description of Artificial Sequence: Synthetic peptide"
DYLYSCDY

SEQ ID NO: 704 - protein, 12 aa, Artificial Sequence
  source: /note="Description of Artificial Sequence: Synthetic peptide"
RASQSISSSFLA

SEQ ID NO: 705 - protein, 16 aa, Artificial Sequence
  source: /note="Description of Artificial Sequence: Synthetic peptide"
RSSQSLLHSNGYNYLD

SEQ ID NO: 706 - protein, 16 aa, Artificial Sequence
  source: /note="Description of Artificial Sequence: Synthetic peptide"
KSSQSLLRNDGKTPLY

SEQ ID NO: 707 - protein, 16 aa, Artificial Sequence
  source: /note="Description of Artificial Sequence: Synthetic peptide"
RSSQSLLHSNGYNYLN

SEQ ID NO: 708 - protein, 11 aa, Artificial Sequence
  source: /note="Description of Artificial Sequence: Synthetic peptide"
RASQSISSYLN

SEQ ID NO: 709 - protein, 16 aa, Artificial Sequence
  source: /note="Description of Artificial Sequence: Synthetic peptide"
RSSQSLLYSNGYNYVD

SEQ ID NO: 710 - protein, 11 aa, Artificial Sequence
  source: /note="Description of Artificial Sequence: Synthetic peptide"
RASQSVSSNLA

SEQ ID NO: 711 - protein, 11 aa, Artificial Sequence
  source: /note="Description of Artificial Sequence: Synthetic peptide"
RASQSVSSKLA

SEQ ID NO: 712 - protein, 12 aa, Artificial Sequence
  source: /note="Description of Artificial Sequence: Synthetic peptide"
RASQSVGSTNLA

SEQ ID NO: 713 - protein, 11 aa, Artificial Sequence
  source: /note="Description of Artificial Sequence: Synthetic peptide"
RASQSISSYLN

SEQ ID NO: 714 - protein, 11 aa, Artificial Sequence
  source: /note="Description of Artificial Sequence: Synthetic peptide"
RASQSISSYLN

SEQ ID NO: 715 - protein, 16 aa, Artificial Sequence
  source: /note="Description of Artificial Sequence: Synthetic peptide"
KSSESLVHNSGKTYLN

SEQ ID NO: 716 - protein, 11 aa, Artificial Sequence
  source: /note="Description of Artificial Sequence: Synthetic peptide"
QASEDINKFLN

SEQ ID NO: 717 - protein, 11 aa, Artificial Sequence
  source: /note="Description of Artificial Sequence: Synthetic peptide"
RASQSVGSNLA

SEQ ID NO: 718 - protein, 12 aa, Artificial Sequence
  source: /note="Description of Artificial Sequence: Synthetic peptide"
RASQSIGSSSLA

SEQ ID NO: 719 - protein, 11 aa, Artificial Sequence
  source: /note="Description of Artificial Sequence: Synthetic peptide"
KASQDIDDAMN

SEQ ID NO: 720 - protein, 11 aa, Artificial Sequence
  source: /note="Description of Artificial Sequence: Synthetic peptide"
RASQDIYNNLA

SEQ ID NO: 721 - protein, 16 aa, Artificial Sequence
  source: /note="Description of Artificial Sequence: Synthetic peptide"
RSSQSLLHSNGYNYLD

SEQ ID NO: 722 - protein, 11 aa, Artificial Sequence
  source: /note="Description of Artificial Sequence: Synthetic peptide"
GGNNIGTKSVH

SEQ ID NO: 723 - protein, 11 aa, Artificial Sequence
  source: /note="Description of Artificial Sequence: Synthetic peptide"
SGDGLSKKYVS

SEQ ID NO: 724 - protein, 11 aa, Artificial Sequence
  source: /note="Description of Artificial Sequence: Synthetic peptide"
RASQGIRNWLA

SEQ ID NO: 725 - protein, 11 aa, Artificial Sequence
  source: /note="Description of Artificial Sequence: Synthetic peptide"
GGNNIGSKSVH

SEQ ID NO: 726 - protein, 11 aa, Artificial Sequence
  source: /note="Description of Artificial Sequence: Synthetic peptide"
QGDSLGNYYAT

SEQ ID NO: 727 - protein, 12 aa, Artificial Sequence
  source: /note="Description of Artificial Sequence: Synthetic peptide"
RASQSVSSAYLA

SEQ ID NO: 728 - protein, 11 aa, Artificial Sequence
  source: /note="Description of Artificial Sequence: Synthetic peptide"
RASQSVSNSLA

SEQ ID NO: 729 - protein, 12 aa, Artificial Sequence
  source: /note="Description of Artificial Sequence: Synthetic peptide"
RASQSVSSSFLA

SEQ ID NO: 730 - protein, 12 aa, Artificial Sequence
  source: /note="Description of Artificial Sequence: Synthetic peptide"
RASQSVSTTFLA

SEQ ID NO: 731 - protein, 11 aa, Artificial Sequence
  source: /note="Description of Artificial Sequence: Synthetic peptide"
RASQSISSYLN

SEQ ID NO: 732 - protein, 12 aa, Artificial Sequence
  source: /note="Description of Artificial Sequence: Synthetic peptide"
RATQSIGSSFLA

SEQ ID NO: 733 - protein, 12 aa, Artificial Sequence
  source: /note="Description of Artificial Sequence: Synthetic peptide"
RASQSVSSSYLA

SEQ ID NO: 734 - protein, 12 aa, Artificial Sequence
  source: /note="Description of Artificial Sequence: Synthetic peptide"
RASQSVSSSYLA

SEQ ID NO: 735 - protein, 12 aa, Artificial Sequence
  source: /note="Description of Artificial Sequence: Synthetic peptide"
RASQRVASNYLA

SEQ ID NO: 736 - protein, 12 aa, Artificial Sequence
  source: /note="Description of Artificial Sequence: Synthetic peptide"
RASQSLSSNFLA

SEQ ID NO: 737 - protein, 16 aa, Artificial Sequence
  source: /note="Description of Artificial Sequence: Synthetic peptide"
RSSQSLLHSNGYNYLD

SEQ ID NO: 738 - protein, 12 aa, Artificial Sequence
  source: /note="Description of Artificial Sequence: Synthetic peptide"
RASQSVSSSYLA

SEQ ID NO: 739 - protein, 12 aa, Artificial Sequence
  source: /note="Description of Artificial Sequence: Synthetic peptide"
RASQSVASSFLA

SEQ ID NO: 740 - protein, 11 aa, Artificial Sequence
  source: /note="Description of Artificial Sequence: Synthetic peptide"
RASQDVNTAVS

SEQ ID NO: 741 - protein, 15 aa, Artificial Sequence
  source: /note="Description of Artificial Sequence: Synthetic peptide"
RASESVSVIGAHLIH

SEQ ID NO: 742 - protein, 15 aa, Artificial Sequence
  source: /note="Description of Artificial Sequence: Synthetic peptide"
RASESVTILGSHLIY

SEQ ID NO: 743 - protein, 15 aa, Artificial Sequence
  source: /note="Description of Artificial Sequence: Synthetic peptide"
RASESVTILGSHLIY

SEQ ID NO: 744 - protein, 7 aa, Artificial Sequence
  source: /note="Description of Artificial Sequence: Synthetic peptide"
GASRRAT

SEQ ID NO: 745 - protein, 7 aa, Artificial Sequence
  source: /note="Description of Artificial Sequence: Synthetic peptide"
LGSNRAS

SEQ ID NO: 746 - protein, 7 aa, Artificial Sequence
  source: /note="Description of Artificial Sequence: Synthetic peptide"
EVSNRFS

SEQ ID NO: 747 - protein, 7 aa, Artificial Sequence
  source: /note="Description of Artificial Sequence: Synthetic peptide"
LGSKRAS

SEQ ID NO: 748 - protein, 7 aa, Artificial Sequence
  source: /note="Description of Artificial Sequence: Synthetic peptide"
GASTLAS

SEQ ID NO: 749 - protein, 7 aa, Artificial Sequence
  source: /note="Description of Artificial Sequence: Synthetic peptide"
LGSNRAS

SEQ ID NO: 750 - protein, 7 aa, Artificial Sequence
  source: /note="Description of Artificial Sequence: Synthetic peptide"
GASTRAS

SEQ ID NO: 751 - protein, 7 aa, Artificial Sequence
  source: /note="Description of Artificial Sequence: Synthetic peptide"
GASIRAT

SEQ ID NO: 752 - protein, 7 aa, Artificial Sequence
  source: /note="Description of Artificial Sequence: Synthetic peptide"
DASNRAT

SEQ ID NO: 753 - protein, 7 aa, Artificial Sequence
  source: /note="Description of Artificial Sequence: Synthetic peptide"
AASSLQS

SEQ ID NO: 754 - protein, 7 aa, Artificial Sequence
  source: /note="Description of Artificial Sequence: Synthetic peptide"
AASSLQS

SEQ ID NO: 755 - protein, 7 aa, Artificial Sequence
  source: /note="Description of Artificial Sequence: Synthetic peptide"
EVSNRDS

SEQ ID NO: 756 - protein, 7 aa, Artificial Sequence
  source: /note="Description of Artificial Sequence: Synthetic peptide"
DASTLQT

SEQ ID NO: 757 - protein, 7 aa, Artificial Sequence
  source: /note="Description of Artificial Sequence: Synthetic peptide"
GASTRAT

SEQ ID NO: 758 - protein, 7 aa, Artificial Sequence
  source: /note="Description of Artificial Sequence: Synthetic peptide"
GASSRAS

SEQ ID NO: 759 - protein, 7 aa, Artificial Sequence
  source: /note="Description of Artificial Sequence: Synthetic peptide"
SATSPVP

SEQ ID NO: 760 - protein, 7 aa, Artificial Sequence
  source: /note="Description of Artificial Sequence: Synthetic peptide"
AANKSQS

SEQ ID NO: 761 - protein, 7 aa, Artificial Sequence
  source: /note="Description of Artificial Sequence: Synthetic peptide"
LGSNRAS

SEQ ID NO: 762 - protein, 7 aa, Artificial Sequence
  source: /note="Description of Artificial Sequence: Synthetic peptide"
DDSVRPS

SEQ ID NO: 763 - protein, 7 aa, Artificial Sequence
  source: /note="Description of Artificial Sequence: Synthetic peptide"
RDKERPS

SEQ ID NO: 764 - protein, 7 aa, Artificial Sequence
  source: /note="Description of Artificial Sequence: Synthetic peptide"
AASNLQS

SEQ ID NO: 765 - protein, 7 aa, Artificial Sequence
  source: /note="Description of Artificial Sequence: Synthetic peptide"
GKNNRPS

SEQ ID NO: 766 - protein, 7 aa, Artificial Sequence
  source: /note="Description of Artificial Sequence: Synthetic peptide"
GTNNRPS

SEQ ID NO: 767 - protein, 7 aa, Artificial Sequence
  source: /note="Description of Artificial Sequence: Synthetic peptide"
GASTRAT

SEQ ID NO: 768 - protein, 7 aa, Artificial Sequence
  source: /note="Description of Artificial Sequence: Synthetic peptide"
DASSRAT

SEQ ID NO: 769 - protein, 7 aa, Artificial Sequence
  source: /note="Description of Artificial Sequence: Synthetic peptide"
GASSRAT

SEQ ID NO: 770 - protein, 7 aa, Artificial Sequence
  source: /note="Description of Artificial Sequence: Synthetic peptide"
GSSNRAT

SEQ ID NO: 771 - protein, 7 aa, Artificial Sequence
  source: /note="Description of Artificial Sequence: Synthetic peptide"
AASSLQS

SEQ ID NO: 772 - protein, 7 aa, Artificial Sequence
  source: /note="Description of Artificial Sequence: Synthetic peptide"
GASQRAT

SEQ ID NO: 773 - protein, 7 aa, Artificial Sequence
  source: /note="Description of Artificial Sequence: Synthetic peptide"
GASSRAT

SEQ ID NO: 774 - protein, 7 aa, Artificial Sequence
  source: /note="Description of Artificial Sequence: Synthetic peptide"
GASSRAT

SEQ ID NO: 775 - protein, 7 aa, Artificial Sequence
  source: /note="Description of Artificial Sequence: Synthetic peptide"
GASSRAT

SEQ ID NO: 776 - protein, 7 aa, Artificial Sequence
  source: /note="Description of Artificial Sequence: Synthetic peptide"
GASNWAT

SEQ ID NO: 777 - protein, 7 aa, Artificial Sequence
  source: /note="Description of Artificial Sequence: Synthetic peptide"
LGSNRAS

SEQ ID NO: 778 - protein, 7 aa, Artificial Sequence
  source: /note="Description of Artificial Sequence: Synthetic peptide"
GTSSRAT

SEQ ID NO: 779 - protein, 7 aa, Artificial Sequence
  source: /note="Description of Artificial Sequence: Synthetic peptide"
GASGRAT

SEQ ID NO: 780 - protein, 7 aa, Artificial Sequence
  source: /note="Description of Artificial Sequence: Synthetic peptide"
SASYRYT

SEQ ID NO: 781 - protein, 7 aa, Artificial Sequence
  source: /note="Description of Artificial Sequence: Synthetic peptide"
LASNLET

SEQ ID NO: 782 - protein, 7 aa, Artificial Sequence
  source: /note="Description of Artificial Sequence: Synthetic peptide"
LASNVQT

SEQ ID NO: 783 - protein, 7 aa, Artificial Sequence
  source: /note="Description of Artificial Sequence: Synthetic peptide"
LASNVQT

SEQ ID NO: 784 - protein, 10 aa, Artificial Sequence
  source: /note="Description of Artificial Sequence: Synthetic peptide"
QQYHSSPSWT

SEQ ID NO: 785 - protein, 9 aa, Artificial Sequence
  source: /note="Description of Artificial Sequence: Synthetic peptide"
MQALQTPYT

SEQ ID NO: 786 - protein, 8 aa, Artificial Sequence
  source: /note="Description of Artificial Sequence: Synthetic peptide"
MQNIQFPS

SEQ ID NO: 787 - protein, 9 aa, Artificial Sequence
  source: /note="Description of Artificial Sequence: Synthetic peptide"
MQALQTPYT

SEQ ID NO: 788 - protein, 8 aa, Artificial Sequence
  source: /note="Description of Artificial Sequence: Synthetic peptide"
QQSYKRAS

SEQ ID NO: 789 - protein, 9 aa, Artificial Sequence
  source: /note="Description of Artificial Sequence: Synthetic peptide"
MQGRQFPYS

SEQ ID NO: 790 - protein, 8 aa, Artificial Sequence
  source: /note="Description of Artificial Sequence: Synthetic peptide"
QQYGSSLT

SEQ ID NO: 791 - protein, 9 aa, Artificial Sequence
  source: /note="Description of Artificial Sequence: Synthetic peptide"
QQYGSSSWT

SEQ ID NO: 792 - protein, 10 aa, Artificial Sequence
  source: /note="Description of Artificial Sequence: Synthetic peptide"
QQYGSSPPWT

SEQ ID NO: 793 - protein, 7 aa, Artificial Sequence
  source: /note="Description of Artificial Sequence: Synthetic peptide"
QQSYTLA

SEQ ID NO: 794 - protein, 9 aa, Artificial Sequence
  source: /note="Description of Artificial Sequence: Synthetic peptide"
QQSYSTPYT

SEQ ID NO: 795 - protein, 9 aa, Artificial Sequence
  source: /note="Description of Artificial Sequence: Synthetic peptide"
MQGTHWPGT

SEQ ID NO: 796 - protein, 9 aa, Artificial Sequence
  source: /note="Description of Artificial Sequence: Synthetic peptide"
QQYESLPLT

SEQ ID NO: 797 - protein, 10 aa, Artificial Sequence
  source: /note="Description of Artificial Sequence: Synthetic peptide"
QQYNDWLPVT

SEQ ID NO: 798 - protein, 10 aa, Artificial Sequence
  source: /note="Description of Artificial Sequence: Synthetic peptide"
QQYAGSPPFT

SEQ ID NO: 799 - protein, 9 aa, Artificial Sequence
  source: /note="Description of Artificial Sequence: Synthetic peptide"
LQHDNFPLT

SEQ ID NO: 800 - protein, 9 aa, Artificial Sequence
  source: /note="Description of Artificial Sequence: Synthetic peptide"
QHYYRFPYS

SEQ ID NO: 801 - protein, 9 aa, Artificial Sequence
  source: /note="Description of Artificial Sequence: Synthetic peptide"
MQALQTPYT

SEQ ID NO: 802 - protein, 11 aa, Artificial Sequence
  source: /note="Description of Artificial Sequence: Synthetic peptide"
QVWDSDSEHVV

SEQ ID NO: 803 - protein, 9 aa, Artificial Sequence
  source: /note="Description of Artificial Sequence: Synthetic peptide"
QAWDDTTVV

SEQ ID NO: 804 - protein, 9 aa, Artificial Sequence
  source: /note="Description of Artificial Sequence: Synthetic peptide"
QKYNSAPFT

SEQ ID NO: 805 - protein, 12 aa, Artificial Sequence
  source: /note="Description of Artificial Sequence: Synthetic peptide"
SSRDSSGDHLRV

SEQ ID NO: 806 - protein, 11 aa, Artificial Sequence
  source: /note="Description of Artificial Sequence: Synthetic peptide"
NSRDSSGHHLL

SEQ ID NO: 807 - protein, 14 aa, Artificial Sequence
  source: /note="Description of Artificial Sequence: Synthetic peptide"
QHYGSSFNGSSLFT

SEQ ID NO: 808 - protein, 10 aa, Artificial Sequence
  source: /note="Description of Artificial Sequence: Synthetic peptide"
QQFGTSSGLT

SEQ ID NO: 809 - protein, 10 aa, Artificial Sequence
  source: /note="Description of Artificial Sequence: Synthetic peptide"
QQYHSSPSWT

SEQ ID NO: 810 - protein, 10 aa, Artificial Sequence
  source: /note="Description of Artificial Sequence: Synthetic peptide"
QQYHSSPSWT

SEQ ID NO: 811 - protein, 9 aa, Artificial Sequence
  source: /note="Description of Artificial Sequence: Synthetic peptide"
QQSYSTPYS

SEQ ID NO: 812 - protein, 10 aa, Artificial Sequence
  source: /note="Description of Artificial Sequence: Synthetic peptide"
QHYESSPSWT

SEQ ID NO: 813 - protein, 10 aa, Artificial Sequence
  source: /note="Description of Artificial Sequence: Synthetic peptide"
QQYGSPPRFT

SEQ ID NO: 814 - protein, 10 aa, Artificial Sequence
  source: /note="Description of Artificial Sequence: Synthetic peptide"
QHYGSSPSWT

SEQ ID NO: 815 - protein, 10 aa, Artificial Sequence
  source: /note="Description of Artificial Sequence: Synthetic peptide"
QHYDSSPSWT

SEQ ID NO: 816 - protein, 10 aa, Artificial Sequence
  source: /note="Description of Artificial Sequence: Synthetic peptide"
QYYGTSPMYT

SEQ ID NO: 817 - protein, 9 aa, Artificial Sequence
  source: /note="Description of Artificial Sequence: Synthetic peptide"
MQALQTPLT

SEQ ID NO: 818 - protein, 11 aa, Artificial Sequence
  source: /note="Description of Artificial Sequence: Synthetic peptide"
QHYGNSPPKFT

SEQ ID NO: 819 - protein, 10 aa, Artificial Sequence
  source: /note="Description of Artificial Sequence: Synthetic peptide"
QHYGGSPRLT

SEQ ID NO: 820 - protein, 9 aa, Artificial Sequence
  source: /note="Description of Artificial Sequence: Synthetic peptide"
QQHYSTPWT

SEQ ID NO: 821 - protein, 9 aa, Artificial Sequence
  source: /note="Description of Artificial Sequence: Synthetic peptide"
LQSRIFPRT

SEQ ID NO: 822 - protein, 9 aa, Artificial Sequence
  source: /note="Description of Artificial Sequence: Synthetic peptide"
LQSRTIPRT

SEQ ID NO: 823 - protein, 9 aa, Artificial Sequence
  source: /note="Description of Artificial Sequence: Synthetic peptide"
LQSRTIPRT

SEQ ID NO: 824-848 - skipped (25 entries)

SEQ ID NO: 849 - protein, 490 aa, Artificial Sequence
  source: /note="Description of Artificial Sequence: Synthetic polypeptide"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 850 - protein, 488 aa, Artificial Sequence
  source: /note="Description of Artificial Sequence: Synthetic polypeptide"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 851 - protein, 487 aa, Artificial Sequence
  source: /note="Description of Artificial Sequence: Synthetic polypeptide"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 852 - protein, 493 aa, Artificial Sequence
  source: /note="Description of Artificial Sequence: Synthetic polypeptide"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 853 - protein, 490 aa, Artificial Sequence
  source: /note="Description of Artificial Sequence: Synthetic polypeptide"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 854 - protein, 491 aa, Artificial Sequence
  source: /note="Description of Artificial Sequence: Synthetic polypeptide"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 855 - protein, 482 aa, Artificial Sequence
  source: /note="Description of Artificial Sequence: Synthetic polypeptide"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 856 - protein, 483 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 857 - protein, 485 aa, Artificial Sequence
  source: /note="Description of Artificial Sequence: Synthetic polypeptide"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 858 - protein, 483 aa, Artificial Sequence
  source: /note="Description of Artificial Sequence: Synthetic polypeptide"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 859 - protein, 483 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 860 - protein, 490 aa, Artificial Sequence
  source: /note="Description of Artificial Sequence: Synthetic polypeptide"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 861 - protein, 483 aa, Artificial Sequence
  source: /note="Description of Artificial Sequence: Synthetic polypeptide"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 862 - protein, 484 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 863 - protein, 485 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 864 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 865 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 866 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 867 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 868 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 869 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 870 - DNA, 1446 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 871 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 872 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 873 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 874 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 875 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 876 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 877 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 878 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 879 - protein, 487 aa, Artificial Sequence
  source: /note="Description of Artificial Sequence: Synthetic polypeptide"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 880 - protein, 489 aa, Artificial Sequence
  source: /note="Description of Artificial Sequence: Synthetic polypeptide"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 881 - protein, 490 aa, Artificial Sequence
  source: /note="Description of Artificial Sequence: Synthetic polypeptide"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 882 - protein, 484 aa, Artificial Sequence
  source: /note="Description of Artificial Sequence: Synthetic polypeptide"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 883 - protein, 485 aa, Artificial Sequence
  source: /note="Description of Artificial Sequence: Synthetic polypeptide"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 884 - protein, 489 aa, Artificial Sequence
  source: /note="Description of Artificial Sequence: Synthetic polypeptide"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 885 - protein, 497 aa, Artificial Sequence
  source: /note="Description of Artificial Sequence: Synthetic polypeptide"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 886 - protein, 492 aa, Artificial Sequence
  source: /note="Description of Artificial Sequence: Synthetic polypeptide"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 887 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 888 - protein, 485 aa, Artificial Sequence
  source: /note="Description of Artificial Sequence: Synthetic polypeptide"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 889 - protein, 492 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 890 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 891 - protein, 483 aa, Artificial Sequence
  source: /note="Description of Artificial Sequence: Synthetic polypeptide"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 892 - protein, 490 aa, Artificial Sequence
  source: /note="Description of Artificial Sequence: Synthetic polypeptide"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 893 - protein, 485 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 894 - protein, 486 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 895 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 896 - protein, 488 aa, Artificial Sequence
  source: /note="Description of Artificial Sequence: Synthetic polypeptide"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 897 - protein, 488 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 898 - protein, 495 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 899 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 900 - skipped

SEQ ID NO: 901 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 902 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 903 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 904 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 905 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 906 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 907 - DNA, 1491 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 908 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 909 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 910 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 911 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 912 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 913 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 914 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 915 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 916 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 917 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 918 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 919 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 920 - DNA, 1485 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 921 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 922-949 - skipped (28 entries)

SEQ ID NO: 950 - protein, 2002 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 951 - DNA, 9796 bp, Homo sapiens
ggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaaaaaaaaaaaaaaaaaa

SEQ ID NO: 952 - DNA, 9437 bp, Homo sapiens
aagcagaaggaagcaagatggctgccctttaggatttgttagaaaggagacccgactgcaactgctggattgctgcaaggctgagggacgagaacgagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 953 - DNA, 9289 bp, Homo sapiens
gtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtttggacagaagggtaaagctattaggattgaaagagtcatctatactggtaaagaaggcaaaagttctcagggatgtcctattgctaagtgggagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 954 - DNA, 9236 bp, Homo sapiens
aaacagaaggtgggccggggcggggagaaacagaactcggtcaatttcccagtttgtcgggtctttaaaaatacaggcccctaaagcactaagggcatgccctcggtgaaacaggggagcgcttctgctgaatgagattaaagcgacagaaaagggaaaggagagcgcgggcaacgggatctaaagggagatagagacgcgggcctctgagggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaatattttttaattcaaggtaaaatatattagtttcacaagatttctggctaatagggaaattattatcttcagtcttcatgagttgggggaaatgataatgctgacactcttagtgctcctaaagtttccttttctccatttatacatttggaatgttgtgatttatattcattttgattcccttttctctaaaatttcatctttttgattaaaaaatatgatacaggcatacctcagagatattgtgggtttggctccataccacaataaaatgaatattacaataaagcaagttgtaaggactttttggtttctcactgtatgtaaaagttatttatatactatactgtaacatactaagtgtgcaatagcattgtgtctaaaaaatatatactttaaaaataatttattgttaaaaaaatgccaacaattatctgggcctttagtgagtgctaatctttttgctggtggagggtcgtgcttcagtattgatcgctgtggactgatcatggtggtagttgctgaaggttgctgggatggctgtgtgtgtggcaatttcttaaaataagacaacagtgaagtgctgtatcaattgatttttccattcacaaaagatttctctgtagcatgcaatgctgtttgatagcatttaacccacagcagaatttctttgaaaattggactcagtcctctcaaactgtgctgctgctttatcaactaagtttttgtaattttctgaatcctttgttgtcatttcagcagtttacagcatcttcattggaagtatattccatctcaaacattctttgttcatccataagaagcaacttcttatcaagttttttcatgacattgcagtaactcagccccatcttcaggctctacttctaattctggttctcttgctacatctccctcatctgcagtgacctctccacggaagtcttgaactcctcaaagtaatccatgagggttggaatcaacttctaaactcctgttaatgttgatatattgaccccctcccatgaattatgaatgttcttaataacttctaaatggtgatacctttccagaaggctttcaatgtactttgcccggatccatcagaagactatcttggcagctgtagactaacaatatatttcttaaatgataagacttgaaagtcaaaagtactccttaatccataggctgcagaatcaatgttgtattaacaggcacgaaaacagcattaatcttgtgcatctccatcggagctcttgggtgactaggtgccttgagcagtaatattttgaaaggaggttttggttttgttttttgttttttttttttgttttttagcagtaagtctcaacactgggcttaaaatattcagtaaactatgttgtaaaaagatgtgttatcatccagactttgttgttccattactctacacaagcagggtacacttagcataattcttaagggccttggaattttcagaatggtaaatgagtatgggcttcaacttaaaatcatcaactgcattagcctgtaacaagagagtcagcctgtcctttgaagcaaggcattgacttctatctatgaaagtcttagatggcaccttgtttcaatagtaggctgtttagtacagccaccttcatcagtgatcttagctagatcttctgcataacttgctgcagcttctacatcagcacttgctgcctcaccttgtccttttatgttatagagacagctgcgcttcttaaactttataaaccaacttctgctagcttccaacttctcttctgcagcttcctcattctcttcatagaactgaagggagtcaaggccttgctctggattaagctttggcttaaggaatgttgtggctgacgtgatcttctatccagaccactaaagcgctctccatatcagcaataaggccgttttgctttcttacctttcatgtgttcactggagtaatttccttcaagaatttttcctttacattcacaacttggctaactggcatgcaaggcctagctttcagcctgtcttggcttttgacatgccttcctcacttagctcgtcatatctagcttttgatttaaagtggcaggcatacaactcttcctttcacttgaacacttagaggccactgtagggttattaattggcctaatttcaatattgttgtgttttagggaatagagaggcccagggagagggagagagcccaaacggctggttgatagagcaggcagaatgcacacaacatttatcagattatgtttgcaccatttaccagattatgggtacggtttgtggcaccccccaaaaattagaatagtaacatcaaagatcactgatcacagatcgccataacataaataataataaactttaaaatactgtgagaattaccaaaatgtgatacagagacatgaagtgagcacatgctgttgaaaaaaatgacactgatagacatacttaacacgtgggattgccacaaaccttcagtttgtaaaagtcacagtaactgtgactcacaaaagaacaaagcacaataaaacgaggtatgcctgtatttttaaaaaaagctttttgttaaaattcaggatatgtaataggtctgtaggaatagtgaaatatttttgctgatggatgtagatatatacgtggatagagatgaagatcttaattatagctatgcagcatagatttagtcaaagacatttgaaaagacaaatgttaaattagtgtggctaatgacctacccgtgccatgttttccctcttgcaatgagataccccacactgtgtagaaggatggagggaggactcctactgtccctctttgcgtgtggttattaagttgcctcactgggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatatttaaa

SEQ ID NO: 955 - DNA, 5969 bp, Homo sapiens
tcaggctctacttctaattctggttctcttgctacatctccctcatctgcagtgacctctccacggaagtcttgaactcctcaaaagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 956 - DNA, 4594 bp, Homo sapiens
gtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaa

SEQ ID NO: 957-999 - skipped (43 entries)

SEQ ID NO: 1000 - RNA, 20 nt, Artificial Sequence
  source: /note="Description of Artificial Sequence: Synthetic oligonucleotide"
uucuccccuucgcuuuuucu

SEQ ID NO: 1001 - RNA, 20 nt, Artificial Sequence
  source: /note="Description of Artificial Sequence: Synthetic oligonucleotide"
ucuccccuucgcuuuuucuc

SEQ ID NO: 1002 - RNA, 20 nt, Artificial Sequence
  source: /note="Description of Artificial Sequence: Synthetic oligonucleotide"
ucgcuuuuucucgggcuucc

SEQ ID NO: 1003 - RNA, 20 nt, Artificial Sequence
  source: /note="Description of Artificial Sequence: Synthetic oligonucleotide"
cgcuuuuucucgggcuucca

SEQ ID NO: 1004 - RNA, 20 nt, Artificial Sequence
  source: /note="Description of Artificial Sequence: Synthetic oligonucleotide"
uuucucgggcuuccagggac

SEQ ID NO: 1005 - RNA, 20 nt, Artificial Sequence
  source: /note="Description of Artificial Sequence: Synthetic oligonucleotide"
uucucgggcuuccagggacu

SEQ ID NO: 1006 - RNA, 20 nt, Artificial Sequence
  source: /note="Description of Artificial Sequence: Synthetic oligonucleotide"
ucucgggcuuccagggacug

SEQ ID NO: 1007 - RNA, 20 nt, Artificial Sequence
  source: /note="Description of Artificial Sequence: Synthetic oligonucleotide"
ugucacccacaaauaccaag

SEQ ID NO: 1008 - RNA, 20 nt, Artificial Sequence
  source: /note="Description of Artificial Sequence: Synthetic oligonucleotide"
gucacccacaaauaccaaga

SEQ ID NO: 1009 - RNA, 20 nt, Artificial Sequence
  source: /note="Description of Artificial Sequence: Synthetic oligonucleotide"
cacaaauaccaagagggaag

SEQ ID NO: 1010 - RNA, 20 nt, Artificial Sequence
  source: /note="Description of Artificial Sequence: Synthetic oligonucleotide"
acaaauaccaagagggaaga

SEQ ID NO: 1011 - RNA, 20 nt, Artificial Sequence
  source: /note="Description of Artificial Sequence: Synthetic oligonucleotide"
agggaagcuucacaaauuac

SEQ ID NO: 1012 - RNA, 20 nt, Artificial Sequence
  source: /note="Description of Artificial Sequence: Synthetic oligonucleotide"
uuacuggagccucuucaaca

SEQ ID NO: 1013 - RNA, 20 nt, Artificial Sequence
  source: /note="Description of Artificial Sequence: Synthetic oligonucleotide"
ccuuugugccuccgacgagc

SEQ ID NO: 1014 - RNA, 20 nt, Artificial Sequence
  source: /note="Description of Artificial Sequence: Synthetic oligonucleotide"
ccuccgacgagccgguuucc

SEQ ID NO: 1015 - RNA, 20 nt, Artificial Sequence
  source: /note="Description of Artificial Sequence: Synthetic oligonucleotide"
uuucuaaaauaguucagcuu

SEQ ID NO: 1016 - RNA, 20 nt, Artificial Sequence
  source: /note="Description of Artificial Sequence: Synthetic oligonucleotide"
uucuaaaauaguucagcuuu

SEQ ID NO: 1017 - RNA, 20 nt, Artificial Sequence
  source: /note="Description of Artificial Sequence: Synthetic oligonucleotide"
ucuaaaauaguucagcuuug

SEQ ID NO: 1018 - RNA, 20 nt, Artificial Sequence
  source: /note="Description of Artificial Sequence: Synthetic oligonucleotide"
cuaaaauaguucagcuuugg

SEQ ID NO: 1019 - RNA, 20 nt, Artificial Sequence
  source: /note="Description of Artificial Sequence: Synthetic oligonucleotide"
accucagagagaacacugau

SEQ ID NO: 1020 - RNA, 20 nt, Artificial Sequence
  source: /note="Description of Artificial Sequence: Synthetic oligonucleotide"
ccucagagagaacacugaua

SEQ ID NO: 1021 - RNA, 20 nt, Artificial Sequence
  source: /note="Description of Artificial Sequence: Synthetic oligonucleotide"
ucgacccuuuuaucagcugu

SEQ ID NO: 1022 - RNA, 20 nt, Artificial Sequence
  source: /note="Description of Artificial Sequence: Synthetic oligonucleotide"
cgacccuuuuaucagcugua

SEQ ID NO: 1023 - RNA, 20 nt, Artificial Sequence
  source: /note="Description of Artificial Sequence: Synthetic oligonucleotide"
cuuuuaucagcuguaggguc

SEQ ID NO: 1024 - RNA, 20 nt, Artificial Sequence
  source: /note="Description of Artificial Sequence: Synthetic oligonucleotide"
uuuuaucagcuguagggucu

SEQ ID NO: 1025 - RNA, 20 nt, Artificial Sequence
  source: /note="Description of Artificial Sequence: Synthetic oligonucleotide"
ucagcuguagggucuggguc

SEQ ID NO: 1026 - RNA, 20 nt, Artificial Sequence
  source: /note="Description of Artificial Sequence: Synthetic oligonucleotide"
cagcuguagggucugggucu

SEQ ID NO: 1027 - RNA, 20 nt, Artificial Sequence
  source: /note="Description of Artificial Sequence: Synthetic oligonucleotide"
cuaccuucuuaucccccuuu

SEQ ID NO: 1028 - RNA, 20 nt, Artificial Sequence
  source: /note="Description of Artificial Sequence: Synthetic oligonucleotide"
uaccuucuuaucccccuuua

SEQ ID NO: 1029 - RNA, 20 nt, Artificial Sequence
  source: /note="Description of Artificial Sequence: Synthetic oligonucleotide"
accuucuuaucccccuuuag

SEQ ID NO: 1030 - RNA, 20 nt, Artificial Sequence
  source: /note="Description of Artificial Sequence: Synthetic oligonucleotide"
ccuucuuaucccccuuuagg

SEQ ID NO: 1031 - RNA, 20 nt, Artificial Sequence
  source: /note="Description of Artificial Sequence: Synthetic oligonucleotide"
cuguacgaagugaaugucac

SEQ ID NO: 1032 - RNA, 20 nt, Artificial Sequence
  source: /note="Description of Artificial Sequence: Synthetic oligonucleotide"
uguacgaagugaaugucaca

SEQ ID NO: 1033 - RNA, 20 nt, Artificial Sequence
  source: /note="Description of Artificial Sequence: Synthetic oligonucleotide"
gaagugaaugucacagggag

SEQ ID NO: 1034 - RNA, 20 nt, Artificial Sequence
  source: /note="Description of Artificial Sequence: Synthetic oligonucleotide"
aaugucacagggaguggaau

SEQ ID NO: 1035 - RNA, 20 nt, Artificial Sequence
  source: /note="Description of Artificial Sequence: Synthetic oligonucleotide"
uggaauuggaguacacugag

SEQ ID NO: 1036 - RNA, 20 nt, Artificial Sequence
  source: /note="Description of Artificial Sequence: Synthetic oligonucleotide"
ggaauuggaguacacugagu

SEQ ID NO: 1037 - RNA, 20 nt, Artificial Sequence
  source: /note="Description of Artificial Sequence: Synthetic oligonucleotide"
aaguccgcgcguuuuguuag

SEQ ID NO: 1038 - RNA, 20 nt, Artificial Sequence
  source: /note="Description of Artificial Sequence: Synthetic oligonucleotide"
uuagcggcgcugagugaaag

SEQ ID NO: 1039 - RNA, 20 nt, Artificial Sequence
  source: /note="Description of Artificial Sequence: Synthetic oligonucleotide"
agaggaaagaauaguuucuc

SEQ ID NO: 1040 - RNA, 20 nt, Artificial Sequence
  source: /note="Description of Artificial Sequence: Synthetic oligonucleotide"
accagaacucacuuuucuca

SEQ ID NO: 1041 - RNA, 20 nt, Artificial Sequence
  source: /note="Description of Artificial Sequence: Synthetic oligonucleotide"
caagguacauaagucagcgc

SEQ ID NO: 1042 - RNA, 20 nt, Artificial Sequence
  source: /note="Description of Artificial Sequence: Synthetic oligonucleotide"
aagguacauaagucagcgcu

SEQ ID NO: 1043 - RNA, 20 nt, Artificial Sequence
  source: /note="Description of Artificial Sequence: Synthetic oligonucleotide"
cugggcugagccuuccagcc

SEQ ID NO: 1044 - RNA, 20 nt, Artificial Sequence
  source: /note="Description of Artificial Sequence: Synthetic oligonucleotide"
ugggcugagccuuccagccu

SEQ ID NO: 1045 - RNA, 20 nt, Artificial Sequence
  source: /note="Description of Artificial Sequence: Synthetic oligonucleotide"
gggcugagccuuccagccug

SEQ ID NO: 1046 - RNA, 20 nt, Artificial Sequence
  source: /note="Description of Artificial Sequence: Synthetic oligonucleotide"
aauguauguaagagaauuua

SEQ ID NO: 1047 - RNA, 20 nt, Artificial Sequence
  source: /note="Description of Artificial Sequence: Synthetic oligonucleotide"
uuauggacaaaucugugucc

SEQ ID NO: 1048 - RNA, 20 nt, Artificial Sequence
  source: /note="Description of Artificial Sequence: Synthetic oligonucleotide"
ucucccgaaucagcuucguu

SEQ ID NO: 1049 - RNA, 20 nt, Artificial Sequence
  source: /note="Description of Artificial Sequence: Synthetic oligonucleotide"
aucagcuucguuugguuccu

SEQ ID NO: 1050 - RNA, 20 nt, Artificial Sequence
  source: /note="Description of Artificial Sequence: Synthetic oligonucleotide"
uugguuccuugguaagugac

SEQ ID NO: 1051 - RNA, 20 nt, Artificial Sequence
  source: /note="Description of Artificial Sequence: Synthetic oligonucleotide"
uaagugacaggcagacacaa

SEQ ID NO: 1052 - RNA, 20 nt, Artificial Sequence
  source: /note="Description of Artificial Sequence: Synthetic oligonucleotide"
ugacaggcagacacaaaggc

SEQ ID NO: 1053 - RNA, 20 nt, Artificial Sequence
  source: /note="Description of Artificial Sequence: Synthetic oligonucleotide"
gcagacacaaaggcaggcgc

SEQ ID NO: 1054 - RNA, 20 nt, Artificial Sequence
  source: /note="Description of Artificial Sequence: Synthetic oligonucleotide"
cacaaaggcaggcgcaggcc

SEQ ID NO: 1055 - RNA, 20 nt, Artificial Sequence
  source: /note="Description of Artificial Sequence: Synthetic oligonucleotide"
acaaaggcaggcgcaggccc

SEQ ID NO: 1056 - RNA, 20 nt, Artificial Sequence
  source: /note="Description of Artificial Sequence: Synthetic oligonucleotide"
caaaggcaggcgcaggcccg

SEQ ID NO: 1057 - RNA, 20 nt, Artificial Sequence
  source: /note="Description of Artificial Sequence: Synthetic oligonucleotide"
aggcaggcgcaggcccgggg

SEQ ID NO: 1058 - RNA, 20 nt, Artificial Sequence
  source: /note="Description of Artificial Sequence: Synthetic oligonucleotide"
ggcaggcgcaggcccgggga

SEQ ID NO: 1059 - RNA, 20 nt, Artificial Sequence
  source: /note="Description of Artificial Sequence: Synthetic oligonucleotide"
gcaggcgcaggcccggggag

SEQ ID NO: 1060 - RNA, 20 nt, Artificial Sequence
  source: /note="Description of Artificial Sequence: Synthetic oligonucleotide"
caggcgcaggcccggggagg

SEQ ID NO: 1061 - RNA, 20 nt, Artificial Sequence
  source: /note="Description of Artificial Sequence: Synthetic oligonucleotide"
gcgcaggcccggggaggggg

SEQ ID NO: 1062 - RNA, 20 nt, Artificial Sequence
  source: /note="Description of Artificial Sequence: Synthetic oligonucleotide"
cgcaggcccggggagggggc

SEQ ID NO: 1063 - RNA, 20 nt, Artificial Sequence
  source: /note="Description of Artificial Sequence: Synthetic oligonucleotide"
aggcccggggagggggcggg

SEQ ID NO: 1064 - RNA, 20 nt, Artificial Sequence
  source: /note="Description of Artificial Sequence: Synthetic oligonucleotide"
ggcccggggagggggcggga

SEQ ID NO: 1065 - RNA, 20 nt, Artificial Sequence
  source: /note="Description of Artificial Sequence: Synthetic oligonucleotide"
gcccggggagggggcgggag

SEQ ID NO: 1066 - RNA, 20 nt, Artificial Sequence
  source: /note="Description of Artificial Sequence: Synthetic oligonucleotide"
cccggggagggggcgggagg

SEQ ID NO: 1067 - RNA, 20 nt, Artificial Sequence
  source: /note="Description of Artificial Sequence: Synthetic oligonucleotide"
ggggagggggcgggaggggg

SEQ ID NO: 1068 - RNA, 20 nt, Artificial Sequence
  source: /note="Description of Artificial Sequence: Synthetic oligonucleotide"
gggagggggcgggagggggu

SEQ ID NO: 1069 - RNA, 20 nt, Artificial Sequence
  source: /note="Description of Artificial Sequence: Synthetic oligonucleotide"
ggagggggcgggagggggug

SEQ ID NO: 1070 - RNA, 20 nt, Artificial Sequence
  source: /note="Description of Artificial Sequence: Synthetic oligonucleotide"
ggggguggggagcgcagcgu

SEQ ID NO: 1071 - RNA, 20 nt, Artificial Sequence
  source: /note="Description of Artificial Sequence: Synthetic oligonucleotide"
guuggaguugcaagacugca

SEQ ID NO: 1072 - RNA, 20 nt, Artificial Sequence
  source: /note="Description of Artificial Sequence: Synthetic oligonucleotide"
aguugcaagacugcaagguc

SEQ ID NO: 1073 - RNA, 20 nt, Artificial Sequence
  source: /note="Description of Artificial Sequence: Synthetic oligonucleotide"
guugcaagacugcaagguca

SEQ ID NO: 1074 - RNA, 20 nt, Artificial Sequence
  source: /note="Description of Artificial Sequence: Synthetic oligonucleotide"
uugcaagacugcaaggucag

SEQ ID NO: 1075 - RNA, 20 nt, Artificial Sequence
  source: /note="Description of Artificial Sequence: Synthetic oligonucleotide"
gucccauccaaauuucucuu

SEQ ID NO: 1076 - RNA, 20 nt, Artificial Sequence
  source: /note="Description of Artificial Sequence: Synthetic oligonucleotide"
uucucuuuggcuucucucuu

SEQ ID NO: 1077 - RNA, 20 nt, Artificial Sequence
  source: /note="Description of Artificial Sequence: Synthetic oligonucleotide"
aucuugcugaaucuuuucac

SEQ ID NO: 1078 - RNA, 20 nt, Artificial Sequence
  source: /note="Description of Artificial Sequence: Synthetic oligonucleotide"
ucuugcugaaucuuuucacu

SEQ ID NO: 1079 - RNA, 20 nt, Artificial Sequence
  source: /note="Description of Artificial Sequence: Synthetic oligonucleotide"
ucuaguuuuauuaagcuaau

SEQ ID NO: 1080 - RNA, 20 nt, Artificial Sequence
  source: /note="Description of Artificial Sequence: Synthetic oligonucleotide"
cuaguuuuauuaagcuaaua

SEQ ID NO: 1081 - RNA, 20 nt, Artificial Sequence
  source: /note="Description of Artificial Sequence: Synthetic oligonucleotide"
uuaagcuaauaggguuugua

SEQ ID NO: 1082 - RNA, 20 nt, Artificial Sequence
  source: /note="Description of Artificial Sequence: Synthetic oligonucleotide"
accuaugacauaaugaagug

SEQ ID NO: 1083 - RNA, 20 nt, Artificial Sequence
  source: /note="Description of Artificial Sequence: Synthetic oligonucleotide"
ugacauaaugaaguguggcc

SEQ ID NO: 1084 - RNA, 20 nt, Artificial Sequence
  source: /note="Description of Artificial Sequence: Synthetic oligonucleotide"
guguggccuggauagacucc

SEQ ID NO: 1085 - RNA, 20 nt, Artificial Sequence
  source: /note="Description of Artificial Sequence: Synthetic oligonucleotide"
gccuggauagacuccuggaa

SEQ ID NO: 1086 - RNA, 20 nt, Artificial Sequence
  source: /note="Description of Artificial Sequence: Synthetic oligonucleotide"
gaaauauaaguguuauuugc

SEQ ID NO: 1087 - RNA, 20 nt, Artificial Sequence
  source: /note="Description of Artificial Sequence: Synthetic oligonucleotide"
auauacuuuuaauuacauug

SEQ ID NO: 1088 - RNA, 20 nt, Artificial Sequence
  source: /note="Description of Artificial Sequence: Synthetic oligonucleotide"
uauacuuuuaauuacauuga

SEQ ID NO: 1089 - RNA, 20 nt, Artificial Sequence
  source: /note="Description of Artificial Sequence: Synthetic oligonucleotide"
aauguuuaagaauugagaaa

SEQ ID NO: 1090 - RNA, 20 nt, Artificial Sequence
  source: /note="Description of Artificial Sequence: Synthetic oligonucleotide"
agaaaaggcuuauuuuccag

SEQ ID NO: 1091 - RNA, 20 nt, Artificial Sequence
  source: /note="Description of Artificial Sequence: Synthetic oligonucleotide"
auuuauauauuuacgugucu

SEQ ID NO: 1092 - RNA, 20 nt, Artificial Sequence
  source: /note="Description of Artificial Sequence: Synthetic oligonucleotide"
uuuauauauuuacgugucua

SEQ ID NO: 1093 - RNA, 20 nt, Artificial Sequence
  source: /note="Description of Artificial Sequence: Synthetic oligonucleotide"
auauuuacgugucuagggag

SEQ ID NO: 1094 - RNA, 20 nt, Artificial Sequence
  source: /note="Description of Artificial Sequence: Synthetic oligonucleotide"
gugcuuuuuccccuucaguc

SEQ ID NO: 1095 - RNA, 20 nt, Artificial Sequence
  source: /note="Description of Artificial Sequence: Synthetic oligonucleotide"
ugcuuuuuccccuucaguca

SEQ ID NO: 1096 - RNA, 20 nt, Artificial Sequence
  source: /note="Description of Artificial Sequence: Synthetic oligonucleotide"
ccuucagucagggauuauaa

SEQ ID NO: 1097 - RNA, 20 nt, Artificial Sequence
  source: /note="Description of Artificial Sequence: Synthetic oligonucleotide"
cuucagucagggauuauaau

SEQ ID NO: 1098 - RNA, 20 nt, Artificial Sequence
  source: /note="Description of Artificial Sequence: Synthetic oligonucleotide"
aucaacaaaugauccaucau

SEQ ID NO: 1099 - RNA, 20 nt, Artificial Sequence
  source: /note="Description of Artificial Sequence: Synthetic oligonucleotide"
aggaauaagauuguaucuua

SEQ ID NO: 1100 - RNA, 20 nt, Artificial Sequence
  source: /note="Description of Artificial Sequence: Synthetic oligonucleotide"
ggaauaagauuguaucuuaa

SEQ ID NO: 1101 - RNA, 20 nt, Artificial Sequence
  source: /note="Description of Artificial Sequence: Synthetic oligonucleotide"
gauuguaucuuaagggaagu

SEQ ID NO: 1102 - RNA, 20 nt, Artificial Sequence
  source: /note="Description of Artificial Sequence: Synthetic oligonucleotide"
auuguaucuuaagggaaguu

SEQ ID NO: 1103 - RNA, 20 nt, Artificial Sequence
  source: /note="Description of Artificial Sequence: Synthetic oligonucleotide"
gauucacagagaaaagacau

SEQ ID NO: 1104 - RNA, 20 nt, Artificial Sequence
  source: /note="Description of Artificial Sequence: Synthetic oligonucleotide"
acagagaaaagacauugguu

SEQ ID NO: 1105 - RNA, 20 nt, Artificial Sequence
  source: /note="Description of Artificial Sequence: Synthetic oligonucleotide"
gaaaagacauugguuugguu

SEQ ID NO: 1106 - RNA, 20 nt, Artificial Sequence
  source: /note="Description of Artificial Sequence: Synthetic oligonucleotide"
uuugguuuggugugauacug

SEQ ID NO: 1107 - RNA, 20 nt, Artificial Sequence
  source: /note="Description of Artificial Sequence: Synthetic oligonucleotide"
uugguuuggugugauacugu

SEQ ID NO: 1108 - RNA, 20 nt, Artificial Sequence
  source: /note="Description of Artificial Sequence: Synthetic oligonucleotide"
auacuguggguauuguugcc

SEQ ID NO: 1109 - RNA, 20 nt, Artificial Sequence
  source: /note="Description of Artificial Sequence: Synthetic oligonucleotide"
ucauuacauuugcauuuuaa

SEQ ID NO: 1110 - RNA, 20 nt, Artificial Sequence
  source: /note="Description of Artificial Sequence: Synthetic oligonucleotide"
aauggaaaguugaaauacua

SEQ ID NO: 1111 - RNA, 20 nt, Artificial Sequence
  source: /note="Description of Artificial Sequence: Synthetic oligonucleotide"
auggaaaguugaaauacuaa

SEQ ID NO: 1112 - RNA, 20 nt, Artificial Sequence
  source: /note="Description of Artificial Sequence: Synthetic oligonucleotide"
uggaaaguugaaauacuaag

SEQ ID NO: 1113 - RNA, 20 nt, Artificial Sequence
  source: /note="Description of Artificial Sequence: Synthetic oligonucleotide"
uaugugugcuuaauaauguu

SEQ ID NO: 1114 - RNA, 20 nt, Artificial Sequence
  source: /note="Description of Artificial Sequence: Synthetic oligonucleotide"
aaauguuaauaagcagagaa

SEQ ID NO: 1115 - RNA, 20 nt, Artificial Sequence
  source: /note="Description of Artificial Sequence: Synthetic oligonucleotide"
gagaacgguuaaugaagugu

SEQ ID NO: 1116 - RNA, 20 nt, Artificial Sequence
  source: /note="Description of Artificial Sequence: Synthetic oligonucleotide"
aaguuuagaagacaauuuau

SEQ ID NO: 1117 - RNA, 20 nt, Artificial Sequence
  source: /note="Description of Artificial Sequence: Synthetic oligonucleotide"
caauuuauaggauuaaaaaa

SEQ ID NO: 1118 - RNA, 20 nt, Artificial Sequence
  source: /note="Description of Artificial Sequence: Synthetic oligonucleotide"
aggauuaaaaaauggauaga

SEQ ID NO: 1119 - RNA, 20 nt, Artificial Sequence
  source: /note="Description of Artificial Sequence: Synthetic oligonucleotide"
uugcuuuaaucauugauacg

SEQ ID NO: 1120 - RNA, 20 nt, Artificial Sequence
  source: /note="Description of Artificial Sequence: Synthetic oligonucleotide"
ugcuuuaaucauugauacgu

SEQ ID NO: 1121 - RNA, 20 nt, Artificial Sequence
  source: /note="Description of Artificial Sequence: Synthetic oligonucleotide"
gcuuuaaucauugauacgug

SEQ ID NO: 1122 - RNA, 20 nt, Artificial Sequence
  source: /note="Description of Artificial Sequence: Synthetic oligonucleotide"
gguucuuucacaugauuaca

SEQ ID NO: 1123 - RNA, 20 nt, Artificial Sequence
  source: /note="Description of Artificial Sequence: Synthetic oligonucleotide"
guucuuucacaugauuacaa

SEQ ID NO: 1124 - RNA, 20 nt, Artificial Sequence
  source: /note="Description of Artificial Sequence: Synthetic oligonucleotide"
agaagcauuacucaucucug

SEQ ID NO: 1125 - RNA, 20 nt, Artificial Sequence
  source: /note="Description of Artificial Sequence: Synthetic oligonucleotide"
ucaucucuguggaauagaaa

SEQ ID NO: 1126 - RNA, 20 nt, Artificial Sequence
  source: /note="Description of Artificial Sequence: Synthetic oligonucleotide"
guggaauagaaacgguucau

SEQ ID NO: 1127 - RNA, 20 nt, Artificial Sequence
  source: /note="Description of Artificial Sequence: Synthetic oligonucleotide"
cuaaaauuaaaacaaaaauu

SEQ ID NO: 1128 - RNA, 20 nt, Artificial Sequence
  source: /note="Description of Artificial Sequence: Synthetic oligonucleotide"
uuuaccauuaaugcuguuca

SEQ ID NO: 1129 - RNA, 20 nt, Artificial Sequence
  source: /note="Description of Artificial Sequence: Synthetic oligonucleotide"
guaaacuaucgagaaaacua

SEQ ID NO: 1130 - RNA, 20 nt, Artificial Sequence
  source: /note="Description of Artificial Sequence: Synthetic oligonucleotide"
acaaacuaauauuuacuuuu

SEQ ID NO: 1131 - RNA, 20 nt, Artificial Sequence
  source: /note="Description of Artificial Sequence: Synthetic oligonucleotide"
caaacuaauauuuacuuuuu

SEQ ID NO: 1132 - RNA, 20 nt, Artificial Sequence
  source: /note="Description of Artificial Sequence: Synthetic oligonucleotide"
aaacuaauauuuacuuuuug

SEQ ID NO: 1133 - RNA, 20 nt, Artificial Sequence
  source: /note="Description of Artificial Sequence: Synthetic oligonucleotide"
ggacaacuuuucaaauguug

SEQ ID NO: 1134 - RNA, 20 nt, Artificial Sequence
  source: /note="Description of Artificial Sequence: Synthetic oligonucleotide"
uugugguauauacugucuuc

SEQ ID NO: 1135 - RNA, 20 nt, Artificial Sequence
  source: /note="Description of Artificial Sequence: Synthetic oligonucleotide"
auaaauaagaauaacuacau

SEQ ID NO: 1136 - RNA, 20 nt, Artificial Sequence
  source: /note="Description of Artificial Sequence: Synthetic oligonucleotide"
aauuuugaauacaacuauga

SEQ ID NO: 1137 - RNA, 20 nt, Artificial Sequence
  source: /note="Description of Artificial Sequence: Synthetic oligonucleotide"
aaaguauuucagugauuaua

SEQ ID NO: 1138 - RNA, 20 nt, Artificial Sequence
  source: /note="Description of Artificial Sequence: Synthetic oligonucleotide"
uuagucacuuuauccuuugu

SEQ ID NO: 1139 - RNA, 20 nt, Artificial Sequence
  source: /note="Description of Artificial Sequence: Synthetic oligonucleotide"
agaaauuauuuuaauaagua

SEQ ID NO: 1140 - RNA, 20 nt, Artificial Sequence
  source: /note="Description of Artificial Sequence: Synthetic oligonucleotide"
gaaauuauuuuaauaaguau

SEQ ID NO: 1141 - RNA, 20 nt, Artificial Sequence
  source: /note="Description of Artificial Sequence: Synthetic oligonucleotide"
aaauuauuuuaauaaguaug

SEQ ID NO: 1142 - RNA, 20 nt, Artificial Sequence
  source: /note="Description of Artificial Sequence: Synthetic oligonucleotide"
uauaugugaucauacuaccu

SEQ ID NO: 1143 - RNA, 20 nt, Artificial Sequence
  source: /note="Description of Artificial Sequence: Synthetic oligonucleotide"
aggugcuccaaaaauuccau

SEQ ID NO: 1144 - RNA, 20 nt, Artificial Sequence
  source: /note="Description of Artificial Sequence: Synthetic oligonucleotide"
aaaauuccauaggacugucu

SEQ ID NO: 1145 - RNA, 20 nt, Artificial Sequence
  source: /note="Description of Artificial Sequence: Synthetic oligonucleotide"
aaauuccauaggacugucuu

SEQ ID NO: 1146 - RNA, 20 nt, Artificial Sequence
  source: /note="Description of Artificial Sequence: Synthetic oligonucleotide"
gucuuggguuauugaauuuu

SEQ ID NO: 1147 - RNA, 20 nt, Artificial Sequence
  source: /note="Description of Artificial Sequence: Synthetic oligonucleotide"
gaauuuuaggaacaugauaa

SEQ ID NO: 1148 - RNA, 20 nt, Artificial Sequence
  source: /note="Description of Artificial Sequence: Synthetic oligonucleotide"
uauuugccaaacucuucuua

SEQ ID NO: 1149 - RNA, 20 nt, Artificial Sequence
  source: /note="Description of Artificial Sequence: Synthetic oligonucleotide"
cucuucuuaaggcuuuaauu

SEQ ID NO: 1150 - RNA, 20 nt, Artificial Sequence
  source: /note="Description of Artificial Sequence: Synthetic oligonucleotide"
ugccaguuuaugccagaagc

SEQ ID NO: 1151 - RNA, 20 nt, Artificial Sequence
  source: /note="Description of Artificial Sequence: Synthetic oligonucleotide"
caguuuaugccagaagccgg

SEQ ID NO: 1152 - RNA, 20 nt, Artificial Sequence
  source: /note="Description of Artificial Sequence: Synthetic oligonucleotide"
gaggaauugauaugauuuug

SEQ ID NO: 1153 - RNA, 20 nt, Artificial Sequence
  source: /note="Description of Artificial Sequence: Synthetic oligonucleotide"
uugauaugauuuugaggcag

SEQ ID NO: 1154 - RNA, 20 nt, Artificial Sequence
  source: /note="Description of Artificial Sequence: Synthetic oligonucleotide"
gauuuugaggcaguggcaca

SEQ ID NO: 1155 - RNA, 20 nt, Artificial Sequence
  source: /note="Description of Artificial Sequence: Synthetic oligonucleotide"
cacaugguccuacuagacau

SEQ ID NO: 1156 - RNA, 20 nt, Artificial Sequence
  source: /note="Description of Artificial Sequence: Synthetic oligonucleotide"
caagugaagugcaccugcca

SEQ ID NO: 1157 - RNA, 20 nt, Artificial Sequence
  source: /note="Description of Artificial Sequence: Synthetic oligonucleotide"
aagaauuccaaaguccuuau

SEQ ID NO: 1158 - RNA, 20 nt, Artificial Sequence
  source: /note="Description of Artificial Sequence: Synthetic oligonucleotide"
agaauuccaaaguccuuauu

SEQ ID NO: 1159 - RNA, 20 nt, Artificial Sequence
  source: /note="Description of Artificial Sequence: Synthetic oligonucleotide"
ccaaaguccuuauugggcac

SEQ ID NO: 1160 - RNA, 20 nt, Artificial Sequence
  source: /note="Description of Artificial Sequence: Synthetic oligonucleotide"
uugggcacuggucuuguauu

SEQ ID NO: 1161 - RNA, 20 nt, Artificial Sequence
  source: /note="Description of Artificial Sequence: Synthetic oligonucleotide"
uuguauuagguaacaacaac

SEQ ID NO: 1162 - RNA, 20 nt, Artificial Sequence
  source: /note="Description of Artificial Sequence: Synthetic oligonucleotide"
aagcccuucuuaugauucau

SEQ ID NO: 1163 - RNA, 20 nt, Artificial Sequence
  source: /note="Description of Artificial Sequence: Synthetic oligonucleotide"
auccugcccaaagucugagu

SEQ ID NO: 1164 - RNA, 20 nt, Artificial Sequence
  source: /note="Description of Artificial Sequence: Synthetic oligonucleotide"
uaaaauaucuucaaaaguua

SEQ ID NO: 1165 - RNA, 20 nt, Artificial Sequence
  source: /note="Description of Artificial Sequence: Synthetic oligonucleotide"
aucuagcaauuucaaaucgc

SEQ ID NO: 1166 - RNA, 20 nt, Artificial Sequence
  source: /note="Description of Artificial Sequence: Synthetic oligonucleotide"
aauguuauuguuuccuaccu

SEQ ID NO: 1167 - RNA, 20 nt, Artificial Sequence
  source: /note="Description of Artificial Sequence: Synthetic oligonucleotide"
auguuauuguuuccuaccuu

SEQ ID NO: 1168 - RNA, 20 nt, Artificial Sequence
  source: /note="Description of Artificial Sequence: Synthetic oligonucleotide"
uuguuuccuaccuugggaac

SEQ ID NO: 1169 - RNA, 20 nt, Artificial Sequence
  source: /note="Description of Artificial Sequence: Synthetic oligonucleotide"
uugggaacaggcuaaaacuu

SEQ ID NO: 1170 - RNA, 20 nt, Artificial Sequence
  source: /note="Description of Artificial Sequence: Synthetic oligonucleotide"
ccauugcacaguaguucuua

SEQ ID NO: 1171 - RNA, 20 nt, Artificial Sequence
  source: /note="Description of Artificial Sequence: Synthetic oligonucleotide"
guaguucuuaaggauaguaa

SEQ ID NO: 1172 - RNA, 20 nt, Artificial Sequence
  source: /note="Description of Artificial Sequence: Synthetic oligonucleotide"
ucccaagccaacuuuacaau

SEQ ID NO: 1173 - RNA, 20 nt, Artificial Sequence
  source: /note="Description of Artificial Sequence: Synthetic oligonucleotide"
uacaauuggagccuucacug

SEQ ID NO: 1174 - RNA, 20 nt, Artificial Sequence
  source: /note="Description of Artificial Sequence: Synthetic oligonucleotide"
acaauuggagccuucacugu

SEQ ID NO: 1175 - RNA, 20 nt, Artificial Sequence
  source: /note="Description of Artificial Sequence: Synthetic oligonucleotide"
gaccaguugccaaguagagc

SEQ ID NO: 1176 - RNA, 20 nt, Artificial Sequence
  source: /note="Description of Artificial Sequence: Synthetic oligonucleotide"
caguugccaaguagagcugg

SEQ ID NO: 1177 - RNA, 20 nt, Artificial Sequence
  source: /note="Description of Artificial Sequence: Synthetic oligonucleotide"
aaguagagcuggugguuauc

SEQ ID NO: 1178 - RNA, 20 nt, Artificial Sequence
  source: /note="Description of Artificial Sequence: Synthetic oligonucleotide"
aguagagcuggugguuaucu

SEQ ID NO: 1179 - RNA, 20 nt, Artificial Sequence
  source: /note="Description of Artificial Sequence: Synthetic oligonucleotide"
ccaaauauacaguauuuacu

SEQ ID NO: 1180 - RNA, 20 nt, Artificial Sequence
  source: /note="Description of Artificial Sequence: Synthetic oligonucleotide"
gaauacugugacauuauuga

SEQ ID NO: 1181 - RNA, 20 nt, Artificial Sequence
  source: /note="Description of Artificial Sequence: Synthetic oligonucleotide"
uacugugacauuauugaagg

SEQ ID NO: 1182 - RNA, 20 nt, Artificial Sequence
  source: /note="Description of Artificial Sequence: Synthetic oligonucleotide"
agguuaugcaguacaucugu

SEQ ID NO: 1183 - RNA, 20 nt, Artificial Sequence
  source: /note="Description of Artificial Sequence: Synthetic oligonucleotide"
augcaguacaucuguugguu

SEQ ID NO: 1184 - RNA, 20 nt, Artificial Sequence
  source: /note="Description of Artificial Sequence: Synthetic oligonucleotide"
cuguugguuugguauauagu

SEQ ID NO: 1185 - RNA, 20 nt, Artificial Sequence
  source: /note="Description of Artificial Sequence: Synthetic oligonucleotide"
uugguauauaguaggagaga

SEQ ID NO: 1186 - RNA, 20 nt, Artificial Sequence
  source: /note="Description of Artificial Sequence: Synthetic oligonucleotide"
ugguauauaguaggagagaa

SEQ ID NO: 1187 - RNA, 20 nt, Artificial Sequence
  source: /note="Description of Artificial Sequence: Synthetic oligonucleotide"
uaguaggagagaaggguucc

SEQ ID NO: 1188 - RNA, 20 nt, Artificial Sequence
  source: /note="Description of Artificial Sequence: Synthetic oligonucleotide"
uaggagagaaggguuccagg

SEQ ID NO: 1189 - RNA, 20 nt, Artificial Sequence
  source: /note="Description of Artificial Sequence: Synthetic oligonucleotide"
aggagagaaggguuccagga

SEQ ID NO: 1190 - RNA, 20 nt, Artificial Sequence
  source: /note="Description of Artificial Sequence: Synthetic oligonucleotide"
agaaggguuccaggagggaa

SEQ ID NO: 1191 - RNA, 20 nt, Artificial Sequence
  source: /note="Description of Artificial Sequence: Synthetic oligonucleotide"
gaaggguuccaggagggaaa

SEQ ID NO: 1192 - RNA, 20 nt, Artificial Sequence
  source: /note="Description of Artificial Sequence: Synthetic oligonucleotide"
aaggguuccaggagggaaag

SEQ ID NO: 1193 - RNA, 20 nt, Artificial Sequence
  source: /note="Description of Artificial Sequence: Synthetic oligonucleotide"
uucucaaaagaauagauauu

SEQ ID NO: 1194 - RNA, 20 nt, Artificial Sequence
  source: /note="Description of Artificial Sequence: Synthetic oligonucleotide"
ccauuccaaauaacaaauuu

SEQ ID NO: 1195 - RNA, 20 nt, Artificial Sequence
  source: /note="Description of Artificial Sequence: Synthetic oligonucleotide"
uccaaauaacaaauuuugga

SEQ ID NO: 1196 - RNA, 20 nt, Artificial Sequence
  source: /note="Description of Artificial Sequence: Synthetic oligonucleotide"
ccaaauaacaaauuuuggau

SEQ ID NO: 1197 - RNA, 20 nt, Artificial Sequence
  source: /note="Description of Artificial Sequence: Synthetic oligonucleotide"
uaacaaauuuuggaugggcg

SEQ ID NO: 1198 - RNA, 20 nt, Artificial Sequence
  source: /note="Description of Artificial Sequence: Synthetic oligonucleotide"
ugccuguaauccuagcacuu

SEQ ID NO: 1199 - RNA, 20 nt, Artificial Sequence
  source: /note="Description of Artificial Sequence: Synthetic oligonucleotide"
gccuguaauccuagcacuuu

SEQ ID NO: 1200 - RNA, 20 nt, Artificial Sequence
  source: /note="Description of Artificial Sequence: Synthetic oligonucleotide"
uguaauccuagcacuuuggg

SEQ ID NO: 1201 - RNA, 20 nt, Artificial Sequence
  source: /note="Description of Artificial Sequence: Synthetic oligonucleotide"
ccuagcacuuugggaggcca

SEQ ID NO: 1202 - RNA, 20 nt, Artificial Sequence
  source: /note="Description of Artificial Sequence: Synthetic oligonucleotide"
ccaaggugagagaucacuug

SEQ ID NO: 1203 - RNA, 20 nt, Artificial Sequence
  source: /note="Description of Artificial Sequence: Synthetic oligonucleotide"
gugagagaucacuugaggcc

SEQ ID NO: 1204 - RNA, 20 nt, Artificial Sequence
  source: /note="Description of Artificial Sequence: Synthetic oligonucleotide"
ccaggaguuugaaaccaccc

SEQ ID NO: 1205 - RNA, 20 nt, Artificial Sequence
  source: /note="Description of Artificial Sequence: Synthetic oligonucleotide"
caggaguuugaaaccacccu

SEQ ID NO: 1206 - RNA, 20 nt, Artificial Sequence
  source: /note="Description of Artificial Sequence: Synthetic oligonucleotide"
ccacccugggcaacacaguc

SEQ ID NO: 1207 - RNA, 20 nt, Artificial Sequence
  source: /note="Description of Artificial Sequence: Synthetic oligonucleotide"
caaaaaauuuaaaaaguuag

SEQ ID NO: 1208 - RNA, 20 nt, Artificial Sequence
  source: /note="Description of Artificial Sequence: Synthetic oligonucleotide"
aaaaaauuuaaaaaguuagu

SEQ ID NO: 1209 - RNA, 20 nt, Artificial Sequence
  source: /note="Description of Artificial Sequence: Synthetic oligonucleotide"
aaaaauuuaaaaaguuagug

SEQ ID NO: 1210 - RNA, 20 nt, Artificial Sequence
  source: /note="Description of Artificial Sequence: Synthetic oligonucleotide"
uuuaaaaaguuaguggggca

SEQ ID NO: 1211 - RNA, 20 nt, Artificial Sequence
  source: /note="Description of Artificial Sequence: Synthetic oligonucleotide"
aaaaaguuaguggggcaugg

SEQ ID NO: 1212 - RNA, 20 nt, Artificial Sequence
  source: /note="Description of Artificial Sequence: Synthetic oligonucleotide"
uccuguagucccagcuacuc

SEQ ID NO: 1213 - RNA, 20 nt, Artificial Sequence
  source: /note="Description of Artificial Sequence: Synthetic oligonucleotide"
gcuacucaggagacugagau

SEQ ID NO: 1214 - RNA, 20 nt, Artificial Sequence
  source: /note="Description of Artificial Sequence: Synthetic oligonucleotide"
acucaggagacugagauagg

SEQ ID NO: 1215 - RNA, 20 nt, Artificial Sequence
  source: /note="Description of Artificial Sequence: Synthetic oligonucleotide"
aggagacugagauaggagga

SEQ ID NO: 1216 - RNA, 20 nt, Artificial Sequence
  source: /note="Description of Artificial Sequence: Synthetic oligonucleotide"
acaccacugcgcuccagccc

SEQ ID NO: 1217 - RNA, 20 nt, Artificial Sequence
  source: /note="Description of Artificial Sequence: Synthetic oligonucleotide"
ugcgcuccagcccaggcaag

SEQ ID NO: 1218 - RNA, 20 nt, Artificial Sequence
  source: /note="Description of Artificial Sequence: Synthetic oligonucleotide"
gcgcuccagcccaggcaaga

SEQ ID NO: 1219 - RNA, 20 nt, Artificial Sequence
  source: /note="Description of Artificial Sequence: Synthetic oligonucleotide"
aaaaagaagaaacagauagu

SEQ ID NO: 1220 - RNA, 20 nt, Artificial Sequence
  source: /note="Description of Artificial Sequence: Synthetic oligonucleotide"
aagaagaaacagauaguagg

SEQ ID NO: 1221 - RNA, 20 nt, Artificial Sequence
  source: /note="Description of Artificial Sequence: Synthetic oligonucleotide"
guuuuaagaauucagaacuc

SEQ ID NO: 1222 - RNA, 20 nt, Artificial Sequence
  source: /note="Description of Artificial Sequence: Synthetic oligonucleotide"
aagaauucagaacucaggcc

SEQ ID NO: 1223 - RNA, 20 nt, Artificial Sequence
  source: /note="Description of Artificial Sequence: Synthetic oligonucleotide"
uucagaacucaggccaggug

SEQ ID NO: 1224 - RNA, 20 nt, Artificial Sequence
  source: /note="Description of Artificial Sequence: Synthetic oligonucleotide"
agaacucaggccaggugugg

SEQ ID NO: 1225 - RNA, 20 nt, Artificial Sequence
  source: /note="Description of Artificial Sequence: Synthetic oligonucleotide"
ccaggugugguggcucauuc

SEQ ID NO: 1226 - RNA, 20 nt, Artificial Sequence
  source: /note="Description of Artificial Sequence: Synthetic oligonucleotide"
caggugugguggcucauucu

SEQ ID NO: 1227 - RNA, 20 nt, Artificial Sequence
  source: /note="Description of Artificial Sequence: Synthetic oligonucleotide"
gugugguggcucauucuggg

SEQ ID NO: 1228 - RNA, 20 nt, Artificial Sequence
  source: /note="Description of Artificial Sequence: Synthetic oligonucleotide"
ugugguggcucauucuggga

SEQ ID NO: 1229 - RNA, 20 nt, Artificial Sequence
  source: /note="Description of Artificial Sequence: Synthetic oligonucleotide"
gugguggcucauucugggag

SEQ ID NO: 1230 - RNA, 20 nt, Artificial Sequence
  source: /note="Description of Artificial Sequence: Synthetic oligonucleotide"
uggcucauucugggagggga

SEQ ID NO: 1231 - RNA, 20 nt, Artificial Sequence
  source: /note="Description of Artificial Sequence: Synthetic oligonucleotide"
ucauucugggaggggaaggc

SEQ ID NO: 1232 - RNA, 20 nt, Artificial Sequence
  source: /note="Description of Artificial Sequence: Synthetic oligonucleotide"
uucugggaggggaaggcagg

SEQ ID NO: 1233 - RNA, 20 nt, Artificial Sequence
  source: /note="Description of Artificial Sequence: Synthetic oligonucleotide"
gaaggcaggaggaucacuug

SEQ ID NO: 1234 - RNA, 20 nt, Artificial Sequence
  source: /note="Description of Artificial Sequence: Synthetic oligonucleotide"
ccagaaguucuagaccagcc

SEQ ID NO: 1235 - RNA, 20 nt, Artificial Sequence
  source: /note="Description of Artificial Sequence: Synthetic oligonucleotide"
cagaaguucuagaccagccu

SEQ ID NO: 1236 - RNA, 20 nt, Artificial Sequence
  source: /note="Description of Artificial Sequence: Synthetic oligonucleotide"
gagaauuaaaguaagagacg

SEQ ID NO: 1237 - RNA, 20 nt, Artificial Sequence
  source: /note="Description of Artificial Sequence: Synthetic oligonucleotide"
auuaaaguaagagacgaggc

SEQ ID NO: 1238 - RNA, 20 nt, Artificial Sequence
  source: /note="Description of Artificial Sequence: Synthetic oligonucleotide"
guaagagacgaggccgguug

SEQ ID NO: 1239 - RNA, 20 nt, Artificial Sequence
  source: /note="Description of Artificial Sequence: Synthetic oligonucleotide"
agagacgaggccgguugugg

SEQ ID NO: 1240 - RNA, 20 nt, Artificial Sequence
  source: /note="Description of Artificial Sequence: Synthetic oligonucleotide"
ugccuguaaucccagcacuu

SEQ ID NO: 1241 - RNA, 20 nt, Artificial Sequence
  source: /note="Description of Artificial Sequence: Synthetic oligonucleotide"
gccuguaaucccagcacuuu

SEQ ID NO: 1242 - RNA, 20 nt, Artificial Sequence
  source: /note="Description of Artificial Sequence: Synthetic oligonucleotide"
cccagcacuuugggacgaca

SEQ ID NO: 1243 - RNA, 20 nt, Artificial Sequence
  source: /note="Description of Artificial Sequence: Synthetic oligonucleotide"
gcacuuugggacgacaaggc

SEQ ID NO: 1244 - RNA, 20 nt, Artificial Sequence
  source: /note="Description of Artificial Sequence: Synthetic oligonucleotide"
cuuugggacgacaaggcagg

SEQ ID NO: 1245 - RNA, 20 nt, Artificial Sequence
  source: /note="Description of Artificial Sequence: Synthetic oligonucleotide"
caaggcagguggaugaccug

SEQ ID NO: 1246 - RNA, 20 nt, Artificial Sequence
  source: /note="Description of Artificial Sequence: Synthetic oligonucleotide"
cagguggaugaccugagguc

SEQ ID NO: 1247 - RNA, 20 nt, Artificial Sequence
  source: /note="Description of Artificial Sequence: Synthetic oligonucleotide"
ucaggaguuugagaccagcc

SEQ ID NO: 1248 - RNA, 20 nt, Artificial Sequence
  source: /note="Description of Artificial Sequence: Synthetic oligonucleotide"
ugagaccagccuggccaaca

SEQ ID NO: 1249 - RNA, 20 nt, Artificial Sequence
  source: /note="Description of Artificial Sequence: Synthetic oligonucleotide"
cuaaaaauacaaaaauuagc

SEQ ID NO: 1250 - RNA, 20 nt, Artificial Sequence
  source: /note="Description of Artificial Sequence: Synthetic oligonucleotide"
uaaaaauacaaaaauuagcc

SEQ ID NO: 1251 - RNA, 20 nt, Artificial Sequence
  source: /note="Description of Artificial Sequence: Synthetic oligonucleotide"
auacaaaaauuagccgggca

SEQ ID NO: 1252 - RNA, 20 nt, Artificial Sequence
  source: /note="Description of Artificial Sequence: Synthetic oligonucleotide"
caaaaauuagccgggcaugg

SEQ ID NO: 1253 - RNA, 20 nt, Artificial Sequence
  source: /note="Description of Artificial Sequence: Synthetic oligonucleotide"
accaguaaucccagcuacuc

SEQ ID NO: 1254 - RNA, 20 nt, Artificial Sequence
  source: /note="Description of Artificial Sequence: Synthetic oligonucleotide"
aguaaucccagcuacucagg

SEQ ID NO: 1255 - RNA, 20 nt, Artificial Sequence
  source: /note="Description of Artificial Sequence: Synthetic oligonucleotide"
cccagcuacucaggaggcug

SEQ ID NO: 1256 - RNA, 20 nt, Artificial Sequence
  source: /note="Description of Artificial Sequence: Synthetic oligonucleotide"
gcccgagaaucacuugagcc

SEQ ID NO: 1257 - RNA, 20 nt, Artificial Sequence
  source: /note="Description of Artificial Sequence: Synthetic oligonucleotide"
cccgagaaucacuugagccu

SEQ ID NO: 1258 - RNA, 20 nt, Artificial Sequence
  source: /note="Description of Artificial Sequence: Synthetic oligonucleotide"
gaaucacuugagccugggca

SEQ ID NO: 1259 - RNA, 20 nt, Artificial Sequence
  source: /note="Description of Artificial Sequence: Synthetic oligonucleotide"
ucacuugagccugggcaugg

SEQ ID NO: 1260 - RNA, 20 nt, Artificial Sequence
  source: /note="Description of Artificial Sequence: Synthetic oligonucleotide"
uaccuauaaucccagcacuu

SEQ ID NO: 1261 - RNA, 20 nt, Artificial Sequence
  source: /note="Description of Artificial Sequence: Synthetic oligonucleotide"
accuauaaucccagcacuuu

SEQ ID NO: 1262 - RNA, 20 nt, Artificial Sequence
  source: /note="Description of Artificial Sequence: Synthetic oligonucleotide"
uauaaucccagcacuuuggg

SEQ ID NO: 1263 - RNA, 20 nt, Artificial Sequence
  source: /note="Description of Artificial Sequence: Synthetic oligonucleotide"
cccagcacuuugggaggccg

SEQ ID NO: 1264 - RNA, 20 nt, Artificial Sequence
  source: /note="Description of Artificial Sequence: Synthetic oligonucleotide"
gcacuuugggaggccgaggc

SEQ ID NO: 1265 - RNA, 20 nt, Artificial Sequence
  source: /note="Description of Artificial Sequence: Synthetic oligonucleotide"
cuuugggaggccgaggcagg

SEQ ID NO: 1266 - RNA, 20 nt, Artificial Sequence
  source: /note="Description of Artificial Sequence: Synthetic oligonucleotide"
cagguggaucaccugacguc

SEQ ID NO: 1267 - RNA, 20 nt, Artificial Sequence
  source: /note="Description of Artificial Sequence: Synthetic oligonucleotide"
ucaggaauucgagaccaguc

SEQ ID NO: 1268 - RNA, 20 nt, Artificial Sequence
  source: /note="Description of Artificial Sequence: Synthetic oligonucleotide"
cgagaccagucuggccaaca

SEQ ID NO: 1269 - RNA, 20 nt, Artificial Sequence
  source: /note="Description of Artificial Sequence: Synthetic oligonucleotide"
acuaaacauacaaaauuagc

SEQ ID NO: 1270 - RNA, 20 nt, Artificial Sequence
  source: /note="Description of Artificial Sequence: Synthetic oligonucleotide"
cuaaacauacaaaauuagcu

SEQ ID NO: 1271 - RNA, 20 nt, Artificial Sequence
  source: /note="Description of Artificial Sequence: Synthetic oligonucleotide"
cauacaaaauuagcugggug

SEQ ID NO: 1272 - RNA, 20 nt, Artificial Sequence
  source: /note="Description of Artificial Sequence: Synthetic oligonucleotide"
acaaaauuagcugggugugg

SEQ ID NO: 1273 - RNA, 20 nt, Artificial Sequence
  source: /note="Description of Artificial Sequence: Synthetic oligonucleotide"
gccuguagucucagcuauuc

SEQ ID NO: 1274 - RNA, 20 nt, Artificial Sequence
  source: /note="Description of Artificial Sequence: Synthetic oligonucleotide"
uguagucucagcuauucugg

SEQ ID NO: 1275 - RNA, 20 nt, Artificial Sequence
  source: /note="Description of Artificial Sequence: Synthetic oligonucleotide"
gcuauucuggaggcugauac

SEQ ID NO: 1276 - RNA, 20 nt, Artificial Sequence
  source: /note="Description of Artificial Sequence: Synthetic oligonucleotide"
gagaauugcuugaacccucc

SEQ ID NO: 1277 - RNA, 20 nt, Artificial Sequence
  source: /note="Description of Artificial Sequence: Synthetic oligonucleotide"
agaauugcuugaacccuccc

SEQ ID NO: 1278 - RNA, 20 nt, Artificial Sequence
  source: /note="Description of Artificial Sequence: Synthetic oligonucleotide"
auugcuugaacccucccggg

SEQ ID NO: 1279 - RNA, 20 nt, Artificial Sequence
  source: /note="Description of Artificial Sequence: Synthetic oligonucleotide"
ugaacccucccgggaggcag

SEQ ID NO: 1280 - RNA, 20 nt, Artificial Sequence
  source: /note="Description of Artificial Sequence: Synthetic oligonucleotide"
cucccgggaggcagaggcug

SEQ ID NO: 1281 - RNA, 20 nt, Artificial Sequence
  source: /note="Description of Artificial Sequence: Synthetic oligonucleotide"
gaggcugcggugagccgaga

SEQ ID NO: 1282 - RNA, 20 nt, Artificial Sequence
  source: /note="Description of Artificial Sequence: Synthetic oligonucleotide"
ggcucugcugcacuccagcc

SEQ ID NO: 1283 - RNA, 20 nt, Artificial Sequence
  source: /note="Description of Artificial Sequence: Synthetic oligonucleotide"
gcucugcugcacuccagccu

SEQ ID NO: 1284 - RNA, 20 nt, Artificial Sequence
  source: /note="Description of Artificial Sequence: Synthetic oligonucleotide"
gcugcacuccagccugggcg

SEQ ID NO: 1285 - RNA, 20 nt, Artificial Sequence
  source: /note="Description of Artificial Sequence: Synthetic oligonucleotide"
gaaaaauaauaauaauaaau

SEQ ID NO: 1286 - RNA, 20 nt, Artificial Sequence
  source: /note="Description of Artificial Sequence: Synthetic oligonucleotide"
uaaauaggagaugaauaaau

SEQ ID NO: 1287 - RNA, 20 nt, Artificial Sequence
  source: /note="Description of Artificial Sequence: Synthetic oligonucleotide"
aaauaggagaugaauaaauu

SEQ ID NO: 1288 - RNA, 20 nt, Artificial Sequence
  source: /note="Description of Artificial Sequence: Synthetic oligonucleotide"
uugggauaaaguguuuuuga

SEQ ID NO: 1289 - RNA, 20 nt, Artificial Sequence
  source: /note="Description of Artificial Sequence: Synthetic oligonucleotide"
guguuuuugaaggacagucu

SEQ ID NO: 1290 - RNA, 20 nt, Artificial Sequence
  source: /note="Description of Artificial Sequence: Synthetic oligonucleotide"
gucuaggauauaaaaugaac

SEQ ID NO: 1291 - RNA, 20 nt, Artificial Sequence
  source: /note="Description of Artificial Sequence: Synthetic oligonucleotide"
uacauuucuuuuuugucuau

SEQ ID NO: 1292 - RNA, 20 nt, Artificial Sequence
  source: /note="Description of Artificial Sequence: Synthetic oligonucleotide"
uuucuuuuuugucuauugga

SEQ ID NO: 1293 - RNA, 20 nt, Artificial Sequence
  source: /note="Description of Artificial Sequence: Synthetic oligonucleotide"
uuuuuugucuauuggaaggu

SEQ ID NO: 1294 - RNA, 20 nt, Artificial Sequence
  source: /note="Description of Artificial Sequence: Synthetic oligonucleotide"
accucucagucaauauuuaa

SEQ ID NO: 1295 - RNA, 20 nt, Artificial Sequence
  source: /note="Description of Artificial Sequence: Synthetic oligonucleotide"
uuuuuuuuuuuuuuuugaga

SEQ ID NO: 1296 - RNA, 20 nt, Artificial Sequence
  source: /note="Description of Artificial Sequence: Synthetic oligonucleotide"
gguaucuugcucugucaccu

SEQ ID NO: 1297 - RNA, 20 nt, Artificial Sequence
  source: /note="Description of Artificial Sequence: Synthetic oligonucleotide"
ucuugcucugucaccuaggc

SEQ ID NO: 1298 - RNA, 20 nt, Artificial Sequence
  source: /note="Description of Artificial Sequence: Synthetic oligonucleotide"
ucaccuaggcuggagugcag

SEQ ID NO: 1299 - RNA, 20 nt, Artificial Sequence
  source: /note="Description of Artificial Sequence: Synthetic oligonucleotide"
ggagugcaguggugugaucu

SEQ ID NO: 1300 - RNA, 20 nt, Artificial Sequence
  source: /note="Description of Artificial Sequence: Synthetic oligonucleotide"
cacugcaaccucugccuucc

SEQ ID NO: 1301 - RNA, 20 nt, Artificial Sequence
  source: /note="Description of Artificial Sequence: Synthetic oligonucleotide"
uucucagcccccagaguagc

SEQ ID NO: 1302 - RNA, 20 nt, Artificial Sequence
  source: /note="Description of Artificial Sequence: Synthetic oligonucleotide"
ucucagcccccagaguagcu

SEQ ID NO: 1303 - RNA, 20 nt, Artificial Sequence
  source: /note="Description of Artificial Sequence: Synthetic oligonucleotide"
cccccagaguagcugggacu

SEQ ID NO: 1304 - RNA, 20 nt, Artificial Sequence
  source: /note="Description of Artificial Sequence: Synthetic oligonucleotide"
ggagcgugccccaccacacc

SEQ ID NO: 1305 - RNA, 20 nt, Artificial Sequence
  source: /note="Description of Artificial Sequence: Synthetic oligonucleotide"
uuucuauuuuuauuagagac

SEQ ID NO: 1306 - RNA, 20 nt, Artificial Sequence
  source: /note="Description of Artificial Sequence: Synthetic oligonucleotide"
uucuauuuuuauuagagaca

SEQ ID NO: 1307 - RNA, 20 nt, Artificial Sequence
  source: /note="Description of Artificial Sequence: Synthetic oligonucleotide"
gagacaggguuucaccaugu

SEQ ID NO: 1308 - RNA, 20 nt, Artificial Sequence
  source: /note="Description of Artificial Sequence: Synthetic oligonucleotide"
aggguuucaccauguuggcc

SEQ ID NO: 1309 - RNA, 20 nt, Artificial Sequence
  source: /note="Description of Artificial Sequence: Synthetic oligonucleotide"
ccaggcugaucucguacucc

SEQ ID NO: 1310 - RNA, 20 nt, Artificial Sequence
  source: /note="Description of Artificial Sequence: Synthetic oligonucleotide"
gaucucguacuccuggucuc

SEQ ID NO: 1311 - RNA, 20 nt, Artificial Sequence
  source: /note="Description of Artificial Sequence: Synthetic oligonucleotide"
ucucaggugaucugccugcc

SEQ ID NO: 1312 - RNA, 20 nt, Artificial Sequence
  source: /note="Description of Artificial Sequence: Synthetic oligonucleotide"
cucaggugaucugccugccc

SEQ ID NO: 1313 - RNA, 20 nt, Artificial Sequence
  source: /note="Description of Artificial Sequence: Synthetic oligonucleotide"
gcccgggucucccaaagugc

SEQ ID NO: 1314 - RNA, 20 nt, Artificial Sequence
  source: /note="Description of Artificial Sequence: Synthetic oligonucleotide"
cccgggucucccaaagugcu

SEQ ID NO: 1315 - RNA, 20 nt, Artificial Sequence
  source: /note="Description of Artificial Sequence: Synthetic oligonucleotide"
ucccaaagugcugggauuac

SEQ ID NO: 1316 - RNA, 20 nt, Artificial Sequence
  source: /note="Description of Artificial Sequence: Synthetic oligonucleotide"
caggcaugagccacugcacc

SEQ ID NO: 1317 - RNA, 20 nt, Artificial Sequence
  source: /note="Description of Artificial Sequence: Synthetic oligonucleotide"
aaaaauaguguuaagugucu

SEQ ID NO: 1318 - RNA, 20 nt, Artificial Sequence
  source: /note="Description of Artificial Sequence: Synthetic oligonucleotide"
aguguuaagugucuugguga

SEQ ID NO: 1319 - RNA, 20 nt, Artificial Sequence
  source: /note="Description of Artificial Sequence: Synthetic oligonucleotide"
ugucuuggugauggugauga

SEQ ID NO: 1320 - RNA, 20 nt, Artificial Sequence
  source: /note="Description of Artificial Sequence: Synthetic oligonucleotide"
uuggugauggugaugauggu

SEQ ID NO: 1321 - RNA, 20 nt, Artificial Sequence
  source: /note="Description of Artificial Sequence: Synthetic oligonucleotide"
ggugaugaugguaggaguaa

SEQ ID NO: 1322 - RNA, 20 nt, Artificial Sequence
  source: /note="Description of Artificial Sequence: Synthetic oligonucleotide"
uccuuacauuuaauuucuac

SEQ ID NO: 1323 - RNA, 20 nt, Artificial Sequence
  source: /note="Description of Artificial Sequence: Synthetic oligonucleotide"
cauuuaauuucuacaggcua

SEQ ID NO: 1324 - RNA, 20 nt, Artificial Sequence
  source: /note="Description of Artificial Sequence: Synthetic oligonucleotide"
auuuuaagcacaaaagugaa

SEQ ID NO: 1325 - RNA, 20 nt, Artificial Sequence
  source: /note="Description of Artificial Sequence: Synthetic oligonucleotide"
ugguuuuuaguaaacuuaua

SEQ ID NO: 1326 - RNA, 20 nt, Artificial Sequence
  source: /note="Description of Artificial Sequence: Synthetic oligonucleotide"
gguuuuuaguaaacuuauau

SEQ ID NO: 1327 - RNA, 20 nt, Artificial Sequence
  source: /note="Description of Artificial Sequence: Synthetic oligonucleotide"
acuugcucaauuucccccag

SEQ ID NO: 1328 - RNA, 20 nt, Artificial Sequence
  source: /note="Description of Artificial Sequence: Synthetic oligonucleotide"
ccaugauacugacauugaug

SEQ ID NO: 1329 - RNA, 20 nt, Artificial Sequence
  source: /note="Description of Artificial Sequence: Synthetic oligonucleotide"
aaguccuuuuuuugauagaa

SEQ ID NO: 1330 - RNA, 20 nt, Artificial Sequence
  source: /note="Description of Artificial Sequence: Synthetic oligonucleotide"
cucaucacaacccuagagau

SEQ ID NO: 1331 - RNA, 20 nt, Artificial Sequence
  source: /note="Description of Artificial Sequence: Synthetic oligonucleotide"
cuuaucccuauuuaugagug

SEQ ID NO: 1332 - RNA, 20 nt, Artificial Sequence
  source: /note="Description of Artificial Sequence: Synthetic oligonucleotide"
gaggaaacugaagcccagug

SEQ ID NO: 1333 - RNA, 20 nt, Artificial Sequence
  source: /note="Description of Artificial Sequence: Synthetic oligonucleotide"
aaguucauacagccuauaca

SEQ ID NO: 1334 - RNA, 20 nt, Artificial Sequence
  source: /note="Description of Artificial Sequence: Synthetic oligonucleotide"
auacagccuauacauggcuu

SEQ ID NO: 1335 - RNA, 20 nt, Artificial Sequence
  source: /note="Description of Artificial Sequence: Synthetic oligonucleotide"
agcuguaaaaguguauaaug

SEQ ID NO: 1336 - RNA, 20 nt, Artificial Sequence
  source: /note="Description of Artificial Sequence: Synthetic oligonucleotide"
uauguagagaaagucauaaa

SEQ ID NO: 1337 - RNA, 20 nt, Artificial Sequence
  source: /note="Description of Artificial Sequence: Synthetic oligonucleotide"
cauuacagcauuauuaauaa

SEQ ID NO: 1338 - RNA, 20 nt, Artificial Sequence
  source: /note="Description of Artificial Sequence: Synthetic oligonucleotide"
uuauuaauaaugguaaaaaa

SEQ ID NO: 1339 - RNA, 20 nt, Artificial Sequence
  source: /note="Description of Artificial Sequence: Synthetic oligonucleotide"
augagugaauaaacaaauug

SEQ ID NO: 1340 - RNA, 20 nt, Artificial Sequence
  source: /note="Description of Artificial Sequence: Synthetic oligonucleotide"
aauauuauuaaguaguauaa

SEQ ID NO: 1341 - RNA, 20 nt, Artificial Sequence
  source: /note="Description of Artificial Sequence: Synthetic oligonucleotide"
uauuaaguaguauaaaggaa

SEQ ID NO: 1342 - RNA, 20 nt, Artificial Sequence
  source: /note="Description of Artificial Sequence: Synthetic oligonucleotide"
auugauaaaugcugucacau

SEQ ID NO: 1343 - RNA, 20 nt, Artificial Sequence
  source: /note="Description of Artificial Sequence: Synthetic oligonucleotide"
gucacauaggugaaucugag

SEQ ID NO: 1344 - RNA, 20 nt, Artificial Sequence
  source: /note="Description of Artificial Sequence: Synthetic oligonucleotide"
gaaucugagaggcacaagaa

SEQ ID NO: 1345 - RNA, 20 nt, Artificial Sequence
  source: /note="Description of Artificial Sequence: Synthetic oligonucleotide"
uuuuaaguaacguccagaau

SEQ ID NO: 1346 - RNA, 20 nt, Artificial Sequence
  source: /note="Description of Artificial Sequence: Synthetic oligonucleotide"
guccagaauaggcaaaucua

SEQ ID NO: 1347 - RNA, 20 nt, Artificial Sequence
  source: /note="Description of Artificial Sequence: Synthetic oligonucleotide"
aaucuaaggagacagaaagu

SEQ ID NO: 1348 - RNA, 20 nt, Artificial Sequence
  source: /note="Description of Artificial Sequence: Synthetic oligonucleotide"
aaaguuggcuaguuauuacu

SEQ ID NO: 1349 - RNA, 20 nt, Artificial Sequence
  source: /note="Description of Artificial Sequence: Synthetic oligonucleotide"
aaguuggcuaguuauuacua

SEQ ID NO: 1350 - RNA, 20 nt, Artificial Sequence
  source: /note="Description of Artificial Sequence: Synthetic oligonucleotide"
aguuggcuaguuauuacuag

SEQ ID NO: 1351 - RNA, 20 nt, Artificial Sequence
  source: /note="Description of Artificial Sequence: Synthetic oligonucleotide"
gcuaguuauuacuaggggcu

SEQ ID NO: 1352 - RNA, 20 nt, Artificial Sequence
  source: /note="Description of Artificial Sequence: Synthetic oligonucleotide"
cuaguuauuacuaggggcua

SEQ ID NO: 1353 - RNA, 20 nt, Artificial Sequence
  source: /note="Description of Artificial Sequence: Synthetic oligonucleotide"
uuauuacuaggggcuaggga

SEQ ID NO: 1354 - RNA, 20 nt, Artificial Sequence
  source: /note="Description of Artificial Sequence: Synthetic oligonucleotide"
uauuacuaggggcuagggau

SEQ ID NO: 1355 - RNA, 20 nt, Artificial Sequence
  source: /note="Description of Artificial Sequence: Synthetic oligonucleotide"
uacuaggggcuagggauggg

SEQ ID NO: 1356 - RNA, 20 nt, Artificial Sequence
  source: /note="Description of Artificial Sequence: Synthetic oligonucleotide"
acuaggggcuagggauggga

SEQ ID NO: 1357 - RNA, 20 nt, Artificial Sequence
  source: /note="Description of Artificial Sequence: Synthetic oligonucleotide"
aggggcuagggaugggaggg

SEQ ID NO: 1358 - RNA, 20 nt, Artificial Sequence
  source: /note="Description of Artificial Sequence: Synthetic oligonucleotide"
aauaaguaugagauuucuuu

SEQ ID NO: 1359 - RNA, 20 nt, Artificial Sequence
  source: /note="Description of Artificial Sequence: Synthetic oligonucleotide"
acugaauuauaugcuuuaaa

SEQ ID NO: 1360 - RNA, 20 nt, Artificial Sequence
  source: /note="Description of Artificial Sequence: Synthetic oligonucleotide"
augaauguaguugaguuauu

SEQ ID NO: 1361 - RNA, 20 nt, Artificial Sequence
  source: /note="Description of Artificial Sequence: Synthetic oligonucleotide"
aucucaugcaaaagaaaugc

SEQ ID NO: 1362 - RNA, 20 nt, Artificial Sequence
  source: /note="Description of Artificial Sequence: Synthetic oligonucleotide"
aaagaaaugcaggaacuauu

SEQ ID NO: 1363 - RNA, 20 nt, Artificial Sequence
  source: /note="Description of Artificial Sequence: Synthetic oligonucleotide"
ggaacuauuuggauugaaug

SEQ ID NO: 1364 - RNA, 20 nt, Artificial Sequence
  source: /note="Description of Artificial Sequence: Synthetic oligonucleotide"
gaggcuaagcauaucuuucu

SEQ ID NO: 1365 - RNA, 20 nt, Artificial Sequence
  source: /note="Description of Artificial Sequence: Synthetic oligonucleotide"
agcauaucuuucuaggaaga

SEQ ID NO: 1366 - RNA, 20 nt, Artificial Sequence
  source: /note="Description of Artificial Sequence: Synthetic oligonucleotide"
uuucuaggaagauggcauca

SEQ ID NO: 1367 - RNA, 20 nt, Artificial Sequence
  source: /note="Description of Artificial Sequence: Synthetic oligonucleotide"
uuuuauuaugccuguaaucc

SEQ ID NO: 1368 - RNA, 20 nt, Artificial Sequence
  source: /note="Description of Artificial Sequence: Synthetic oligonucleotide"
ugccuguaauccuggcacuu

SEQ ID NO: 1369 - RNA, 20 nt, Artificial Sequence
  source: /note="Description of Artificial Sequence: Synthetic oligonucleotide"
gccuguaauccuggcacuuu

SEQ ID NO: 1370 - RNA, 20 nt, Artificial Sequence
  source: /note="Description of Artificial Sequence: Synthetic oligonucleotide"
uguaauccuggcacuuuggg

SEQ ID NO: 1371 - RNA, 20 nt, Artificial Sequence
  source: /note="Description of Artificial Sequence: Synthetic oligonucleotide"
ccuggcacuuugggaggcca

SEQ ID NO: 1372 - RNA, 20 nt, Artificial Sequence
  source: /note="Description of Artificial Sequence: Synthetic oligonucleotide"
ggcacuuugggaggccaagg

SEQ ID NO: 1373 - RNA, 20 nt, Artificial Sequence
  source: /note="Description of Artificial Sequence: Synthetic oligonucleotide"
gcacuuugggaggccaaggc

SEQ ID NO: 1374 - RNA, 20 nt, Artificial Sequence
  source: /note="Description of Artificial Sequence: Synthetic oligonucleotide"
ccagaaguuugagauuaguc

SEQ ID NO: 1375 - RNA, 20 nt, Artificial Sequence
  source: /note="Description of Artificial Sequence: Synthetic oligonucleotide"
cagaaguuugagauuagucu

SEQ ID NO: 1376 - RNA, 20 nt, Artificial Sequence
  source: /note="Description of Artificial Sequence: Synthetic oligonucleotide"
acauccucuuauagaugaga

SEQ ID NO: 1377 - RNA, 20 nt, Artificial Sequence
  source: /note="Description of Artificial Sequence: Synthetic oligonucleotide"
auacuuaaucacucaaaagu

SEQ ID NO: 1378 - RNA, 20 nt, Artificial Sequence
  source: /note="Description of Artificial Sequence: Synthetic oligonucleotide"
aauagccuuuagagcucaua

SEQ ID NO: 1379 - RNA, 20 nt, Artificial Sequence
  source: /note="Description of Artificial Sequence: Synthetic oligonucleotide"
auagccuuuagagcucauau

SEQ ID NO: 1380 - RNA, 20 nt, Artificial Sequence
  source: /note="Description of Artificial Sequence: Synthetic oligonucleotide"
aagauucaauagauagugau

SEQ ID NO: 1381 - RNA, 20 nt, Artificial Sequence
  source: /note="Description of Artificial Sequence: Synthetic oligonucleotide"
uagugauagguuauaugacu

SEQ ID NO: 1382 - RNA, 20 nt, Artificial Sequence
  source: /note="Description of Artificial Sequence: Synthetic oligonucleotide"
gguuauaugacuugguaaag

SEQ ID NO: 1383 - RNA, 20 nt, Artificial Sequence
  source: /note="Description of Artificial Sequence: Synthetic oligonucleotide"
guuauaugacuugguaaaga

SEQ ID NO: 1384 - RNA, 20 nt, Artificial Sequence
  source: /note="Description of Artificial Sequence: Synthetic oligonucleotide"
guaaagagggcuuaauguau

SEQ ID NO: 1385 - RNA, 20 nt, Artificial Sequence
  source: /note="Description of Artificial Sequence: Synthetic oligonucleotide"
guuaccuagccauucaguuc

SEQ ID NO: 1386 - RNA, 20 nt, Artificial Sequence
  source: /note="Description of Artificial Sequence: Synthetic oligonucleotide"
gauguaacccaaguguuaaa

SEQ ID NO: 1387 - RNA, 20 nt, Artificial Sequence
  source: /note="Description of Artificial Sequence: Synthetic oligonucleotide"
aguguuaaaaggaaugugac

SEQ ID NO: 1388 - RNA, 20 nt, Artificial Sequence
  source: /note="Description of Artificial Sequence: Synthetic oligonucleotide"
guguuaaaaggaaugugacu

SEQ ID NO: 1389 - RNA, 20 nt, Artificial Sequence
  source: /note="Description of Artificial Sequence: Synthetic oligonucleotide"
aaaaggaaugugacugggug

SEQ ID NO: 1390 - RNA, 20 nt, Artificial Sequence
  source: /note="Description of Artificial Sequence: Synthetic oligonucleotide"
aggaaugugacugggugcgg

SEQ ID NO: 1391 - RNA, 20 nt, Artificial Sequence
  source: /note="Description of Artificial Sequence: Synthetic oligonucleotide"
uguaaucccagcacuuugcg

SEQ ID NO: 1392 - RNA, 20 nt, Artificial Sequence
  source: /note="Description of Artificial Sequence: Synthetic oligonucleotide"
aaucccagcacuuugcgagg

SEQ ID NO: 1393 - RNA, 20 nt, Artificial Sequence
  source: /note="Description of Artificial Sequence: Synthetic oligonucleotide"
agcacuuugcgaggcggaag

SEQ ID NO: 1394 - RNA, 20 nt, Artificial Sequence
  source: /note="Description of Artificial Sequence: Synthetic oligonucleotide"
gcacuuugcgaggcggaagu

SEQ ID NO: 1395 - RNA, 20 nt, Artificial Sequence
  source: /note="Description of Artificial Sequence: Synthetic oligonucleotide"
cuuugcgaggcggaaguggg

SEQ ID NO: 1396 - RNA, 20 nt, Artificial Sequence
  source: /note="Description of Artificial Sequence: Synthetic oligonucleotide"
uuugcgaggcggaagugggu

SEQ ID NO: 1397 - RNA, 20 nt, Artificial Sequence
  source: /note="Description of Artificial Sequence: Synthetic oligonucleotide"
ugggugggucucuugagcuc

SEQ ID NO: 1398 - RNA, 20 nt, Artificial Sequence
  source: /note="Description of Artificial Sequence: Synthetic oligonucleotide"
ggucucuugagcucaggagu

SEQ ID NO: 1399 - RNA, 20 nt, Artificial Sequence
  source: /note="Description of Artificial Sequence: Synthetic oligonucleotide"
ucaggaguuggagacaagcc

SEQ ID NO: 1400 - RNA, 20 nt, Artificial Sequence
  source: /note="Description of Artificial Sequence: Synthetic oligonucleotide"
caggaguuggagacaagccu

SEQ ID NO: 1401 - RNA, 20 nt, Artificial Sequence
  source: /note="Description of Artificial Sequence: Synthetic oligonucleotide"
ggagacaagccugggcaaca

SEQ ID NO: 1402 - RNA, 20 nt, Artificial Sequence
  source: /note="Description of Artificial Sequence: Synthetic oligonucleotide"
caaaaaaugcacaaauuagc

SEQ ID NO: 1403 - RNA, 20 nt, Artificial Sequence
  source: /note="Description of Artificial Sequence: Synthetic oligonucleotide"
aaaaaaugcacaaauuagcu

SEQ ID NO: 1404 - RNA, 20 nt, Artificial Sequence
  source: /note="Description of Artificial Sequence: Synthetic oligonucleotide"
augcacaaauuagcugggug

SEQ ID NO: 1405 - RNA, 20 nt, Artificial Sequence
  source: /note="Description of Artificial Sequence: Synthetic oligonucleotide"
cacaaauuagcugggugugg

SEQ ID NO: 1406 - RNA, 20 nt, Artificial Sequence
  source: /note="Description of Artificial Sequence: Synthetic oligonucleotide"
uggcacaucccuguaguucc

SEQ ID NO: 1407 - RNA, 20 nt, Artificial Sequence
  source: /note="Description of Artificial Sequence: Synthetic oligonucleotide"
ccuguaguuccagguacuug

SEQ ID NO: 1408 - RNA, 20 nt, Artificial Sequence
  source: /note="Description of Artificial Sequence: Synthetic oligonucleotide"
cuguaguuccagguacuugu

SEQ ID NO: 1409 - RNA, 20 nt, Artificial Sequence
  source: /note="Description of Artificial Sequence: Synthetic oligonucleotide"
uguaguuccagguacuugug

SEQ ID NO: 1410 - RNA, 20 nt, Artificial Sequence
  source: /note="Description of Artificial Sequence: Synthetic oligonucleotide"
uccagguacuuguggggcug

SEQ ID NO: 1411 - RNA, 20 nt, Artificial Sequence
  source: /note="Description of Artificial Sequence: Synthetic oligonucleotide"
agguacuuguggggcugagg

SEQ ID NO: 1412 - RNA, 20 nt, Artificial Sequence
  source: /note="Description of Artificial Sequence: Synthetic oligonucleotide"
gguacuuguggggcugaggc

SEQ ID NO: 1413 - RNA, 20 nt, Artificial Sequence
  source: /note="Description of Artificial Sequence: Synthetic oligonucleotide"
acuuguggggcugaggcggg

SEQ ID NO: 1414 - RNA, 20 nt, Artificial Sequence
  source: /note="Description of Artificial Sequence: Synthetic oligonucleotide"
guggggcugaggcgggagga

SEQ ID NO: 1415 - RNA, 20 nt, Artificial Sequence
  source: /note="Description of Artificial Sequence: Synthetic oligonucleotide"
gcgggaggauggcucgagcc

SEQ ID NO: 1416 - RNA, 20 nt, Artificial Sequence
  source: /note="Description of Artificial Sequence: Synthetic oligonucleotide"
cgggaggauggcucgagccu

SEQ ID NO: 1417 - RNA, 20 nt, Artificial Sequence
  source: /note="Description of Artificial Sequence: Synthetic oligonucleotide"
ggcucgagccugggaaguug

SEQ ID NO: 1418 - RNA, 20 nt, Artificial Sequence
  source: /note="Description of Artificial Sequence: Synthetic oligonucleotide"
gaggcugcagugagccaugu

SEQ ID NO: 1419 - RNA, 20 nt, Artificial Sequence
  source: /note="Description of Artificial Sequence: Synthetic oligonucleotide"
ggugcccccacacuucagcc

SEQ ID NO: 1420 - RNA, 20 nt, Artificial Sequence
  source: /note="Description of Artificial Sequence: Synthetic oligonucleotide"
gugcccccacacuucagccu

SEQ ID NO: 1421 - RNA, 20 nt, Artificial Sequence
  source: /note="Description of Artificial Sequence: Synthetic oligonucleotide"
uaauaacaaauuacuagauu

SEQ ID NO: 1422 - RNA, 20 nt, Artificial Sequence
  source: /note="Description of Artificial Sequence: Synthetic oligonucleotide"
aauaacaaauuacuagauuu

SEQ ID NO: 1423 - RNA, 20 nt, Artificial Sequence
  source: /note="Description of Artificial Sequence: Synthetic oligonucleotide"
auaacaaauuacuagauuug

SEQ ID NO: 1424 - RNA, 20 nt, Artificial Sequence
  source: /note="Description of Artificial Sequence: Synthetic oligonucleotide"
uaacaaauuacuagauuugg

SEQ ID NO: 1425 - RNA, 20 nt, Artificial Sequence
  source: /note="Description of Artificial Sequence: Synthetic oligonucleotide"
aacaaauuacuagauuuggg

SEQ ID NO: 1426 - RNA, 20 nt, Artificial Sequence
  source: /note="Description of Artificial Sequence: Synthetic oligonucleotide"
cuuaucuaugugaaaacaga

SEQ ID NO: 1427 - RNA, 20 nt, Artificial Sequence
  source: /note="Description of Artificial Sequence: Synthetic oligonucleotide"
uuaucuaugugaaaacagaa

SEQ ID NO: 1428 - RNA, 20 nt, Artificial Sequence
  source: /note="Description of Artificial Sequence: Synthetic oligonucleotide"
ugaaaacagaagggcaaugc

SEQ ID NO: 1429 - RNA, 20 nt, Artificial Sequence
  source: /note="Description of Artificial Sequence: Synthetic oligonucleotide"
gaaaacagaagggcaaugca

SEQ ID NO: 1430 - RNA, 20 nt, Artificial Sequence
  source: /note="Description of Artificial Sequence: Synthetic oligonucleotide"
aaaaugacaaaguaucucau

SEQ ID NO: 1431 - RNA, 20 nt, Artificial Sequence
  source: /note="Description of Artificial Sequence: Synthetic oligonucleotide"
aaaugacaaaguaucucaua

SEQ ID NO: 1432 - RNA, 20 nt, Artificial Sequence
  source: /note="Description of Artificial Sequence: Synthetic oligonucleotide"
uuuccuguuaacugauacug

SEQ ID NO: 1433 - RNA, 20 nt, Artificial Sequence
  source: /note="Description of Artificial Sequence: Synthetic oligonucleotide"
cauguugaagauguaaaaua

SEQ ID NO: 1434 - RNA, 20 nt, Artificial Sequence
  source: /note="Description of Artificial Sequence: Synthetic oligonucleotide"
gauguaaaauaagguugaaa

SEQ ID NO: 1435 - RNA, 20 nt, Artificial Sequence
  source: /note="Description of Artificial Sequence: Synthetic oligonucleotide"
gcagcagucuucauaaugcc

SEQ ID NO: 1436 - RNA, 20 nt, Artificial Sequence
  source: /note="Description of Artificial Sequence: Synthetic oligonucleotide"
gccaggacaaagugagaaac

SEQ ID NO: 1437 - RNA, 20 nt, Artificial Sequence
  source: /note="Description of Artificial Sequence: Synthetic oligonucleotide"
ccaggacaaagugagaaaca

SEQ ID NO: 1438 - RNA, 20 nt, Artificial Sequence
  source: /note="Description of Artificial Sequence: Synthetic oligonucleotide"
aaacagggucagaaugauga

SEQ ID NO: 1439 - RNA, 20 nt, Artificial Sequence
  source: /note="Description of Artificial Sequence: Synthetic oligonucleotide"
cucuccaucuuugcuacaca

SEQ ID NO: 1440 - RNA, 20 nt, Artificial Sequence
  source: /note="Description of Artificial Sequence: Synthetic oligonucleotide"
aacuucuacaaaccacuuac

SEQ ID NO: 1441 - RNA, 20 nt, Artificial Sequence
  source: /note="Description of Artificial Sequence: Synthetic oligonucleotide"
auuuuuaacacuagucccua

SEQ ID NO: 1442 - RNA, 20 nt, Artificial Sequence
  source: /note="Description of Artificial Sequence: Synthetic oligonucleotide"
ggaacuaugacuuguaguuu

SEQ ID NO: 1443 - RNA, 20 nt, Artificial Sequence
  source: /note="Description of Artificial Sequence: Synthetic oligonucleotide"
acuuguaguuuuggacacac

SEQ ID NO: 1444 - RNA, 20 nt, Artificial Sequence
  source: /note="Description of Artificial Sequence: Synthetic oligonucleotide"
cuuguaguuuuggacacaca

SEQ ID NO: 1445 - RNA, 20 nt, Artificial Sequence
  source: /note="Description of Artificial Sequence: Synthetic oligonucleotide"
gacacacagggugaauuacu

SEQ ID NO: 1446 - RNA, 20 nt, Artificial Sequence
  source: /note="Description of Artificial Sequence: Synthetic oligonucleotide"
acacacagggugaauuacuu

SEQ ID NO: 1447 - RNA, 20 nt, Artificial Sequence
  source: /note="Description of Artificial Sequence: Synthetic oligonucleotide"
cacacagggugaauuacuug

SEQ ID NO: 1448 - RNA, 20 nt, Artificial Sequence
  source: /note="Description of Artificial Sequence: Synthetic oligonucleotide"
uuuuauucucaugagaaugc

SEQ ID NO: 1449 - RNA, 20 nt, Artificial Sequence
  source: /note="Description of Artificial Sequence: Synthetic oligonucleotide"
uuuauucucaugagaaugcu

SEQ ID NO: 1450 - RNA, 20 nt, Artificial Sequence
  source: /note="Description of Artificial Sequence: Synthetic oligonucleotide"
ugagaaugcuggguugcagc

SEQ ID NO: 1451 - RNA, 20 nt, Artificial Sequence
  source: /note="Description of Artificial Sequence: Synthetic oligonucleotide"
aaugcuggguugcagccggu

SEQ ID NO: 1452 - RNA, 20 nt, Artificial Sequence
  source: /note="Description of Artificial Sequence: Synthetic oligonucleotide"
gccgguuggaucccauaccu

SEQ ID NO: 1453 - RNA, 20 nt, Artificial Sequence
  source: /note="Description of Artificial Sequence: Synthetic oligonucleotide"
ccgguuggaucccauaccuu

SEQ ID NO: 1454 - RNA, 20 nt, Artificial Sequence
  source: /note="Description of Artificial Sequence: Synthetic oligonucleotide"
uugggaccaugacugauaac

SEQ ID NO: 1455 - RNA, 20 nt, Artificial Sequence
  source: /note="Description of Artificial Sequence: Synthetic oligonucleotide"
accaugacugauaacuggag

SEQ ID NO: 1456 - RNA, 20 nt, Artificial Sequence
  source: /note="Description of Artificial Sequence: Synthetic oligonucleotide"
guggagaaaauucacugauc

SEQ ID NO: 1457 - RNA, 20 nt, Artificial Sequence
  source: /note="Description of Artificial Sequence: Synthetic oligonucleotide"
gaaaauucacugaucuggaa

SEQ ID NO: 1458 - RNA, 20 nt, Artificial Sequence
  source: /note="Description of Artificial Sequence: Synthetic oligonucleotide"
aucuggaaagguugagcuuu

SEQ ID NO: 1459 - RNA, 20 nt, Artificial Sequence
  source: /note="Description of Artificial Sequence: Synthetic oligonucleotide"
ucuggaaagguugagcuuua

SEQ ID NO: 1460 - RNA, 20 nt, Artificial Sequence
  source: /note="Description of Artificial Sequence: Synthetic oligonucleotide"
aggguucagagacuuauuua

SEQ ID NO: 1461 - RNA, 20 nt, Artificial Sequence
  source: /note="Description of Artificial Sequence: Synthetic oligonucleotide"
acaugugauuguacccaaua

SEQ ID NO: 1462 - RNA, 20 nt, Artificial Sequence
  source: /note="Description of Artificial Sequence: Synthetic oligonucleotide"
uacccaauaaggaaguauau

SEQ ID NO: 1463 - RNA, 20 nt, Artificial Sequence
  source: /note="Description of Artificial Sequence: Synthetic oligonucleotide"
ugaucauagcaucuacuugu

SEQ ID NO: 1464 - RNA, 20 nt, Artificial Sequence
  source: /note="Description of Artificial Sequence: Synthetic oligonucleotide"
uguuagacccauuaagaagu

SEQ ID NO: 1465 - RNA, 20 nt, Artificial Sequence
  source: /note="Description of Artificial Sequence: Synthetic oligonucleotide"
uuaagaaguugguguaguga

SEQ ID NO: 1466 - RNA, 20 nt, Artificial Sequence
  source: /note="Description of Artificial Sequence: Synthetic oligonucleotide"
aguugguguagugaugguua

SEQ ID NO: 1467 - RNA, 20 nt, Artificial Sequence
  source: /note="Description of Artificial Sequence: Synthetic oligonucleotide"
aaagcaguaagauagaauuu

SEQ ID NO: 1468 - RNA, 20 nt, Artificial Sequence
  source: /note="Description of Artificial Sequence: Synthetic oligonucleotide"
uuagguucuguucuccuuac

SEQ ID NO: 1469 - RNA, 20 nt, Artificial Sequence
  source: /note="Description of Artificial Sequence: Synthetic oligonucleotide"
uaaaucuguucucgcauauu

SEQ ID NO: 1470 - RNA, 20 nt, Artificial Sequence
  source: /note="Description of Artificial Sequence: Synthetic oligonucleotide"
uuauaaguaauuuauacaga

SEQ ID NO: 1471 - RNA, 20 nt, Artificial Sequence
  source: /note="Description of Artificial Sequence: Synthetic oligonucleotide"
cauauucaaaagaagaaaaa

SEQ ID NO: 1472 - RNA, 20 nt, Artificial Sequence
  source: /note="Description of Artificial Sequence: Synthetic oligonucleotide"
auauucaaaagaagaaaaau

SEQ ID NO: 1473 - RNA, 20 nt, Artificial Sequence
  source: /note="Description of Artificial Sequence: Synthetic oligonucleotide"
ugauguacuacucucuucaa

SEQ ID NO: 1474 - RNA, 20 nt, Artificial Sequence
  source: /note="Description of Artificial Sequence: Synthetic oligonucleotide"
gauguacuacucucuucaaa

SEQ ID NO: 1475 - RNA, 20 nt, Artificial Sequence
  source: /note="Description of Artificial Sequence: Synthetic oligonucleotide"
aaagggaauugccuauguuc

SEQ ID NO: 1476 - RNA, 20 nt, Artificial Sequence
  source: /note="Description of Artificial Sequence: Synthetic oligonucleotide"
auguucaggcauagaaaugc

SEQ ID NO: 1477 - RNA, 20 nt, Artificial Sequence
  source: /note="Description of Artificial Sequence: Synthetic oligonucleotide"
augcaggcagucugacauuu

SEQ ID NO: 1478 - RNA, 20 nt, Artificial Sequence
  source: /note="Description of Artificial Sequence: Synthetic oligonucleotide"
auuugucacaguuuguucug

SEQ ID NO: 1479 - RNA, 20 nt, Artificial Sequence
  source: /note="Description of Artificial Sequence: Synthetic oligonucleotide"
uuugucacaguuuguucugu

SEQ ID NO: 1480 - RNA, 20 nt, Artificial Sequence
  source: /note="Description of Artificial Sequence: Synthetic oligonucleotide"
gucacaguuuguucuguggg

SEQ ID NO: 1481 - RNA, 20 nt, Artificial Sequence
  source: /note="Description of Artificial Sequence: Synthetic oligonucleotide"
ucacaguuuguucugugggu

SEQ ID NO: 1482 - RNA, 20 nt, Artificial Sequence
  source: /note="Description of Artificial Sequence: Synthetic oligonucleotide"
cuguggguggguaaaaguaa

SEQ ID NO: 1483 - RNA, 20 nt, Artificial Sequence
  source: /note="Description of Artificial Sequence: Synthetic oligonucleotide"
uaaaucuagcuucuaugucc

SEQ ID NO: 1484 - RNA, 20 nt, Artificial Sequence
  source: /note="Description of Artificial Sequence: Synthetic oligonucleotide"
acauucacccaucucucaaa

SEQ ID NO: 1485 - RNA, 20 nt, Artificial Sequence
  source: /note="Description of Artificial Sequence: Synthetic oligonucleotide"
cauucacccaucucucaaau

SEQ ID NO: 1486 - RNA, 20 nt, Artificial Sequence
  source: /note="Description of Artificial Sequence: Synthetic oligonucleotide"
aaaaguaaaaaagcuucaau

SEQ ID NO: 1487 - RNA, 20 nt, Artificial Sequence
  source: /note="Description of Artificial Sequence: Synthetic oligonucleotide"
aaaguaaaaaagcuucaaua

SEQ ID NO: 1488 - RNA, 20 nt, Artificial Sequence
  source: /note="Description of Artificial Sequence: Synthetic oligonucleotide"
gaaagccagauaacauagca

SEQ ID NO: 1489 - RNA, 20 nt, Artificial Sequence
  source: /note="Description of Artificial Sequence: Synthetic oligonucleotide"
cuuaccugucugcacuaaga

SEQ ID NO: 1490 - RNA, 20 nt, Artificial Sequence
  source: /note="Description of Artificial Sequence: Synthetic oligonucleotide"
uuaccugucugcacuaagaa

SEQ ID NO: 1491 - RNA, 20 nt, Artificial Sequence
  source: /note="Description of Artificial Sequence: Synthetic oligonucleotide"
cuauccauaacauacugucc

SEQ ID NO: 1492 - RNA, 20 nt, Artificial Sequence
  source: /note="Description of Artificial Sequence: Synthetic oligonucleotide"
agaauuuuuauauuugccau

SEQ ID NO: 1493 - RNA, 20 nt, Artificial Sequence
  source: /note="Description of Artificial Sequence: Synthetic oligonucleotide"
uucauuauauuugcauuaaa

SEQ ID NO: 1494 - RNA, 20 nt, Artificial Sequence
  source: /note="Description of Artificial Sequence: Synthetic oligonucleotide"
gaaaagaagaauaccauaaa

SEQ ID NO: 1495 - RNA, 20 nt, Artificial Sequence
  source: /note="Description of Artificial Sequence: Synthetic oligonucleotide"
aaaagaagaauaccauaaau

SEQ ID NO: 1496 - RNA, 20 nt, Artificial Sequence
  source: /note="Description of Artificial Sequence: Synthetic oligonucleotide"
uggguaccuuucaaaaauga

SEQ ID NO: 1497 - RNA, 20 nt, Artificial Sequence
  source: /note="Description of Artificial Sequence: Synthetic oligonucleotide"
acaaacagauacauuuuagc

SEQ ID NO: 1498 - RNA, 20 nt, Artificial Sequence
  source: /note="Description of Artificial Sequence: Synthetic oligonucleotide"
uuccaaucuagccacugaaa

SEQ ID NO: 1499 - RNA, 20 nt, Artificial Sequence
  source: /note="Description of Artificial Sequence: Synthetic oligonucleotide"
cauaaguugaauuuaaaaca

SEQ ID NO: 1500 - RNA, 20 nt, Artificial Sequence
  source: /note="Description of Artificial Sequence: Synthetic oligonucleotide"
ugucugccacauuacgcuug

SEQ ID NO: 1501 - RNA, 20 nt, Artificial Sequence
  source: /note="Description of Artificial Sequence: Synthetic oligonucleotide"
uuacgcuuguggaaaaacac

SEQ ID NO: 1502 - RNA, 20 nt, Artificial Sequence
  source: /note="Description of Artificial Sequence: Synthetic oligonucleotide"
gcuaauagacauuuugcugu

SEQ ID NO: 1503 - RNA, 20 nt, Artificial Sequence
  source: /note="Description of Artificial Sequence: Synthetic oligonucleotide"
cuguuggcucaccuuauuaa

SEQ ID NO: 1504 - RNA, 20 nt, Artificial Sequence
  source: /note="Description of Artificial Sequence: Synthetic oligonucleotide"
gcaaacuugaaaaagacguu

SEQ ID NO: 1505 - RNA, 20 nt, Artificial Sequence
  source: /note="Description of Artificial Sequence: Synthetic oligonucleotide"
agacguuugguuacuaacug

SEQ ID NO: 1506 - RNA, 20 nt, Artificial Sequence
  source: /note="Description of Artificial Sequence: Synthetic oligonucleotide"
gacguuugguuacuaacugu

SEQ ID NO: 1507 - RNA, 20 nt, Artificial Sequence
  source: /note="Description of Artificial Sequence: Synthetic oligonucleotide"
uauuuuuauuuuuuauuuuu

SEQ ID NO: 1508 - RNA, 20 nt, Artificial Sequence
  source: /note="Description of Artificial Sequence: Synthetic oligonucleotide"
agagucucacucucuugccc

SEQ ID NO: 1509 - RNA, 20 nt, Artificial Sequence
  source: /note="Description of Artificial Sequence: Synthetic oligonucleotide"
ucucacucucuugcccaggc

SEQ ID NO: 1510 - RNA, 20 nt, Artificial Sequence
  source: /note="Description of Artificial Sequence: Synthetic oligonucleotide"
uugcccaggcuggagugcag

SEQ ID NO: 1511 - RNA, 20 nt, Artificial Sequence
  source: /note="Description of Artificial Sequence: Synthetic oligonucleotide"
ggagugcaguggcaugaucu

SEQ ID NO: 1512 - RNA, 20 nt, Artificial Sequence
  source: /note="Description of Artificial Sequence: Synthetic oligonucleotide"
ucacugcagccuccuccuuc

SEQ ID NO: 1513 - RNA, 20 nt, Artificial Sequence
  source: /note="Description of Artificial Sequence: Synthetic oligonucleotide"
cacugcagccuccuccuucu

SEQ ID NO: 1514 - RNA, 20 nt, Artificial Sequence
  source: /note="Description of Artificial Sequence: Synthetic oligonucleotide"
gucucagccucccgaguagc

SEQ ID NO: 1515 - RNA, 20 nt, Artificial Sequence
  source: /note="Description of Artificial Sequence: Synthetic oligonucleotide"
ucucagccucccgaguagcu

SEQ ID NO: 1516 - RNA, 20 nt, Artificial Sequence
  source: /note="Description of Artificial Sequence: Synthetic oligonucleotide"
ucccgaguagcugggauuau

SEQ ID NO: 1517 - RNA, 20 nt, Artificial Sequence
  source: /note="Description of Artificial Sequence: Synthetic oligonucleotide"
uaggcaccagccaccaugcc

SEQ ID NO: 1518 - RNA, 20 nt, Artificial Sequence
  source: /note="Description of Artificial Sequence: Synthetic oligonucleotide"
gaaacagcguuucgccaugu

SEQ ID NO: 1519 - RNA, 20 nt, Artificial Sequence
  source: /note="Description of Artificial Sequence: Synthetic oligonucleotide"
agcguuucgccauguaggcu

SEQ ID NO: 1520 - RNA, 20 nt, Artificial Sequence
  source: /note="Description of Artificial Sequence: Synthetic oligonucleotide"
uuucgccauguaggcuaggc

SEQ ID NO: 1521 - RNA, 20 nt, Artificial Sequence
  source: /note="Description of Artificial Sequence: Synthetic oligonucleotide"
ccuucugcuuccuaaagugc

SEQ ID NO: 1522 - RNA, 20 nt, Artificial Sequence
  source: /note="Description of Artificial Sequence: Synthetic oligonucleotide"
cuucugcuuccuaaagugcu

SEQ ID NO: 1523 - RNA, 20 nt, Artificial Sequence
  source: /note="Description of Artificial Sequence: Synthetic oligonucleotide"
uccuaaagugcugggauuac

SEQ ID NO: 1524 - RNA, 20 nt, Artificial Sequence
  source: /note="Description of Artificial Sequence: Synthetic oligonucleotide"
ggauuacaggcaugagccau

SEQ ID NO: 1525 - RNA, 20 nt, Artificial Sequence
  source: /note="Description of Artificial Sequence: Synthetic oligonucleotide"
acaggcaugagccaucggcc

SEQ ID NO: 1526 - RNA, 20 nt, Artificial Sequence
  source: /note="Description of Artificial Sequence: Synthetic oligonucleotide"
uuauuuacuguuaaaaaaug

SEQ ID NO: 1527 - RNA, 20 nt, Artificial Sequence
  source: /note="Description of Artificial Sequence: Synthetic oligonucleotide"
uuauuucaaauaagauuuua

SEQ ID NO: 1528 - RNA, 20 nt, Artificial Sequence
  source: /note="Description of Artificial Sequence: Synthetic oligonucleotide"
accaacauuuuucaagagca

SEQ ID NO: 1529 - RNA, 20 nt, Artificial Sequence
  source: /note="Description of Artificial Sequence: Synthetic oligonucleotide"
ccaacauuuuucaagagcau

SEQ ID NO: 1530 - RNA, 20 nt, Artificial Sequence
  source: /note="Description of Artificial Sequence: Synthetic oligonucleotide"
uucaagagcaugggaaaucu

SEQ ID NO: 1531 - RNA, 20 nt, Artificial Sequence
  source: /note="Description of Artificial Sequence: Synthetic oligonucleotide"
ucaagagcaugggaaaucua

SEQ ID NO: 1532 - RNA, 20 nt, Artificial Sequence
  source: /note="Description of Artificial Sequence: Synthetic oligonucleotide"
agcaugggaaaucuagggua

SEQ ID NO: 1533 - RNA, 20 nt, Artificial Sequence
  source: /note="Description of Artificial Sequence: Synthetic oligonucleotide"
gugacuuuaaagacacuucu

SEQ ID NO: 1534 - RNA, 20 nt, Artificial Sequence
  source: /note="Description of Artificial Sequence: Synthetic oligonucleotide"
ugacuuuaaagacacuucuu

SEQ ID NO: 1535 - RNA, 20 nt, Artificial Sequence
  source: /note="Description of Artificial Sequence: Synthetic oligonucleotide"
auuagucaugccuuaauccu

SEQ ID NO: 1536 - RNA, 20 nt, Artificial Sequence
  source: /note="Description of Artificial Sequence: Synthetic oligonucleotide"
uuagucaugccuuaauccuc

SEQ ID NO: 1537 - RNA, 20 nt, Artificial Sequence
  source: /note="Description of Artificial Sequence: Synthetic oligonucleotide"
uagucaugccuuaauccucg

SEQ ID NO: 1538 - RNA, 20 nt, Artificial Sequence
  source: /note="Description of Artificial Sequence: Synthetic oligonucleotide"
gccuuaauccucgggguuuu

SEQ ID NO: 1539 - RNA, 20 nt, Artificial Sequence
  source: /note="Description of Artificial Sequence: Synthetic oligonucleotide"
ccuuaauccucgggguuuuu

SEQ ID NO: 1540 - RNA, 20 nt, Artificial Sequence
  source: /note="Description of Artificial Sequence: Synthetic oligonucleotide"
guuuuugggaaacuauauuu

SEQ ID NO: 1541 - RNA, 20 nt, Artificial Sequence
  source: /note="Description of Artificial Sequence: Synthetic oligonucleotide"
uuuuugggaaacuauauuua

SEQ ID NO: 1542 - RNA, 20 nt, Artificial Sequence
  source: /note="Description of Artificial Sequence: Synthetic oligonucleotide"
uuuugggaaacuauauuuag

SEQ ID NO: 1543 - RNA, 20 nt, Artificial Sequence
  source: /note="Description of Artificial Sequence: Synthetic oligonucleotide"
auuguaauuuuucucaguau

SEQ ID NO: 1544 - RNA, 20 nt, Artificial Sequence
  source: /note="Description of Artificial Sequence: Synthetic oligonucleotide"
cucaguauugguaagaauuc

SEQ ID NO: 1545 - RNA, 20 nt, Artificial Sequence
  source: /note="Description of Artificial Sequence: Synthetic oligonucleotide"
gguaagaauucagguguuua

SEQ ID NO: 1546 - RNA, 20 nt, Artificial Sequence
  source: /note="Description of Artificial Sequence: Synthetic oligonucleotide"
gaauucagguguuuaaggaa

SEQ ID NO: 1547 - RNA, 20 nt, Artificial Sequence
  source: /note="Description of Artificial Sequence: Synthetic oligonucleotide"
gauauaaugaauguagauga

SEQ ID NO: 1548 - RNA, 20 nt, Artificial Sequence
  source: /note="Description of Artificial Sequence: Synthetic oligonucleotide"
augaaggugaaauccgagau

SEQ ID NO: 1549 - RNA, 20 nt, Artificial Sequence
  source: /note="Description of Artificial Sequence: Synthetic oligonucleotide"
gaaauccgagauaggaagag

SEQ ID NO: 1550 - RNA, 20 nt, Artificial Sequence
  source: /note="Description of Artificial Sequence: Synthetic oligonucleotide"
acuuuuuuuuccuucaccca

SEQ ID NO: 1551 - RNA, 20 nt, Artificial Sequence
  source: /note="Description of Artificial Sequence: Synthetic oligonucleotide"
gaaagccauugaauacugaa

SEQ ID NO: 1552 - RNA, 20 nt, Artificial Sequence
  source: /note="Description of Artificial Sequence: Synthetic oligonucleotide"
aaagccauugaauacugaau

SEQ ID NO: 1553 - RNA, 20 nt, Artificial Sequence
  source: /note="Description of Artificial Sequence: Synthetic oligonucleotide"
gggucauguuguaauuuaau

SEQ ID NO: 1554 - RNA, 20 nt, Artificial Sequence
  source: /note="Description of Artificial Sequence: Synthetic oligonucleotide"
ggucauguuguaauuuaauu

SEQ ID NO: 1555 - RNA, 20 nt, Artificial Sequence
  source: /note="Description of Artificial Sequence: Synthetic oligonucleotide"
gccuacuuaguguauaucuc

SEQ ID NO: 1556 - RNA, 20 nt, Artificial Sequence
  source: /note="Description of Artificial Sequence: Synthetic oligonucleotide"
acugaaguaaauaagcaagc

SEQ ID NO: 1557 - RNA, 20 nt, Artificial Sequence
  source: /note="Description of Artificial Sequence: Synthetic oligonucleotide"
ggaauaaguccugcaaauag

SEQ ID NO: 1558 - RNA, 20 nt, Artificial Sequence
  source: /note="Description of Artificial Sequence: Synthetic oligonucleotide"
aacugauccuaaauugaauu

SEQ ID NO: 1559 - RNA, 20 nt, Artificial Sequence
  source: /note="Description of Artificial Sequence: Synthetic oligonucleotide"
uagauuacaagaaaugcaac

SEQ ID NO: 1560 - RNA, 20 nt, Artificial Sequence
  source: /note="Description of Artificial Sequence: Synthetic oligonucleotide"
uuacaguucuuccucuuuuu

SEQ ID NO: 1561 - RNA, 20 nt, Artificial Sequence
  source: /note="Description of Artificial Sequence: Synthetic oligonucleotide"
acaucuguaugcucauuuuu

SEQ ID NO: 1562 - RNA, 20 nt, Artificial Sequence
  source: /note="Description of Artificial Sequence: Synthetic oligonucleotide"
caucuguaugcucauuuuua

SEQ ID NO: 1563 - RNA, 20 nt, Artificial Sequence
  source: /note="Description of Artificial Sequence: Synthetic oligonucleotide"
uuuuagggccaaaaaauagu

SEQ ID NO: 1564 - RNA, 20 nt, Artificial Sequence
  source: /note="Description of Artificial Sequence: Synthetic oligonucleotide"
aaaaauaguaggcuucucuu

SEQ ID NO: 1565 - RNA, 20 nt, Artificial Sequence
  source: /note="Description of Artificial Sequence: Synthetic oligonucleotide"
ucucuccuuccaguuacacg

SEQ ID NO: 1566 - RNA, 20 nt, Artificial Sequence
  source: /note="Description of Artificial Sequence: Synthetic oligonucleotide"
ucacaucaacauuugacacg

SEQ ID NO: 1567 - RNA, 20 nt, Artificial Sequence
  source: /note="Description of Artificial Sequence: Synthetic oligonucleotide"
cacaucaacauuugacacgu

SEQ ID NO: 1568 - RNA, 20 nt, Artificial Sequence
  source: /note="Description of Artificial Sequence: Synthetic oligonucleotide"
acacguggguaccgugcacg

SEQ ID NO: 1569 - RNA, 20 nt, Artificial Sequence
  source: /note="Description of Artificial Sequence: Synthetic oligonucleotide"
guauuuacaaacaccauccu

SEQ ID NO: 1570 - RNA, 20 nt, Artificial Sequence
  source: /note="Description of Artificial Sequence: Synthetic oligonucleotide"
cagagacucuuauguaacag

SEQ ID NO: 1571 - RNA, 20 nt, Artificial Sequence
  source: /note="Description of Artificial Sequence: Synthetic oligonucleotide"
gaguaagcuuugagugucug

SEQ ID NO: 1572 - RNA, 20 nt, Artificial Sequence
  source: /note="Description of Artificial Sequence: Synthetic oligonucleotide"
aguaagcuuugagugucugu

SEQ ID NO: 1573 - RNA, 20 nt, Artificial Sequence
  source: /note="Description of Artificial Sequence: Synthetic oligonucleotide"
aagcuuugagugucuguggg

SEQ ID NO: 1574 - RNA, 20 nt, Artificial Sequence
  source: /note="Description of Artificial Sequence: Synthetic oligonucleotide"
cuuugagugucugugggcgg

SEQ ID NO: 1575 - RNA, 20 nt, Artificial Sequence
  source: /note="Description of Artificial Sequence: Synthetic oligonucleotide"
acacaguuuaauucauuguc

SEQ ID NO: 1576 - RNA, 20 nt, Artificial Sequence
  source: /note="Description of Artificial Sequence: Synthetic oligonucleotide"
cacaguuuaauucauugucc

SEQ ID NO: 1577 - RNA, 20 nt, Artificial Sequence
  source: /note="Description of Artificial Sequence: Synthetic oligonucleotide"
auuguccgggagcccuuguc

SEQ ID NO: 1578 - RNA, 20 nt, Artificial Sequence
  source: /note="Description of Artificial Sequence: Synthetic oligonucleotide"
agcccuugucuggcucugau

SEQ ID NO: 1579 - RNA, 20 nt, Artificial Sequence
  source: /note="Description of Artificial Sequence: Synthetic oligonucleotide"
gcccuugucuggcucugaua

SEQ ID NO: 1580 - RNA, 20 nt, Artificial Sequence
  source: /note="Description of Artificial Sequence: Synthetic oligonucleotide"
gggucaugaaccaaagauca

SEQ ID NO: 1581 - RNA, 20 nt, Artificial Sequence
  source: /note="Description of Artificial Sequence: Synthetic oligonucleotide"
aaccaaagaucaagguguuu

SEQ ID NO: 1582 - RNA, 20 nt, Artificial Sequence
  source: /note="Description of Artificial Sequence: Synthetic oligonucleotide"
aagaucaagguguuuagguc

SEQ ID NO: 1583 - RNA, 20 nt, Artificial Sequence
  source: /note="Description of Artificial Sequence: Synthetic oligonucleotide"
ucaggauauucccuaacgca

SEQ ID NO: 1584 - RNA, 20 nt, Artificial Sequence
  source: /note="Description of Artificial Sequence: Synthetic oligonucleotide"
uuuuuuuuuuuuuuuugaga

SEQ ID NO: 1585 - RNA, 20 nt, Artificial Sequence
  source: /note="Description of Artificial Sequence: Synthetic oligonucleotide"
gaguuucgcucuugcugcca

SEQ ID NO: 1586 - RNA, 20 nt, Artificial Sequence
  source: /note="Description of Artificial Sequence: Synthetic oligonucleotide"
uucgcucuugcugccaaggu

SEQ ID NO: 1587 - RNA, 20 nt, Artificial Sequence
  source: /note="Description of Artificial Sequence: Synthetic oligonucleotide"
cugccaagguuggagugcag

SEQ ID NO: 1588 - RNA, 20 nt, Artificial Sequence
  source: /note="Description of Artificial Sequence: Synthetic oligonucleotide"
gugcaguggcgccgcgaucu

SEQ ID NO: 1589 - RNA, 20 nt, Artificial Sequence
  source: /note="Description of Artificial Sequence: Synthetic oligonucleotide"
cacugcaaccuccgccucac

SEQ ID NO: 1590 - RNA, 20 nt, Artificial Sequence
  source: /note="Description of Artificial Sequence: Synthetic oligonucleotide"
gccucagacacccaaguagc

SEQ ID NO: 1591 - RNA, 20 nt, Artificial Sequence
  source: /note="Description of Artificial Sequence: Synthetic oligonucleotide"
ccucagacacccaaguagcu

SEQ ID NO: 1592 - RNA, 20 nt, Artificial Sequence
  source: /note="Description of Artificial Sequence: Synthetic oligonucleotide"
acccaaguagcugggauuau

SEQ ID NO: 1593 - RNA, 20 nt, Artificial Sequence
  source: /note="Description of Artificial Sequence: Synthetic oligonucleotide"
uaggcaugcgccaccacgcc

SEQ ID NO: 1594 - RNA, 20 nt, Artificial Sequence
  source: /note="Description of Artificial Sequence: Synthetic oligonucleotide"
uuuuguauuuuuaguacaga

SEQ ID NO: 1595 - RNA, 20 nt, Artificial Sequence
  source: /note="Description of Artificial Sequence: Synthetic oligonucleotide"
uuuguauuuuuaguacagac

SEQ ID NO: 1596 - RNA, 20 nt, Artificial Sequence
  source: /note="Description of Artificial Sequence: Synthetic oligonucleotide"
uuguauuuuuaguacagacg

SEQ ID NO: 1597 - RNA, 20 nt, Artificial Sequence
  source: /note="Description of Artificial Sequence: Synthetic oligonucleotide"
cagacgggguuucuccaugu

SEQ ID NO: 1598 - RNA, 20 nt, Artificial Sequence
  source: /note="Description of Artificial Sequence: Synthetic oligonucleotide"
uuucuccauguuggucagcc

SEQ ID NO: 1599 - RNA, 20 nt, Artificial Sequence
  source: /note="Description of Artificial Sequence: Synthetic oligonucleotide"
gguguugaacucccgacuua

SEQ ID NO: 1600 - RNA, 20 nt, Artificial Sequence
  source: /note="Description of Artificial Sequence: Synthetic oligonucleotide"
uuaaggugauccgcuugcuu

SEQ ID NO: 1601 - RNA, 20 nt, Artificial Sequence
  source: /note="Description of Artificial Sequence: Synthetic oligonucleotide"
gcuucggccccccaaagugc

SEQ ID NO: 1602 - RNA, 20 nt, Artificial Sequence
  source: /note="Description of Artificial Sequence: Synthetic oligonucleotide"
cuucggccccccaaagugcu

SEQ ID NO: 1603 - RNA, 20 nt, Artificial Sequence
  source: /note="Description of Artificial Sequence: Synthetic oligonucleotide"
ccccaaagugcugggauuac

SEQ ID NO: 1604 - RNA, 20 nt, Artificial Sequence
  source: /note="Description of Artificial Sequence: Synthetic oligonucleotide"
gccaaaccauuuuugugauu

SEQ ID NO: 1605 - RNA, 20 nt, Artificial Sequence
  source: /note="Description of Artificial Sequence: Synthetic oligonucleotide"
ccaaaccauuuuugugauuu

SEQ ID NO: 1606 - RNA, 20 nt, Artificial Sequence
  source: /note="Description of Artificial Sequence: Synthetic oligonucleotide"
caaaccauuuuugugauuug

SEQ ID NO: 1607 - RNA, 20 nt, Artificial Sequence
  source: /note="Description of Artificial Sequence: Synthetic oligonucleotide"
aacaugagcagaugaugcuu

SEQ ID NO: 1608 - RNA, 20 nt, Artificial Sequence
  source: /note="Description of Artificial Sequence: Synthetic oligonucleotide"
gccuuuaaaaaauuacaucu

SEQ ID NO: 1609 - RNA, 20 nt, Artificial Sequence
  source: /note="Description of Artificial Sequence: Synthetic oligonucleotide"
uaaaaaauuacaucuuggcc

SEQ ID NO: 1610 - RNA, 20 nt, Artificial Sequence
  source: /note="Description of Artificial Sequence: Synthetic oligonucleotide"
aaauuacaucuuggccagga

SEQ ID NO: 1611 - RNA, 20 nt, Artificial Sequence
  source: /note="Description of Artificial Sequence: Synthetic oligonucleotide"
auggcucacgccuguaaucc

SEQ ID NO: 1612 - RNA, 20 nt, Artificial Sequence
  source: /note="Description of Artificial Sequence: Synthetic oligonucleotide"
cgccuguaaucccggcauuu

SEQ ID NO: 1613 - RNA, 20 nt, Artificial Sequence
  source: /note="Description of Artificial Sequence: Synthetic oligonucleotide"
gccuguaaucccggcauuuu

SEQ ID NO: 1614 - RNA, 20 nt, Artificial Sequence
  source: /note="Description of Artificial Sequence: Synthetic oligonucleotide"
uguaaucccggcauuuuggg

SEQ ID NO: 1615 - RNA, 20 nt, Artificial Sequence
  source: /note="Description of Artificial Sequence: Synthetic oligonucleotide"
cccggcauuuugggaggcca

SEQ ID NO: 1616 - RNA, 20 nt, Artificial Sequence
  source: /note="Description of Artificial Sequence: Synthetic oligonucleotide"
ggcauuuugggaggccaagg

SEQ ID NO: 1617 - RNA, 20 nt, Artificial Sequence
  source: /note="Description of Artificial Sequence: Synthetic oligonucleotide"
gcauuuugggaggccaaggc

SEQ ID NO: 1618 - RNA, 20 nt, Artificial Sequence
  source: /note="Description of Artificial Sequence: Synthetic oligonucleotide"
uuuugggaggccaaggcggg

SEQ ID NO: 1619 - RNA, 20 nt, Artificial Sequence
  source: /note="Description of Artificial Sequence: Synthetic oligonucleotide"
gcaagagaucgagaucaucc

SEQ ID NO: 1620 - RNA, 20 nt, Artificial Sequence
  source: /note="Description of Artificial Sequence: Synthetic oligonucleotide"
cgagaucauccuggccaaca

SEQ ID NO: 1621 - RNA, 20 nt, Artificial Sequence
  source: /note="Description of Artificial Sequence: Synthetic oligonucleotide"
cuaaaaauacaaaaauuagc

SEQ ID NO: 1622 - RNA, 20 nt, Artificial Sequence
  source: /note="Description of Artificial Sequence: Synthetic oligonucleotide"
uaaaaauacaaaaauuagcu

SEQ ID NO: 1623 - RNA, 20 nt, Artificial Sequence
  source: /note="Description of Artificial Sequence: Synthetic oligonucleotide"
auacaaaaauuagcugggcg

SEQ ID NO: 1624 - RNA, 20 nt, Artificial Sequence
  source: /note="Description of Artificial Sequence: Synthetic oligonucleotide"
caaaaauuagcugggcgugg

SEQ ID NO: 1625 - RNA, 20 nt, Artificial Sequence
  source: /note="Description of Artificial Sequence: Synthetic oligonucleotide"
aaauuagcugggcguggugg

SEQ ID NO: 1626 - RNA, 20 nt, Artificial Sequence
  source: /note="Description of Artificial Sequence: Synthetic oligonucleotide"
aauuagcugggcgugguggc

SEQ ID NO: 1627 - RNA, 20 nt, Artificial Sequence
  source: /note="Description of Artificial Sequence: Synthetic oligonucleotide"
cgccuguaaucccagcuacu

SEQ ID NO: 1628 - RNA, 20 nt, Artificial Sequence
  source: /note="Description of Artificial Sequence: Synthetic oligonucleotide"
gccuguaaucccagcuacuu

SEQ ID NO: 1629 - RNA, 20 nt, Artificial Sequence
  source: /note="Description of Artificial Sequence: Synthetic oligonucleotide"
cccagcuacuugggagacug

SEQ ID NO: 1630 - RNA, 20 nt, Artificial Sequence
  source: /note="Description of Artificial Sequence: Synthetic oligonucleotide"
gcuacuugggagacuguggc

SEQ ID NO: 1631 - RNA, 20 nt, Artificial Sequence
  source: /note="Description of Artificial Sequence: Synthetic oligonucleotide"
gcaggagaaucgcuugaccc

SEQ ID NO: 1632 - RNA, 20 nt, Artificial Sequence
  source: /note="Description of Artificial Sequence: Synthetic oligonucleotide"
caggagaaucgcuugacccc

SEQ ID NO: 1633 - RNA, 20 nt, Artificial Sequence
  source: /note="Description of Artificial Sequence: Synthetic oligonucleotide"
gagaaucgcuugaccccggg

SEQ ID NO: 1634 - RNA, 20 nt, Artificial Sequence
  source: /note="Description of Artificial Sequence: Synthetic oligonucleotide"
aaucgcuugaccccgggagg

SEQ ID NO: 1635 - RNA, 20 nt, Artificial Sequence
  source: /note="Description of Artificial Sequence: Synthetic oligonucleotide"
cgcuugaccccgggaggcgg

SEQ ID NO: 1636 - RNA, 20 nt, Artificial Sequence
  source: /note="Description of Artificial Sequence: Synthetic oligonucleotide"
cgcgccacugcacuccagcc

SEQ ID NO: 1637 - RNA, 20 nt, Artificial Sequence
  source: /note="Description of Artificial Sequence: Synthetic oligonucleotide"
gauugacuucccaaacuaaa

SEQ ID NO: 1638 - RNA, 20 nt, Artificial Sequence
  source: /note="Description of Artificial Sequence: Synthetic oligonucleotide"
aaaacacucaagaaaacucu

SEQ ID NO: 1639 - RNA, 20 nt, Artificial Sequence
  source: /note="Description of Artificial Sequence: Synthetic oligonucleotide"
agcuuuaagucucuauauuu

SEQ ID NO: 1640 - RNA, 20 nt, Artificial Sequence
  source: /note="Description of Artificial Sequence: Synthetic oligonucleotide"
gcuuuaagucucuauauuua

SEQ ID NO: 1641 - RNA, 20 nt, Artificial Sequence
  source: /note="Description of Artificial Sequence: Synthetic oligonucleotide"
gcaaguugaaauaaaaaaaa

SEQ ID NO: 1642 - RNA, 20 nt, Artificial Sequence
  source: /note="Description of Artificial Sequence: Synthetic oligonucleotide"
aaugucuaaccacguauauu

SEQ ID NO: 1643 - RNA, 20 nt, Artificial Sequence
  source: /note="Description of Artificial Sequence: Synthetic oligonucleotide"
uauauuugguauauguauac

SEQ ID NO: 1644 - RNA, 20 nt, Artificial Sequence
  source: /note="Description of Artificial Sequence: Synthetic oligonucleotide"
uguauuagcuguaagcagac

SEQ ID NO: 1645 - RNA, 20 nt, Artificial Sequence
  source: /note="Description of Artificial Sequence: Synthetic oligonucleotide"
uucuuuuuguauugcaucua

SEQ ID NO: 1646 - RNA, 20 nt, Artificial Sequence
  source: /note="Description of Artificial Sequence: Synthetic oligonucleotide"
caucuaaggaucauuugaga

SEQ ID NO: 1647 - RNA, 20 nt, Artificial Sequence
  source: /note="Description of Artificial Sequence: Synthetic oligonucleotide"
uacacuaccuuucuaaagau

SEQ ID NO: 1648 - RNA, 20 nt, Artificial Sequence
  source: /note="Description of Artificial Sequence: Synthetic oligonucleotide"
auauguauuuuuuaaaauaa

SEQ ID NO: 1649 - RNA, 20 nt, Artificial Sequence
  source: /note="Description of Artificial Sequence: Synthetic oligonucleotide"
caagcaccaaaucuguuuuu

SEQ ID NO: 1650 - RNA, 20 nt, Artificial Sequence
  source: /note="Description of Artificial Sequence: Synthetic oligonucleotide"
aagcaccaaaucuguuuuuu

SEQ ID NO: 1651 - RNA, 20 nt, Artificial Sequence
  source: /note="Description of Artificial Sequence: Synthetic oligonucleotide"
agcaccaaaucuguuuuuug

SEQ ID NO: 1652 - RNA, 20 nt, Artificial Sequence
  source: /note="Description of Artificial Sequence: Synthetic oligonucleotide"
gcaccaaaucuguuuuuugg

SEQ ID NO: 1653 - RNA, 20 nt, Artificial Sequence
  source: /note="Description of Artificial Sequence: Synthetic oligonucleotide"
ucuguuuuuuggggguuuuu

SEQ ID NO: 1654 - RNA, 20 nt, Artificial Sequence
  source: /note="Description of Artificial Sequence: Synthetic oligonucleotide"
uuggggguuuuuugguuugu

SEQ ID NO: 1655 - RNA, 20 nt, Artificial Sequence
  source: /note="Description of Artificial Sequence: Synthetic oligonucleotide"
agagucucccucugucgccc

SEQ ID NO: 1656 - RNA, 20 nt, Artificial Sequence
  source: /note="Description of Artificial Sequence: Synthetic oligonucleotide"
ucucccucugucgcccaggc

SEQ ID NO: 1657 - RNA, 20 nt, Artificial Sequence
  source: /note="Description of Artificial Sequence: Synthetic oligonucleotide"
ucgcccaggcuggagugaag

SEQ ID NO: 1658 - RNA, 20 nt, Artificial Sequence
  source: /note="Description of Artificial Sequence: Synthetic oligonucleotide"
uggagugaagcggagcgauc

SEQ ID NO: 1659 - RNA, 20 nt, Artificial Sequence
  source: /note="Description of Artificial Sequence: Synthetic oligonucleotide"
ggagugaagcggagcgaucu

SEQ ID NO: 1660 - RNA, 20 nt, Artificial Sequence
  source: /note="Description of Artificial Sequence: Synthetic oligonucleotide"
ucaccgcaaccuccgccucc

SEQ ID NO: 1661 - RNA, 20 nt, Artificial Sequence
  source: /note="Description of Artificial Sequence: Synthetic oligonucleotide"
caccgcaaccuccgccuccu

SEQ ID NO: 1662 - RNA, 20 nt, Artificial Sequence
  source: /note="Description of Artificial Sequence: Synthetic oligonucleotide"
uuccagcaauucucugccuc

SEQ ID NO: 1663 - RNA, 20 nt, Artificial Sequence
  source: /note="Description of Artificial Sequence: Synthetic oligonucleotide"
caauucucugccucaggcuu

SEQ ID NO: 1664 - RNA, 20 nt, Artificial Sequence
  source: /note="Description of Artificial Sequence: Synthetic oligonucleotide"
gccucaggcuucggaguagc

SEQ ID NO: 1665 - RNA, 20 nt, Artificial Sequence
  source: /note="Description of Artificial Sequence: Synthetic oligonucleotide"
ccucaggcuucggaguagcu

SEQ ID NO: 1666 - RNA, 20 nt, Artificial Sequence
  source: /note="Description of Artificial Sequence: Synthetic oligonucleotide"
uucggaguagcugggauuac

SEQ ID NO: 1667 - RNA, 20 nt, Artificial Sequence
  source: /note="Description of Artificial Sequence: Synthetic oligonucleotide"
caggcacucgccaccacgcc

SEQ ID NO: 1668 - RNA, 20 nt, Artificial Sequence
  source: /note="Description of Artificial Sequence: Synthetic oligonucleotide"
aauuuuuguauuuuuaguag

SEQ ID NO: 1669 - RNA, 20 nt, Artificial Sequence
  source: /note="Description of Artificial Sequence: Synthetic oligonucleotide"
uuuuguauuuuuaguagagg

SEQ ID NO: 1670 - RNA, 20 nt, Artificial Sequence
  source: /note="Description of Artificial Sequence: Synthetic oligonucleotide"
uuuguauuuuuaguagaggc

SEQ ID NO: 1671 - RNA, 20 nt, Artificial Sequence
  source: /note="Description of Artificial Sequence: Synthetic oligonucleotide"
uuguauuuuuaguagaggcg

SEQ ID NO: 1672 - RNA, 20 nt, Artificial Sequence
  source: /note="Description of Artificial Sequence: Synthetic oligonucleotide"
gaggcgggguuuuaccaucu

SEQ ID NO: 1673 - RNA, 20 nt, Artificial Sequence
  source: /note="Description of Artificial Sequence: Synthetic oligonucleotide"
gggguuuuaccaucuugguc

SEQ ID NO: 1674 - RNA, 20 nt, Artificial Sequence
  source: /note="Description of Artificial Sequence: Synthetic oligonucleotide"
uuuuaccaucuuggucaggc

SEQ ID NO: 1675 - RNA, 20 nt, Artificial Sequence
  source: /note="Description of Artificial Sequence: Synthetic oligonucleotide"
cugguuuugaacuccugacc

SEQ ID NO: 1676 - RNA, 20 nt, Artificial Sequence
  source: /note="Description of Artificial Sequence: Synthetic oligonucleotide"
gccucagccucccaaagugc

SEQ ID NO: 1677 - RNA, 20 nt, Artificial Sequence
  source: /note="Description of Artificial Sequence: Synthetic oligonucleotide"
ccucagccucccaaagugcu

SEQ ID NO: 1678 - RNA, 20 nt, Artificial Sequence
  source: /note="Description of Artificial Sequence: Synthetic oligonucleotide"
ucccaaagugcugggauuac

SEQ ID NO: 1679 - RNA, 20 nt, Artificial Sequence
  source: /note="Description of Artificial Sequence: Synthetic oligonucleotide"
guuuuucuuuaaguaauacu

SEQ ID NO: 1680 - RNA, 20 nt, Artificial Sequence
  source: /note="Description of Artificial Sequence: Synthetic oligonucleotide"
guauaagagaacuuuauauc

SEQ ID NO: 1681 - RNA, 20 nt, Artificial Sequence
  source: /note="Description of Artificial Sequence: Synthetic oligonucleotide"
uuauucacauauagaaacuc

SEQ ID NO: 1682 - RNA, 20 nt, Artificial Sequence
  source: /note="Description of Artificial Sequence: Synthetic oligonucleotide"
cuaaagcuguucucauuuag

SEQ ID NO: 1683 - RNA, 20 nt, Artificial Sequence
  source: /note="Description of Artificial Sequence: Synthetic oligonucleotide"
uuaacuaacaauaaaaucua

SEQ ID NO: 1684 - RNA, 20 nt, Artificial Sequence
  source: /note="Description of Artificial Sequence: Synthetic oligonucleotide"
gcagagcaaaagcagccuuc

SEQ ID NO: 1685 - RNA, 20 nt, Artificial Sequence
  source: /note="Description of Artificial Sequence: Synthetic oligonucleotide"
aauuaagaugcgaugagagu

SEQ ID NO: 1686 - RNA, 20 nt, Artificial Sequence
  source: /note="Description of Artificial Sequence: Synthetic oligonucleotide"
ucuacuugcuuuuuuagugu

SEQ ID NO: 1687 - RNA, 20 nt, Artificial Sequence
  source: /note="Description of Artificial Sequence: Synthetic oligonucleotide"
guauuucucucaauuauccu

SEQ ID NO: 1688 - RNA, 20 nt, Artificial Sequence
  source: /note="Description of Artificial Sequence: Synthetic oligonucleotide"
cggccuaaauaguaaaagcu

SEQ ID NO: 1689 - RNA, 20 nt, Artificial Sequence
  source: /note="Description of Artificial Sequence: Synthetic oligonucleotide"
ggccuaaauaguaaaagcuu

SEQ ID NO: 1690 - RNA, 20 nt, Artificial Sequence
  source: /note="Description of Artificial Sequence: Synthetic oligonucleotide"
uuaauauuuucccucuuucu

SEQ ID NO: 1691 - RNA, 20 nt, Artificial Sequence
  source: /note="Description of Artificial Sequence: Synthetic oligonucleotide"
guuucacaguaaaucauaua

SEQ ID NO: 1692 - RNA, 20 nt, Artificial Sequence
  source: /note="Description of Artificial Sequence: Synthetic oligonucleotide"
aagugcucagaauuugauua

SEQ ID NO: 1693 - RNA, 20 nt, Artificial Sequence
  source: /note="Description of Artificial Sequence: Synthetic oligonucleotide"
aaguuaauuucuacuaaaaa

SEQ ID NO: 1694 - RNA, 20 nt, Artificial Sequence
  source: /note="Description of Artificial Sequence: Synthetic oligonucleotide"
aguuaauuucuacuaaaaaa

SEQ ID NO: 1695 - RNA, 20 nt, Artificial Sequence
  source: /note="Description of Artificial Sequence: Synthetic oligonucleotide"
auucaaauagaacuuucauu

SEQ ID NO: 1696 - RNA, 20 nt, Artificial Sequence
  source: /note="Description of Artificial Sequence: Synthetic oligonucleotide"
uguacuguaguuucacuuga

SEQ ID NO: 1697 - RNA, 20 nt, Artificial Sequence
  source: /note="Description of Artificial Sequence: Synthetic oligonucleotide"
guacuguaguuucacuugaa

SEQ ID NO: 1698 - RNA, 20 nt, Artificial Sequence
  source: /note="Description of Artificial Sequence: Synthetic oligonucleotide"
uacuguaguuucacuugaag

SEQ ID NO: 1699 - RNA, 20 nt, Artificial Sequence
  source: /note="Description of Artificial Sequence: Synthetic oligonucleotide"
cauugacuuauucaaugcau

SEQ ID NO: 1700 - RNA, 20 nt, Artificial Sequence
  source: /note="Description of Artificial Sequence: Synthetic oligonucleotide"
uguauuauaaaauaucagaa

SEQ ID NO: 1701 - RNA, 20 nt, Artificial Sequence
  source: /note="Description of Artificial Sequence: Synthetic oligonucleotide"
auugaaucugaugcauacca

SEQ ID NO: 1702 - RNA, 20 nt, Artificial Sequence
  source: /note="Description of Artificial Sequence: Synthetic oligonucleotide"
augcauaccaaggagcaaug

SEQ ID NO: 1703 - RNA, 20 nt, Artificial Sequence
  source: /note="Description of Artificial Sequence: Synthetic oligonucleotide"
aggagcaauguggaaauuuu

SEQ ID NO: 1704 - RNA, 20 nt, Artificial Sequence
  source: /note="Description of Artificial Sequence: Synthetic oligonucleotide"
uacuacuaaguguguguaug

SEQ ID NO: 1705 - RNA, 20 nt, Artificial Sequence
  source: /note="Description of Artificial Sequence: Synthetic oligonucleotide"
uauuuaagcugaauccucuu

SEQ ID NO: 1706 - RNA, 20 nt, Artificial Sequence
  source: /note="Description of Artificial Sequence: Synthetic oligonucleotide"
ugaauccucuuugguagaaa

SEQ ID NO: 1707 - RNA, 20 nt, Artificial Sequence
  source: /note="Description of Artificial Sequence: Synthetic oligonucleotide"
uugaaagugcacagaauccu

SEQ ID NO: 1708 - RNA, 20 nt, Artificial Sequence
  source: /note="Description of Artificial Sequence: Synthetic oligonucleotide"
ugaaagugcacagaauccuu

SEQ ID NO: 1709 - RNA, 20 nt, Artificial Sequence
  source: /note="Description of Artificial Sequence: Synthetic oligonucleotide"
gaaagugcacagaauccuug

SEQ ID NO: 1710 - RNA, 20 nt, Artificial Sequence
  source: /note="Description of Artificial Sequence: Synthetic oligonucleotide"
uuguauaaacuguuuuuaua

SEQ ID NO: 1711 - RNA, 20 nt, Artificial Sequence
  source: /note="Description of Artificial Sequence: Synthetic oligonucleotide"
guuccuguagaagacagcug

SEQ ID NO: 1712 - RNA, 20 nt, Artificial Sequence
  source: /note="Description of Artificial Sequence: Synthetic oligonucleotide"
cacaaaacaaacagcuugcu

SEQ ID NO: 1713 - RNA, 20 nt, Artificial Sequence
  source: /note="Description of Artificial Sequence: Synthetic oligonucleotide"
gugaugauaacauucgugca

SEQ ID NO: 1714 - RNA, 20 nt, Artificial Sequence
  source: /note="Description of Artificial Sequence: Synthetic oligonucleotide"
ugaugauaacauucgugcaa

SEQ ID NO: 1715 - RNA, 20 nt, Artificial Sequence
  source: /note="Description of Artificial Sequence: Synthetic oligonucleotide"
aagggaguucucucuugcau

SEQ ID NO: 1716 - RNA, 20 nt, Artificial Sequence
  source: /note="Description of Artificial Sequence: Synthetic oligonucleotide"
cucucuugcauaggaguccc

SEQ ID NO: 1717 - RNA, 20 nt, Artificial Sequence
  source: /note="Description of Artificial Sequence: Synthetic oligonucleotide"
uacccuaaugccuucccaca

SEQ ID NO: 1718 - RNA, 20 nt, Artificial Sequence
  source: /note="Description of Artificial Sequence: Synthetic oligonucleotide"
uucccacauggucaaacaca

SEQ ID NO: 1719 - RNA, 20 nt, Artificial Sequence
  source: /note="Description of Artificial Sequence: Synthetic oligonucleotide"
agccugcaguuguuuaucag

SEQ ID NO: 1720 - RNA, 20 nt, Artificial Sequence
  source: /note="Description of Artificial Sequence: Synthetic oligonucleotide"
gccugcaguuguuuaucagu

SEQ ID NO: 1721 - RNA, 20 nt, Artificial Sequence
  source: /note="Description of Artificial Sequence: Synthetic oligonucleotide"
guuguuuaucagugggauac

SEQ ID NO: 1722 - RNA, 20 nt, Artificial Sequence
  source: /note="Description of Artificial Sequence: Synthetic oligonucleotide"
uuguuuaucagugggauaca

SEQ ID NO: 1723 - RNA, 20 nt, Artificial Sequence
  source: /note="Description of Artificial Sequence: Synthetic oligonucleotide"
ugggauacagggagaaagag

SEQ ID NO: 1724 - RNA, 20 nt, Artificial Sequence
  source: /note="Description of Artificial Sequence: Synthetic oligonucleotide"
uuacuaacuguuuaaugacc

SEQ ID NO: 1725 - RNA, 20 nt, Artificial Sequence
  source: /note="Description of Artificial Sequence: Synthetic oligonucleotide"
gauacagaauaagaaagcac

SEQ ID NO: 1726 - RNA, 20 nt, Artificial Sequence
  source: /note="Description of Artificial Sequence: Synthetic oligonucleotide"
gaaagcacuggccugacugc

SEQ ID NO: 1727 - RNA, 20 nt, Artificial Sequence
  source: /note="Description of Artificial Sequence: Synthetic oligonucleotide"
aaagcacuggccugacugca

SEQ ID NO: 1728 - RNA, 20 nt, Artificial Sequence
  source: /note="Description of Artificial Sequence: Synthetic oligonucleotide"
aagcacuggccugacugcag

SEQ ID NO: 1729 - RNA, 20 nt, Artificial Sequence
  source: /note="Description of Artificial Sequence: Synthetic oligonucleotide"
gccugacugcaggggaaaca

SEQ ID NO: 1730 - RNA, 20 nt, Artificial Sequence
  source: /note="Description of Artificial Sequence: Synthetic oligonucleotide"
gaaacaugguagaugccuaa

SEQ ID NO: 1731 - RNA, 20 nt, Artificial Sequence
  source: /note="Description of Artificial Sequence: Synthetic oligonucleotide"
acaugguagaugccuaaagg

SEQ ID NO: 1732 - RNA, 20 nt, Artificial Sequence
  source: /note="Description of Artificial Sequence: Synthetic oligonucleotide"
aacuaucauuaucaccugaa

SEQ ID NO: 1733 - RNA, 20 nt, Artificial Sequence
  source: /note="Description of Artificial Sequence: Synthetic oligonucleotide"
uuuaacccugacaagcaagu

SEQ ID NO: 1734 - RNA, 20 nt, Artificial Sequence
  source: /note="Description of Artificial Sequence: Synthetic oligonucleotide"
cuuuaguauucaagaacuga

SEQ ID NO: 1735 - RNA, 20 nt, Artificial Sequence
  source: /note="Description of Artificial Sequence: Synthetic oligonucleotide"
acugaaggugacaagcccug

SEQ ID NO: 1736 - RNA, 20 nt, Artificial Sequence
  source: /note="Description of Artificial Sequence: Synthetic oligonucleotide"
caugccuucauagaaacagu

SEQ ID NO: 1737 - RNA, 20 nt, Artificial Sequence
  source: /note="Description of Artificial Sequence: Synthetic oligonucleotide"
gaacuauuuugcuuaacauu

SEQ ID NO: 1738 - RNA, 20 nt, Artificial Sequence
  source: /note="Description of Artificial Sequence: Synthetic oligonucleotide"
agccuauaucugcaauaaua

SEQ ID NO: 1739 - RNA, 20 nt, Artificial Sequence
  source: /note="Description of Artificial Sequence: Synthetic oligonucleotide"
gccuauaucugcaauaauac

SEQ ID NO: 1740 - RNA, 20 nt, Artificial Sequence
  source: /note="Description of Artificial Sequence: Synthetic oligonucleotide"
ccuauaucugcaauaauacg

SEQ ID NO: 1741 - RNA, 20 nt, Artificial Sequence
  source: /note="Description of Artificial Sequence: Synthetic oligonucleotide"
uaaugauaaagagaaagaaa

SEQ ID NO: 1742 - RNA, 20 nt, Artificial Sequence
  source: /note="Description of Artificial Sequence: Synthetic oligonucleotide"
gaaaaggugagaaguaauuu

SEQ ID NO: 1743 - RNA, 20 nt, Artificial Sequence
  source: /note="Description of Artificial Sequence: Synthetic oligonucleotide"
aaaaggugagaaguaauuuu

SEQ ID NO: 1744 - RNA, 20 nt, Artificial Sequence
  source: /note="Description of Artificial Sequence: Synthetic oligonucleotide"
aauaugcaaugauaaacuag

SEQ ID NO: 1745 - RNA, 20 nt, Artificial Sequence
  source: /note="Description of Artificial Sequence: Synthetic oligonucleotide"
accagcagcugugcuuagca

SEQ ID NO: 1746 - RNA, 20 nt, Artificial Sequence
  source: /note="Description of Artificial Sequence: Synthetic oligonucleotide"
agcauggauaauugccuaaa

SEQ ID NO: 1747 - RNA, 20 nt, Artificial Sequence
  source: /note="Description of Artificial Sequence: Synthetic oligonucleotide"
gagaaaaaaaaguaaaaauc

SEQ ID NO: 1748 - RNA, 20 nt, Artificial Sequence
  source: /note="Description of Artificial Sequence: Synthetic oligonucleotide"
gcuuauaagacauugccacc

SEQ ID NO: 1749 - RNA, 20 nt, Artificial Sequence
  source: /note="Description of Artificial Sequence: Synthetic oligonucleotide"
uauuuucaaacauagaauca

SEQ ID NO: 1750 - RNA, 20 nt, Artificial Sequence
  source: /note="Description of Artificial Sequence: Synthetic oligonucleotide"
auggauugcuacaagcugaa

SEQ ID NO: 1751 - RNA, 20 nt, Artificial Sequence
  source: /note="Description of Artificial Sequence: Synthetic oligonucleotide"
ugcauuuacagaugagaaaa

SEQ ID NO: 1752 - RNA, 20 nt, Artificial Sequence
  source: /note="Description of Artificial Sequence: Synthetic oligonucleotide"
auuuacagaugagaaaaugg

SEQ ID NO: 1753 - RNA, 20 nt, Artificial Sequence
  source: /note="Description of Artificial Sequence: Synthetic oligonucleotide"
cagaugagaaaauggaggca

SEQ ID NO: 1754 - RNA, 20 nt, Artificial Sequence
  source: /note="Description of Artificial Sequence: Synthetic oligonucleotide"
agaugagaaaauggaggcau

SEQ ID NO: 1755 - RNA, 20 nt, Artificial Sequence
  source: /note="Description of Artificial Sequence: Synthetic oligonucleotide"
uauugauuaaguucuuaugu

SEQ ID NO: 1756 - RNA, 20 nt, Artificial Sequence
  source: /note="Description of Artificial Sequence: Synthetic oligonucleotide"
auugauuaaguucuuauguu

SEQ ID NO: 1757 - RNA, 20 nt, Artificial Sequence
  source: /note="Description of Artificial Sequence: Synthetic oligonucleotide"
uaugucaucuauauuuuugu

SEQ ID NO: 1758 - RNA, 20 nt, Artificial Sequence
  source: /note="Description of Artificial Sequence: Synthetic oligonucleotide"
uuacucuccucacuuuacua

SEQ ID NO: 1759 - RNA, 20 nt, Artificial Sequence
  source: /note="Description of Artificial Sequence: Synthetic oligonucleotide"
cuaaggaagaaaccaagaca

SEQ ID NO: 1760 - RNA, 20 nt, Artificial Sequence
  source: /note="Description of Artificial Sequence: Synthetic oligonucleotide"
uaaggaagaaaccaagacau

SEQ ID NO: 1761 - RNA, 20 nt, Artificial Sequence
  source: /note="Description of Artificial Sequence: Synthetic oligonucleotide"
aaggaagaaaccaagacaug

SEQ ID NO: 1762 - RNA, 20 nt, Artificial Sequence
  source: /note="Description of Artificial Sequence: Synthetic oligonucleotide"
uauaaauuuugaauuaucuu

SEQ ID NO: 1763 - RNA, 20 nt, Artificial Sequence
  source: /note="Description of Artificial Sequence: Synthetic oligonucleotide"
uaaaucaacucuuaaacagu

SEQ ID NO: 1764 - RNA, 20 nt, Artificial Sequence
  source: /note="Description of Artificial Sequence: Synthetic oligonucleotide"
uuggaugccaacaagcaguc

SEQ ID NO: 1765 - RNA, 20 nt, Artificial Sequence
  source: /note="Description of Artificial Sequence: Synthetic oligonucleotide"
ccaacaagcagucugguguu

SEQ ID NO: 1766 - RNA, 20 nt, Artificial Sequence
  source: /note="Description of Artificial Sequence: Synthetic oligonucleotide"
uguguguuccagcuuuguug

SEQ ID NO: 1767 - RNA, 20 nt, Artificial Sequence
  source: /note="Description of Artificial Sequence: Synthetic oligonucleotide"
gugaagugauuauuacuauc

SEQ ID NO: 1768 - RNA, 20 nt, Artificial Sequence
  source: /note="Description of Artificial Sequence: Synthetic oligonucleotide"
ucagucauuuuuuguguuua

SEQ ID NO: 1769 - RNA, 20 nt, Artificial Sequence
  source: /note="Description of Artificial Sequence: Synthetic oligonucleotide"
gagcuacucaaauguaguca

SEQ ID NO: 1770 - RNA, 20 nt, Artificial Sequence
  source: /note="Description of Artificial Sequence: Synthetic oligonucleotide"
gaauguauuaaauauucauc

SEQ ID NO: 1771 - RNA, 20 nt, Artificial Sequence
  source: /note="Description of Artificial Sequence: Synthetic oligonucleotide"
uuccccuacuacccagccca

SEQ ID NO: 1772 - RNA, 20 nt, Artificial Sequence
  source: /note="Description of Artificial Sequence: Synthetic oligonucleotide"
uauaagugagaucaugcaau

SEQ ID NO: 1773 - RNA, 20 nt, Artificial Sequence
  source: /note="Description of Artificial Sequence: Synthetic oligonucleotide"
uagcuguguaugucauauuc

SEQ ID NO: 1774 - RNA, 20 nt, Artificial Sequence
  source: /note="Description of Artificial Sequence: Synthetic oligonucleotide"
aacuaauaauucuuaucuca

SEQ ID NO: 1775 - RNA, 20 nt, Artificial Sequence
  source: /note="Description of Artificial Sequence: Synthetic oligonucleotide"
uuaucucauggauuacugag

SEQ ID NO: 1776 - RNA, 20 nt, Artificial Sequence
  source: /note="Description of Artificial Sequence: Synthetic oligonucleotide"
aaaacauccagcauguuacu

SEQ ID NO: 1777 - RNA, 20 nt, Artificial Sequence
  source: /note="Description of Artificial Sequence: Synthetic oligonucleotide"
guguugagcaucuauguauc

SEQ ID NO: 1778 - RNA, 20 nt, Artificial Sequence
  source: /note="Description of Artificial Sequence: Synthetic oligonucleotide"
agccaucaucuuuacccuuc

SEQ ID NO: 1779 - RNA, 20 nt, Artificial Sequence
  source: /note="Description of Artificial Sequence: Synthetic oligonucleotide"
uuuacccuucuggaauauac

SEQ ID NO: 1780 - RNA, 20 nt, Artificial Sequence
  source: /note="Description of Artificial Sequence: Synthetic oligonucleotide"
ucuggaauauacaggcucau

SEQ ID NO: 1781 - RNA, 20 nt, Artificial Sequence
  source: /note="Description of Artificial Sequence: Synthetic oligonucleotide"
cauaaugagaugaaaauuau

SEQ ID NO: 1782 - RNA, 20 nt, Artificial Sequence
  source: /note="Description of Artificial Sequence: Synthetic oligonucleotide"
aaauuauaggacucauagac

SEQ ID NO: 1783 - RNA, 20 nt, Artificial Sequence
  source: /note="Description of Artificial Sequence: Synthetic oligonucleotide"
acucauagacuggucaguug

SEQ ID NO: 1784 - RNA, 20 nt, Artificial Sequence
  source: /note="Description of Artificial Sequence: Synthetic oligonucleotide"
ggucaguugaggaauuuccc

SEQ ID NO: 1785 - RNA, 20 nt, Artificial Sequence
  source: /note="Description of Artificial Sequence: Synthetic oligonucleotide"
gcuuccagccucugcucaaa

SEQ ID NO: 1786 - RNA, 20 nt, Artificial Sequence
  source: /note="Description of Artificial Sequence: Synthetic oligonucleotide"
gaauucccaguugccugaau

SEQ ID NO: 1787 - RNA, 20 nt, Artificial Sequence
  source: /note="Description of Artificial Sequence: Synthetic oligonucleotide"
gccugaauaggcgccagagu

SEQ ID NO: 1788 - RNA, 20 nt, Artificial Sequence
  source: /note="Description of Artificial Sequence: Synthetic oligonucleotide"
uggcauagcuuucucaguau

SEQ ID NO: 1789 - RNA, 20 nt, Artificial Sequence
  source: /note="Description of Artificial Sequence: Synthetic oligonucleotide"
ggcauagcuuucucaguauu

SEQ ID NO: 1790 - RNA, 20 nt, Artificial Sequence
  source: /note="Description of Artificial Sequence: Synthetic oligonucleotide"
ucucaguauugggaccugac

SEQ ID NO: 1791 - RNA, 20 nt, Artificial Sequence
  source: /note="Description of Artificial Sequence: Synthetic oligonucleotide"
cucaguauugggaccugaca

SEQ ID NO: 1792 - RNA, 20 nt, Artificial Sequence
  source: /note="Description of Artificial Sequence: Synthetic oligonucleotide"
acagcacagccucugaagau

SEQ ID NO: 1793 - RNA, 20 nt, Artificial Sequence
  source: /note="Description of Artificial Sequence: Synthetic oligonucleotide"
agccucugaagauuggcuca

SEQ ID NO: 1794 - RNA, 20 nt, Artificial Sequence
  source: /note="Description of Artificial Sequence: Synthetic oligonucleotide"
gccucugaagauuggcucaa

SEQ ID NO: 1795 - RNA, 20 nt, Artificial Sequence
  source: /note="Description of Artificial Sequence: Synthetic oligonucleotide"
ccucugaagauuggcucaag

SEQ ID NO: 1796 - RNA, 20 nt, Artificial Sequence
  source: /note="Description of Artificial Sequence: Synthetic oligonucleotide"
cucugaagauuggcucaagg

SEQ ID NO: 1797 - RNA, 20 nt, Artificial Sequence
  source: /note="Description of Artificial Sequence: Synthetic oligonucleotide"
gcucaagggggaagagauga

SEQ ID NO: 1798 - RNA, 20 nt, Artificial Sequence
  source: /note="Description of Artificial Sequence: Synthetic oligonucleotide"
uagaaauauuaaaugauagc

SEQ ID NO: 1799 - RNA, 20 nt, Artificial Sequence
  source: /note="Description of Artificial Sequence: Synthetic oligonucleotide"
gcaugauuuaaaaaguacua

SEQ ID NO: 1800 - RNA, 20 nt, Artificial Sequence
  source: /note="Description of Artificial Sequence: Synthetic oligonucleotide"
cuauuuuguaucauauuuuc

SEQ ID NO: 1801 - RNA, 20 nt, Artificial Sequence
  source: /note="Description of Artificial Sequence: Synthetic oligonucleotide"
aggaagaagagacaacauuu

SEQ ID NO: 1802 - RNA, 20 nt, Artificial Sequence
  source: /note="Description of Artificial Sequence: Synthetic oligonucleotide"
gcuuaaagauagaugauagc

SEQ ID NO: 1803 - RNA, 20 nt, Artificial Sequence
  source: /note="Description of Artificial Sequence: Synthetic oligonucleotide"
cuuaaagauagaugauagcc

SEQ ID NO: 1804 - RNA, 20 nt, Artificial Sequence
  source: /note="Description of Artificial Sequence: Synthetic oligonucleotide"
agauagaugauagccgggug

SEQ ID NO: 1805 - RNA, 20 nt, Artificial Sequence
  source: /note="Description of Artificial Sequence: Synthetic oligonucleotide"
uagaugauagccgggugugg

SEQ ID NO: 1806 - RNA, 20 nt, Artificial Sequence
  source: /note="Description of Artificial Sequence: Synthetic oligonucleotide"
gaccuguaauuccagcacuu

SEQ ID NO: 1807 - RNA, 20 nt, Artificial Sequence
  source: /note="Description of Artificial Sequence: Synthetic oligonucleotide"
accuguaauuccagcacuuu

SEQ ID NO: 1808 - RNA, 20 nt, Artificial Sequence
  source: /note="Description of Artificial Sequence: Synthetic oligonucleotide"
uguaauuccagcacuuuggg

SEQ ID NO: 1809 - RNA, 20 nt, Artificial Sequence
  source: /note="Description of Artificial Sequence: Synthetic oligonucleotide"
uccagcacuuugggaggccg

SEQ ID NO: 1810 - RNA, 20 nt, Artificial Sequence
  source: /note="Description of Artificial Sequence: Synthetic oligonucleotide"
agcacuuugggaggccgagg

SEQ ID NO: 1811 - RNA, 20 nt, Artificial Sequence
  source: /note="Description of Artificial Sequence: Synthetic oligonucleotide"
gcacuuugggaggccgaggc

SEQ ID NO: 1812 - RNA, 20 nt, Artificial Sequence
  source: /note="Description of Artificial Sequence: Synthetic oligonucleotide"
cgaggcgggcagaucaccug

SEQ ID NO: 1813 - RNA, 20 nt, Artificial Sequence
  source: /note="Description of Artificial Sequence: Synthetic oligonucleotide"
cgggcagaucaccugagguc

SEQ ID NO: 1814 - RNA, 20 nt, Artificial Sequence
  source: /note="Description of Artificial Sequence: Synthetic oligonucleotide"
ucaggaguuugaaaccaacc

SEQ ID NO: 1815 - RNA, 20 nt, Artificial Sequence
  source: /note="Description of Artificial Sequence: Synthetic oligonucleotide"
aaaaaauacaaaaauuagcc

SEQ ID NO: 1816 - RNA, 20 nt, Artificial Sequence
  source: /note="Description of Artificial Sequence: Synthetic oligonucleotide"
auacaaaaauuagccaggcg

SEQ ID NO: 1817 - RNA, 20 nt, Artificial Sequence
  source: /note="Description of Artificial Sequence: Synthetic oligonucleotide"
caaaaauuagccaggcgugg

SEQ ID NO: 1818 - RNA, 20 nt, Artificial Sequence
  source: /note="Description of Artificial Sequence: Synthetic oligonucleotide"
aaauuagccaggcguggugg

SEQ ID NO: 1819 - RNA, 20 nt, Artificial Sequence
  source: /note="Description of Artificial Sequence: Synthetic oligonucleotide"
aauuagccaggcgugguggu

SEQ ID NO: 1820 - RNA, 20 nt, Artificial Sequence
  source: /note="Description of Artificial Sequence: Synthetic oligonucleotide"
gccuguaauuccagccacuc

SEQ ID NO: 1821 - RNA, 20 nt, Artificial Sequence
  source: /note="Description of Artificial Sequence: Synthetic oligonucleotide"
uccagccacucaggagacug

SEQ ID NO: 1822 - RNA, 20 nt, Artificial Sequence
  source: /note="Description of Artificial Sequence: Synthetic oligonucleotide"
cacgagaaucacuugaaccc

SEQ ID NO: 1823 - RNA, 20 nt, Artificial Sequence
  source: /note="Description of Artificial Sequence: Synthetic oligonucleotide"
gagaaucacuugaacccagg

SEQ ID NO: 1824 - RNA, 20 nt, Artificial Sequence
  source: /note="Description of Artificial Sequence: Synthetic oligonucleotide"
cacuugaacccaggaggcag

SEQ ID NO: 1825 - RNA, 20 nt, Artificial Sequence
  source: /note="Description of Artificial Sequence: Synthetic oligonucleotide"
cgugccauugcacuccagcc

SEQ ID NO: 1826 - RNA, 20 nt, Artificial Sequence
  source: /note="Description of Artificial Sequence: Synthetic oligonucleotide"
gugccauugcacuccagccu

SEQ ID NO: 1827 - RNA, 20 nt, Artificial Sequence
  source: /note="Description of Artificial Sequence: Synthetic oligonucleotide"
cacuccagccugggugacag

SEQ ID NO: 1828 - RNA, 20 nt, Artificial Sequence
  source: /note="Description of Artificial Sequence: Synthetic oligonucleotide"
acuccagccugggugacaga

SEQ ID NO: 1829 - RNA, 20 nt, Artificial Sequence
  source: /note="Description of Artificial Sequence: Synthetic oligonucleotide"
aaaauaaaaaauaauugucu

SEQ ID NO: 1830 - RNA, 20 nt, Artificial Sequence
  source: /note="Description of Artificial Sequence: Synthetic oligonucleotide"
auugucuuggugugcuaauc

SEQ ID NO: 1831 - RNA, 20 nt, Artificial Sequence
  source: /note="Description of Artificial Sequence: Synthetic oligonucleotide"
ucaggagcuuccugugagag

SEQ ID NO: 1832 - RNA, 20 nt, Artificial Sequence
  source: /note="Description of Artificial Sequence: Synthetic oligonucleotide"
gagaguggaaauuccuuaca

SEQ ID NO: 1833 - RNA, 20 nt, Artificial Sequence
  source: /note="Description of Artificial Sequence: Synthetic oligonucleotide"
uggcagugucaugaaauuuu

SEQ ID NO: 1834 - RNA, 20 nt, Artificial Sequence
  source: /note="Description of Artificial Sequence: Synthetic oligonucleotide"
gagugucucaaaauaguuaa

SEQ ID NO: 1835 - RNA, 20 nt, Artificial Sequence
  source: /note="Description of Artificial Sequence: Synthetic oligonucleotide"
uugaaguuucuuugagaacu

SEQ ID NO: 1836 - RNA, 20 nt, Artificial Sequence
  source: /note="Description of Artificial Sequence: Synthetic oligonucleotide"
gauuauugccauguauaagu

SEQ ID NO: 1837 - RNA, 20 nt, Artificial Sequence
  source: /note="Description of Artificial Sequence: Synthetic oligonucleotide"
auuauugccauguauaaguu

SEQ ID NO: 1838 - RNA, 20 nt, Artificial Sequence
  source: /note="Description of Artificial Sequence: Synthetic oligonucleotide"
accuuucuaagucugcauuu

SEQ ID NO: 1839 - RNA, 20 nt, Artificial Sequence
  source: /note="Description of Artificial Sequence: Synthetic oligonucleotide"
ccuuucuaagucugcauuua

SEQ ID NO: 1840 - RNA, 20 nt, Artificial Sequence
  source: /note="Description of Artificial Sequence: Synthetic oligonucleotide"
cacaaaaugaaauguuugau

SEQ ID NO: 1841 - RNA, 20 nt, Artificial Sequence
  source: /note="Description of Artificial Sequence: Synthetic oligonucleotide"
agugacuuuucaaaauguau

SEQ ID NO: 1842 - RNA, 20 nt, Artificial Sequence
  source: /note="Description of Artificial Sequence: Synthetic oligonucleotide"
uuucaaaauguauaggagca

SEQ ID NO: 1843 - RNA, 20 nt, Artificial Sequence
  source: /note="Description of Artificial Sequence: Synthetic oligonucleotide"
aauuuauaauauuuauauuc

SEQ ID NO: 1844 - RNA, 20 nt, Artificial Sequence
  source: /note="Description of Artificial Sequence: Synthetic oligonucleotide"
cacuguaacaccuagcagua

SEQ ID NO: 1845 - RNA, 20 nt, Artificial Sequence
  source: /note="Description of Artificial Sequence: Synthetic oligonucleotide"
uaugguugaacauguagaaa

SEQ ID NO: 1846 - RNA, 20 nt, Artificial Sequence
  source: /note="Description of Artificial Sequence: Synthetic oligonucleotide"
cuaaaauuuagcuuguucua

SEQ ID NO: 1847 - RNA, 20 nt, Artificial Sequence
  source: /note="Description of Artificial Sequence: Synthetic oligonucleotide"
aggaugcuacuuuaagcauu

SEQ ID NO: 1848 - RNA, 20 nt, Artificial Sequence
  source: /note="Description of Artificial Sequence: Synthetic oligonucleotide"
ggaugcuacuuuaagcauua

SEQ ID NO: 1849 - RNA, 20 nt, Artificial Sequence
  source: /note="Description of Artificial Sequence: Synthetic oligonucleotide"
cuuuaagcauuaggguaaaa

SEQ ID NO: 1850 - RNA, 20 nt, Artificial Sequence
  source: /note="Description of Artificial Sequence: Synthetic oligonucleotide"
auuuuuguuucuuucacauu

SEQ ID NO: 1851 - RNA, 20 nt, Artificial Sequence
  source: /note="Description of Artificial Sequence: Synthetic oligonucleotide"
guuucuucucauuuuucucc

SEQ ID NO: 1852 - RNA, 20 nt, Artificial Sequence
  source: /note="Description of Artificial Sequence: Synthetic oligonucleotide"
aaaaaaaaagaaaaaaaaac

SEQ ID NO: 1853 - RNA, 20 nt, Artificial Sequence
  source: /note="Description of Artificial Sequence: Synthetic oligonucleotide"
aaaaaaaagaaaaaaaaaca

SEQ ID NO: 1854 - RNA, 20 nt, Artificial Sequence
  source: /note="Description of Artificial Sequence: Synthetic oligonucleotide"
aaaaaaagaaaaaaaaacag

SEQ ID NO: 1855 - RNA, 20 nt, Artificial Sequence
  source: /note="Description of Artificial Sequence: Synthetic oligonucleotide"
aguaauuuucucucagagcu

SEQ ID NO: 1856 - RNA, 20 nt, Artificial Sequence
  source: /note="Description of Artificial Sequence: Synthetic oligonucleotide"
guaauuuucucucagagcuu

SEQ ID NO: 1857 - RNA, 20 nt, Artificial Sequence
  source: /note="Description of Artificial Sequence: Synthetic oligonucleotide"
ucucagagcuugggaaacau

SEQ ID NO: 1858 - RNA, 20 nt, Artificial Sequence
  source: /note="Description of Artificial Sequence: Synthetic oligonucleotide"
uacguuguuacccuucaucu

SEQ ID NO: 1859 - RNA, 20 nt, Artificial Sequence
  source: /note="Description of Artificial Sequence: Synthetic oligonucleotide"
ucccuauucauauguuuauu

SEQ ID NO: 1860 - RNA, 20 nt, Artificial Sequence
  source: /note="Description of Artificial Sequence: Synthetic oligonucleotide"
uucugaaauuccuccagaua

SEQ ID NO: 1861 - RNA, 20 nt, Artificial Sequence
  source: /note="Description of Artificial Sequence: Synthetic oligonucleotide"
cuugaugauucuguacaauc

SEQ ID NO: 1862 - RNA, 20 nt, Artificial Sequence
  source: /note="Description of Artificial Sequence: Synthetic oligonucleotide"
aacugccuuuauuuagcuua

SEQ ID NO: 1863 - RNA, 20 nt, Artificial Sequence
  source: /note="Description of Artificial Sequence: Synthetic oligonucleotide"
cuuuaugaaacucauguuaa

SEQ ID NO: 1864 - RNA, 20 nt, Artificial Sequence
  source: /note="Description of Artificial Sequence: Synthetic oligonucleotide"
cucugauugauucuuuuuaa

SEQ ID NO: 1865 - RNA, 20 nt, Artificial Sequence
  source: /note="Description of Artificial Sequence: Synthetic oligonucleotide"
uuuaaugguagccuauuucg

SEQ ID NO: 1866 - RNA, 20 nt, Artificial Sequence
  source: /note="Description of Artificial Sequence: Synthetic oligonucleotide"
auaaaauguauuaaauuuug

SEQ ID NO: 1867 - RNA, 20 nt, Artificial Sequence
  source: /note="Description of Artificial Sequence: Synthetic oligonucleotide"
uaaaauguauuaaauuuugu

SEQ ID NO: 1868 - RNA, 20 nt, Artificial Sequence
  source: /note="Description of Artificial Sequence: Synthetic oligonucleotide"
uuaaauuuugugggaaaauu

SEQ ID NO: 1869 - RNA, 20 nt, Artificial Sequence
  source: /note="Description of Artificial Sequence: Synthetic oligonucleotide"
acugacuaauuuucagaacu

SEQ ID NO: 1870 - RNA, 20 nt, Artificial Sequence
  source: /note="Description of Artificial Sequence: Synthetic oligonucleotide"
uuuucagaacuuggugugua

SEQ ID NO: 1871 - RNA, 20 nt, Artificial Sequence
  source: /note="Description of Artificial Sequence: Synthetic oligonucleotide"
gcuuuaguauuacagugccc

SEQ ID NO: 1872 - RNA, 20 nt, Artificial Sequence
  source: /note="Description of Artificial Sequence: Synthetic oligonucleotide"
guucauccuguacagaucua

SEQ ID NO: 1873 - RNA, 20 nt, Artificial Sequence
  source: /note="Description of Artificial Sequence: Synthetic oligonucleotide"
gguguaacuauuuucauuuc

SEQ ID NO: 1874 - RNA, 20 nt, Artificial Sequence
  source: /note="Description of Artificial Sequence: Synthetic oligonucleotide"
guguaacuauuuucauuucu

SEQ ID NO: 1875 - RNA, 20 nt, Artificial Sequence
  source: /note="Description of Artificial Sequence: Synthetic oligonucleotide"
uauuuucauuucugggcccu

SEQ ID NO: 1876 - RNA, 20 nt, Artificial Sequence
  source: /note="Description of Artificial Sequence: Synthetic oligonucleotide"
cugggcccuuggagauucuu

SEQ ID NO: 1877 - RNA, 20 nt, Artificial Sequence
  source: /note="Description of Artificial Sequence: Synthetic oligonucleotide"
cuaucuugcuguucaauaac

SEQ ID NO: 1878 - RNA, 20 nt, Artificial Sequence
  source: /note="Description of Artificial Sequence: Synthetic oligonucleotide"
ucaauaacagguaauagaaa

SEQ ID NO: 1879 - RNA, 20 nt, Artificial Sequence
  source: /note="Description of Artificial Sequence: Synthetic oligonucleotide"
aaauaaaugugaaacccgua

SEQ ID NO: 1880 - RNA, 20 nt, Artificial Sequence
  source: /note="Description of Artificial Sequence: Synthetic oligonucleotide"
cguaaucuugccuagcuuua

SEQ ID NO: 1881 - RNA, 20 nt, Artificial Sequence
  source: /note="Description of Artificial Sequence: Synthetic oligonucleotide"
ugccuagcuuuaaggaauga

SEQ ID NO: 1882 - RNA, 20 nt, Artificial Sequence
  source: /note="Description of Artificial Sequence: Synthetic oligonucleotide"
cuagaaacaacagagagaaa

SEQ ID NO: 1883 - RNA, 20 nt, Artificial Sequence
  source: /note="Description of Artificial Sequence: Synthetic oligonucleotide"
ucuaccuguaaaguauauuc

SEQ ID NO: 1884 - RNA, 20 nt, Artificial Sequence
  source: /note="Description of Artificial Sequence: Synthetic oligonucleotide"
aaagugcaguuucccuguca

SEQ ID NO: 1885 - RNA, 20 nt, Artificial Sequence
  source: /note="Description of Artificial Sequence: Synthetic oligonucleotide"
aagugcaguuucccugucau

SEQ ID NO: 1886 - RNA, 20 nt, Artificial Sequence
  source: /note="Description of Artificial Sequence: Synthetic oligonucleotide"
ucccccuucuuaccucaccg

SEQ ID NO: 1887 - RNA, 20 nt, Artificial Sequence
  source: /note="Description of Artificial Sequence: Synthetic oligonucleotide"
cccccuucuuaccucaccgu

SEQ ID NO: 1888 - RNA, 20 nt, Artificial Sequence
  source: /note="Description of Artificial Sequence: Synthetic oligonucleotide"
gaucauuuaaaaauuaaguc

SEQ ID NO: 1889 - RNA, 20 nt, Artificial Sequence
  source: /note="Description of Artificial Sequence: Synthetic oligonucleotide"
ccucugcuuaaaaccauuaa

SEQ ID NO: 1890 - RNA, 20 nt, Artificial Sequence
  source: /note="Description of Artificial Sequence: Synthetic oligonucleotide"
cucugcuuaaaaccauuaau

SEQ ID NO: 1891 - RNA, 20 nt, Artificial Sequence
  source: /note="Description of Artificial Sequence: Synthetic oligonucleotide"
ccaccaguccucaagugaau

SEQ ID NO: 1892 - RNA, 20 nt, Artificial Sequence
  source: /note="Description of Artificial Sequence: Synthetic oligonucleotide"
ucauucuauucuaauuuccu

SEQ ID NO: 1893 - RNA, 20 nt, Artificial Sequence
  source: /note="Description of Artificial Sequence: Synthetic oligonucleotide"
ccuugguuuucuugcugucc

SEQ ID NO: 1894 - RNA, 20 nt, Artificial Sequence
  source: /note="Description of Artificial Sequence: Synthetic oligonucleotide"
aagagcauccuuuuuccucc

SEQ ID NO: 1895 - RNA, 20 nt, Artificial Sequence
  source: /note="Description of Artificial Sequence: Synthetic oligonucleotide"
cacuugcuguucccucuucc

SEQ ID NO: 1896 - RNA, 20 nt, Artificial Sequence
  source: /note="Description of Artificial Sequence: Synthetic oligonucleotide"
cccuuccuucagagagccac

SEQ ID NO: 1897 - RNA, 20 nt, Artificial Sequence
  source: /note="Description of Artificial Sequence: Synthetic oligonucleotide"
uuuuauuuuuuuauucccau

SEQ ID NO: 1898 - RNA, 20 nt, Artificial Sequence
  source: /note="Description of Artificial Sequence: Synthetic oligonucleotide"
uuuuuauucccauagguuau

SEQ ID NO: 1899 - RNA, 20 nt, Artificial Sequence
  source: /note="Description of Artificial Sequence: Synthetic oligonucleotide"
uuuuauucccauagguuauu

SEQ ID NO: 1900 - RNA, 20 nt, Artificial Sequence
  source: /note="Description of Artificial Sequence: Synthetic oligonucleotide"
uuuauucccauagguuauug

SEQ ID NO: 1901 - RNA, 20 nt, Artificial Sequence
  source: /note="Description of Artificial Sequence: Synthetic oligonucleotide"
cccauagguuauuggggaac

SEQ ID NO: 1902 - RNA, 20 nt, Artificial Sequence
  source: /note="Description of Artificial Sequence: Synthetic oligonucleotide"
auagguuauuggggaacagg

SEQ ID NO: 1903 - RNA, 20 nt, Artificial Sequence
  source: /note="Description of Artificial Sequence: Synthetic oligonucleotide"
auuggggaacaggugguauu

SEQ ID NO: 1904 - RNA, 20 nt, Artificial Sequence
  source: /note="Description of Artificial Sequence: Synthetic oligonucleotide"
acaggugguauuugguuaca

SEQ ID NO: 1905 - RNA, 20 nt, Artificial Sequence
  source: /note="Description of Artificial Sequence: Synthetic oligonucleotide"
caggugguauuugguuacau

SEQ ID NO: 1906 - RNA, 20 nt, Artificial Sequence
  source: /note="Description of Artificial Sequence: Synthetic oligonucleotide"
uacauggguaaguucuuuag

SEQ ID NO: 1907 - RNA, 20 nt, Artificial Sequence
  source: /note="Description of Artificial Sequence: Synthetic oligonucleotide"
aguggugauuugugagaucu

SEQ ID NO: 1908 - RNA, 20 nt, Artificial Sequence
  source: /note="Description of Artificial Sequence: Synthetic oligonucleotide"
gagugagaacauaugauguu

SEQ ID NO: 1909 - RNA, 20 nt, Artificial Sequence
  source: /note="Description of Artificial Sequence: Synthetic oligonucleotide"
aauagucuccagucuuaucc

SEQ ID NO: 1910 - RNA, 20 nt, Artificial Sequence
  source: /note="Description of Artificial Sequence: Synthetic oligonucleotide"
cauuaauucauuccuuuuua

SEQ ID NO: 1911 - RNA, 20 nt, Artificial Sequence
  source: /note="Description of Artificial Sequence: Synthetic oligonucleotide"
cucaccgauugacgagcauu

SEQ ID NO: 1912 - RNA, 20 nt, Artificial Sequence
  source: /note="Description of Artificial Sequence: Synthetic oligonucleotide"
ucaccgauugacgagcauuu

SEQ ID NO: 1913 - RNA, 20 nt, Artificial Sequence
  source: /note="Description of Artificial Sequence: Synthetic oligonucleotide"
cgauugacgagcauuugggu

SEQ ID NO: 1914 - RNA, 20 nt, Artificial Sequence
  source: /note="Description of Artificial Sequence: Synthetic oligonucleotide"
auauaaugacuuuuuuccuc

SEQ ID NO: 1915 - RNA, 20 nt, Artificial Sequence
  source: /note="Description of Artificial Sequence: Synthetic oligonucleotide"
uauaaugacuuuuuuccucu

SEQ ID NO: 1916 - RNA, 20 nt, Artificial Sequence
  source: /note="Description of Artificial Sequence: Synthetic oligonucleotide"
ucuggguagauacccaguag

SEQ ID NO: 1917 - RNA, 20 nt, Artificial Sequence
  source: /note="Description of Artificial Sequence: Synthetic oligonucleotide"
cuggguagauacccaguagu

SEQ ID NO: 1918 - RNA, 20 nt, Artificial Sequence
  source: /note="Description of Artificial Sequence: Synthetic oligonucleotide"
auacccaguagugggauugc

SEQ ID NO: 1919 - RNA, 20 nt, Artificial Sequence
  source: /note="Description of Artificial Sequence: Synthetic oligonucleotide"
agugggauugcuggaucaaa

SEQ ID NO: 1920 - RNA, 20 nt, Artificial Sequence
  source: /note="Description of Artificial Sequence: Synthetic oligonucleotide"
guuguacuuuuaguuauuua

SEQ ID NO: 1921 - RNA, 20 nt, Artificial Sequence
  source: /note="Description of Artificial Sequence: Synthetic oligonucleotide"
cuccacacuguuuuccauag

SEQ ID NO: 1922 - RNA, 20 nt, Artificial Sequence
  source: /note="Description of Artificial Sequence: Synthetic oligonucleotide"
uuuuuuauugccguucuugc

SEQ ID NO: 1923 - RNA, 20 nt, Artificial Sequence
  source: /note="Description of Artificial Sequence: Synthetic oligonucleotide"
aggaguaaaguauugcauug

SEQ ID NO: 1924 - RNA, 20 nt, Artificial Sequence
  source: /note="Description of Artificial Sequence: Synthetic oligonucleotide"
acauuuucucauauguuugu

SEQ ID NO: 1925 - RNA, 20 nt, Artificial Sequence
  source: /note="Description of Artificial Sequence: Synthetic oligonucleotide"
uccuuagcccacuuuuugau

SEQ ID NO: 1926 - RNA, 20 nt, Artificial Sequence
  source: /note="Description of Artificial Sequence: Synthetic oligonucleotide"
uuuuuuccuugcuaauuugu

SEQ ID NO: 1927 - RNA, 20 nt, Artificial Sequence
  source: /note="Description of Artificial Sequence: Synthetic oligonucleotide"
ucuagauauuaguccuuugc

SEQ ID NO: 1928 - RNA, 20 nt, Artificial Sequence
  source: /note="Description of Artificial Sequence: Synthetic oligonucleotide"
gaagauuuucucccacucug

SEQ ID NO: 1929 - RNA, 20 nt, Artificial Sequence
  source: /note="Description of Artificial Sequence: Synthetic oligonucleotide"
aagauuuucucccacucugu

SEQ ID NO: 1930 - RNA, 20 nt, Artificial Sequence
  source: /note="Description of Artificial Sequence: Synthetic oligonucleotide"
cuguuccuauugcugugcag

SEQ ID NO: 1931 - RNA, 20 nt, Artificial Sequence
  source: /note="Description of Artificial Sequence: Synthetic oligonucleotide"
guuuuuguugcauuugcuuu

SEQ ID NO: 1932 - RNA, 20 nt, Artificial Sequence
  source: /note="Description of Artificial Sequence: Synthetic oligonucleotide"
uuuuuguugcauuugcuuuu

SEQ ID NO: 1933 - RNA, 20 nt, Artificial Sequence
  source: /note="Description of Artificial Sequence: Synthetic oligonucleotide"
ugcauuugcuuuuggguucu

SEQ ID NO: 1934 - RNA, 20 nt, Artificial Sequence
  source: /note="Description of Artificial Sequence: Synthetic oligonucleotide"
uaccuaagccaaugucuaga

SEQ ID NO: 1935 - RNA, 20 nt, Artificial Sequence
  source: /note="Description of Artificial Sequence: Synthetic oligonucleotide"
accuaagccaaugucuagaa

SEQ ID NO: 1936 - RNA, 20 nt, Artificial Sequence
  source: /note="Description of Artificial Sequence: Synthetic oligonucleotide"
cuugaguugauuuuuauaua

SEQ ID NO: 1937 - RNA, 20 nt, Artificial Sequence
  source: /note="Description of Artificial Sequence: Synthetic oligonucleotide"
uuuauauaaggugagagaug

SEQ ID NO: 1938 - RNA, 20 nt, Artificial Sequence
  source: /note="Description of Artificial Sequence: Synthetic oligonucleotide"
uaguuucauucuucuauaug

SEQ ID NO: 1939 - RNA, 20 nt, Artificial Sequence
  source: /note="Description of Artificial Sequence: Synthetic oligonucleotide"
cccagcaccauuuguugaau

SEQ ID NO: 1940 - RNA, 20 nt, Artificial Sequence
  source: /note="Description of Artificial Sequence: Synthetic oligonucleotide"
ccagcaccauuuguugaaua

SEQ ID NO: 1941 - RNA, 20 nt, Artificial Sequence
  source: /note="Description of Artificial Sequence: Synthetic oligonucleotide"
guuuuuguuugcuuugucaa

SEQ ID NO: 1942 - RNA, 20 nt, Artificial Sequence
  source: /note="Description of Artificial Sequence: Synthetic oligonucleotide"
uugcuuugucaaaggucagu

SEQ ID NO: 1943 - RNA, 20 nt, Artificial Sequence
  source: /note="Description of Artificial Sequence: Synthetic oligonucleotide"
gucaguuggcuguaaguaug

SEQ ID NO: 1944 - RNA, 20 nt, Artificial Sequence
  source: /note="Description of Artificial Sequence: Synthetic oligonucleotide"
ucaguuggcuguaaguaugu

SEQ ID NO: 1945 - RNA, 20 nt, Artificial Sequence
  source: /note="Description of Artificial Sequence: Synthetic oligonucleotide"
aaguauguggguuucuuucu

SEQ ID NO: 1946 - RNA, 20 nt, Artificial Sequence
  source: /note="Description of Artificial Sequence: Synthetic oligonucleotide"
uugguucucuauccccccau

SEQ ID NO: 1947 - RNA, 20 nt, Artificial Sequence
  source: /note="Description of Artificial Sequence: Synthetic oligonucleotide"
auaccaguaccaugcuguuu

SEQ ID NO: 1948 - RNA, 20 nt, Artificial Sequence
  source: /note="Description of Artificial Sequence: Synthetic oligonucleotide"
ccaugcuguuuuggugucua

SEQ ID NO: 1949 - RNA, 20 nt, Artificial Sequence
  source: /note="Description of Artificial Sequence: Synthetic oligonucleotide"
uggccuucuaguauaaaguc

SEQ ID NO: 1950 - RNA, 20 nt, Artificial Sequence
  source: /note="Description of Artificial Sequence: Synthetic oligonucleotide"
cuuugugcuuaguuuugcuu

SEQ ID NO: 1951 - RNA, 20 nt, Artificial Sequence
  source: /note="Description of Artificial Sequence: Synthetic oligonucleotide"
uuaguuuugcuuuggcucug

SEQ ID NO: 1952 - RNA, 20 nt, Artificial Sequence
  source: /note="Description of Artificial Sequence: Synthetic oligonucleotide"
uaguuuugcuuuggcucugu

SEQ ID NO: 1953 - RNA, 20 nt, Artificial Sequence
  source: /note="Description of Artificial Sequence: Synthetic oligonucleotide"
ccuaauucugugaagaauga

SEQ ID NO: 1954 - RNA, 20 nt, Artificial Sequence
  source: /note="Description of Artificial Sequence: Synthetic oligonucleotide"
aauucugugaagaaugaugg

SEQ ID NO: 1955 - RNA, 20 nt, Artificial Sequence
  source: /note="Description of Artificial Sequence: Synthetic oligonucleotide"
gaaugauggugguauuuuga

SEQ ID NO: 1956 - RNA, 20 nt, Artificial Sequence
  source: /note="Description of Artificial Sequence: Synthetic oligonucleotide"
aaugauggugguauuuugau

SEQ ID NO: 1957 - RNA, 20 nt, Artificial Sequence
  source: /note="Description of Artificial Sequence: Synthetic oligonucleotide"
uugcauaguuuaucaacccu

SEQ ID NO: 1958 - RNA, 20 nt, Artificial Sequence
  source: /note="Description of Artificial Sequence: Synthetic oligonucleotide"
gaugugaguucuaugagaug

SEQ ID NO: 1959 - RNA, 20 nt, Artificial Sequence
  source: /note="Description of Artificial Sequence: Synthetic oligonucleotide"
augagaugaggaacauuguu

SEQ ID NO: 1960 - RNA, 20 nt, Artificial Sequence
  source: /note="Description of Artificial Sequence: Synthetic oligonucleotide"
ugagaugaggaacauuguuu

SEQ ID NO: 1961 - RNA, 20 nt, Artificial Sequence
  source: /note="Description of Artificial Sequence: Synthetic oligonucleotide"
auugucagcauaccaaacag

SEQ ID NO: 1962 - RNA, 20 nt, Artificial Sequence
  source: /note="Description of Artificial Sequence: Synthetic oligonucleotide"
accaaacaguggcuagcaca

SEQ ID NO: 1963 - RNA, 20 nt, Artificial Sequence
  source: /note="Description of Artificial Sequence: Synthetic oligonucleotide"
gugagcacucaauaaauauu

SEQ ID NO: 1964 - RNA, 20 nt, Artificial Sequence
  source: /note="Description of Artificial Sequence: Synthetic oligonucleotide"
aaaguugcagugaaugaaaa

SEQ ID NO: 1965 - RNA, 20 nt, Artificial Sequence
  source: /note="Description of Artificial Sequence: Synthetic oligonucleotide"
aaugaaaaugguuucuaaaa

SEQ ID NO: 1966 - RNA, 20 nt, Artificial Sequence
  source: /note="Description of Artificial Sequence: Synthetic oligonucleotide"
uauagucccagcuacucuga

SEQ ID NO: 1967 - RNA, 20 nt, Artificial Sequence
  source: /note="Description of Artificial Sequence: Synthetic oligonucleotide"
cccagcuacucugaaggcug

SEQ ID NO: 1968 - RNA, 20 nt, Artificial Sequence
  source: /note="Description of Artificial Sequence: Synthetic oligonucleotide"
gcuacucugaaggcugaggc

SEQ ID NO: 1969 - RNA, 20 nt, Artificial Sequence
  source: /note="Description of Artificial Sequence: Synthetic oligonucleotide"
uugccugagucucaaaaguu

SEQ ID NO: 1970 - RNA, 20 nt, Artificial Sequence
  source: /note="Description of Artificial Sequence: Synthetic oligonucleotide"
ugccugagucucaaaaguuu

SEQ ID NO: 1971 - RNA, 20 nt, Artificial Sequence
  source: /note="Description of Artificial Sequence: Synthetic oligonucleotide"
gccugagucucaaaaguuug

SEQ ID NO: 1972 - RNA, 20 nt, Artificial Sequence
  source: /note="Description of Artificial Sequence: Synthetic oligonucleotide"
auagcugcugcauuguagcc

SEQ ID NO: 1973 - RNA, 20 nt, Artificial Sequence
  source: /note="Description of Artificial Sequence: Synthetic oligonucleotide"
aacccaucucuuuaaaaaaa

SEQ ID NO: 1974 - RNA, 20 nt, Artificial Sequence
  source: /note="Description of Artificial Sequence: Synthetic oligonucleotide"
uuuuacugcuuuucucuuua

SEQ ID NO: 1975 - RNA, 20 nt, Artificial Sequence
  source: /note="Description of Artificial Sequence: Synthetic oligonucleotide"
cucugcugauuuauccucau

SEQ ID NO: 1976 - RNA, 20 nt, Artificial Sequence
  source: /note="Description of Artificial Sequence: Synthetic oligonucleotide"
aauauccauugauuauuuau

SEQ ID NO: 1977 - RNA, 20 nt, Artificial Sequence
  source: /note="Description of Artificial Sequence: Synthetic oligonucleotide"
gauuauuuauaggugaaauu

SEQ ID NO: 1978 - RNA, 20 nt, Artificial Sequence
  source: /note="Description of Artificial Sequence: Synthetic oligonucleotide"
uauaggugaaauuaggcuuu

SEQ ID NO: 1979 - RNA, 20 nt, Artificial Sequence
  source: /note="Description of Artificial Sequence: Synthetic oligonucleotide"
auuaggcuuuuggauccaug

SEQ ID NO: 1980 - RNA, 20 nt, Artificial Sequence
  source: /note="Description of Artificial Sequence: Synthetic oligonucleotide"
aauagcugagacaaucuucc

SEQ ID NO: 1981 - RNA, 20 nt, Artificial Sequence
  source: /note="Description of Artificial Sequence: Synthetic oligonucleotide"
gacaaucuuccaggagcuuc

SEQ ID NO: 1982 - RNA, 20 nt, Artificial Sequence
  source: /note="Description of Artificial Sequence: Synthetic oligonucleotide"
uccaggagcuucuggagccg

SEQ ID NO: 1983 - RNA, 20 nt, Artificial Sequence
  source: /note="Description of Artificial Sequence: Synthetic oligonucleotide"
uucuggagccgaggaaacau

SEQ ID NO: 1984 - RNA, 20 nt, Artificial Sequence
  source: /note="Description of Artificial Sequence: Synthetic oligonucleotide"
cacuaaaauaccauuuauau

SEQ ID NO: 1985 - RNA, 20 nt, Artificial Sequence
  source: /note="Description of Artificial Sequence: Synthetic oligonucleotide"
aauuacauugugcauuuaaa

SEQ ID NO: 1986 - RNA, 20 nt, Artificial Sequence
  source: /note="Description of Artificial Sequence: Synthetic oligonucleotide"
gugcauuuaaaaggcuguug

SEQ ID NO: 1987 - RNA, 20 nt, Artificial Sequence
  source: /note="Description of Artificial Sequence: Synthetic oligonucleotide"
acugauuuauaaauagacuu

SEQ ID NO: 1988 - RNA, 20 nt, Artificial Sequence
  source: /note="Description of Artificial Sequence: Synthetic oligonucleotide"
cugauuuauaaauagacuua

SEQ ID NO: 1989 - RNA, 20 nt, Artificial Sequence
  source: /note="Description of Artificial Sequence: Synthetic oligonucleotide"
cuuccuccuccuucuacacu

SEQ ID NO: 1990 - RNA, 20 nt, Artificial Sequence
  source: /note="Description of Artificial Sequence: Synthetic oligonucleotide"
ugaugagaaaauaucuuuuc

SEQ ID NO: 1991 - RNA, 20 nt, Artificial Sequence
  source: /note="Description of Artificial Sequence: Synthetic oligonucleotide"
cuucauucuuuuuuuuuaaa

SEQ ID NO: 1992 - RNA, 20 nt, Artificial Sequence
  source: /note="Description of Artificial Sequence: Synthetic oligonucleotide"
cauucuuuuuuuuuaaaugg

SEQ ID NO: 1993 - RNA, 20 nt, Artificial Sequence
  source: /note="Description of Artificial Sequence: Synthetic oligonucleotide"
uuucuuccugcuguuauugc

SEQ ID NO: 1994 - RNA, 20 nt, Artificial Sequence
  source: /note="Description of Artificial Sequence: Synthetic oligonucleotide"
uuauugcuggcucaaaaucc

SEQ ID NO: 1995 - RNA, 20 nt, Artificial Sequence
  source: /note="Description of Artificial Sequence: Synthetic oligonucleotide"
guuauuucugagcuccauga

SEQ ID NO: 1996 - RNA, 20 nt, Artificial Sequence
  source: /note="Description of Artificial Sequence: Synthetic oligonucleotide"
uuauuucugagcuccaugau

SEQ ID NO: 1997 - RNA, 20 nt, Artificial Sequence
  source: /note="Description of Artificial Sequence: Synthetic oligonucleotide"
ccagugucuagcacagugcc

SEQ ID NO: 1998 - RNA, 20 nt, Artificial Sequence
  source: /note="Description of Artificial Sequence: Synthetic oligonucleotide"
agccuauaauguuuaucuag

SEQ ID NO: 1999 - RNA, 20 nt, Artificial Sequence
  source: /note="Description of Artificial Sequence: Synthetic oligonucleotide"
uuaucauugcaaagauuuag

SEQ ID NO: 2000 - RNA, 20 nt, Artificial Sequence
  source: /note="Description of Artificial Sequence: Synthetic oligonucleotide"
uaaugcucuacuccaugcua

SEQ ID NO: 2001 - RNA, 20 nt, Artificial Sequence
  source: /note="Description of Artificial Sequence: Synthetic oligonucleotide"
auaaccaaauaagauaacac

SEQ ID NO: 2002 - RNA, 20 nt, Artificial Sequence
  source: /note="Description of Artificial Sequence: Synthetic oligonucleotide"
uuuguucuuuaaaaaaugac

SEQ ID NO: 2003 - RNA, 20 nt, Artificial Sequence
  source: /note="Description of Artificial Sequence: Synthetic oligonucleotide"
agaauaagagaaaaaauuag

SEQ ID NO: 2004 - RNA, 20 nt, Artificial Sequence
  source: /note="Description of Artificial Sequence: Synthetic oligonucleotide"
cuacaacugccucuugauaa

SEQ ID NO: 2005 - RNA, 20 nt, Artificial Sequence
  source: /note="Description of Artificial Sequence: Synthetic oligonucleotide"
ugccucuugauaaaggaugc

SEQ ID NO: 2006 - RNA, 20 nt, Artificial Sequence
  source: /note="Description of Artificial Sequence: Synthetic oligonucleotide"
uaauguuugcucauuuacag

SEQ ID NO: 2007 - RNA, 20 nt, Artificial Sequence
  source: /note="Description of Artificial Sequence: Synthetic oligonucleotide"
ggaauguacaauauaguacc

SEQ ID NO: 2008 - RNA, 20 nt, Artificial Sequence
  source: /note="Description of Artificial Sequence: Synthetic oligonucleotide"
gaauguacaauauaguaccu

SEQ ID NO: 2009 - RNA, 20 nt, Artificial Sequence
  source: /note="Description of Artificial Sequence: Synthetic oligonucleotide"
guacaauauaguaccuggga

SEQ ID NO: 2010 - RNA, 20 nt, Artificial Sequence
  source: /note="Description of Artificial Sequence: Synthetic oligonucleotide"
aguaccugggauggugaaga

SEQ ID NO: 2011 - RNA, 20 nt, Artificial Sequence
  source: /note="Description of Artificial Sequence: Synthetic oligonucleotide"
caacaaauuuaaaauagcug

SEQ ID NO: 2012 - RNA, 20 nt, Artificial Sequence
  source: /note="Description of Artificial Sequence: Synthetic oligonucleotide"
aacaaauuuaaaauagcugu

SEQ ID NO: 2013 - RNA, 20 nt, Artificial Sequence
  source: /note="Description of Artificial Sequence: Synthetic oligonucleotide"
augccugccuuuaucugcuu

SEQ ID NO: 2014 - RNA, 20 nt, Artificial Sequence
  source: /note="Description of Artificial Sequence: Synthetic oligonucleotide"
auagcaugcauuucucagac

SEQ ID NO: 2015 - RNA, 20 nt, Artificial Sequence
  source: /note="Description of Artificial Sequence: Synthetic oligonucleotide"
ucagacagguaagauagaau

SEQ ID NO: 2016 - RNA, 20 nt, Artificial Sequence
  source: /note="Description of Artificial Sequence: Synthetic oligonucleotide"
agauagaauugguauauauu

SEQ ID NO: 2017 - RNA, 20 nt, Artificial Sequence
  source: /note="Description of Artificial Sequence: Synthetic oligonucleotide"
uuugguauagcaaaaaguca

SEQ ID NO: 2018 - RNA, 20 nt, Artificial Sequence
  source: /note="Description of Artificial Sequence: Synthetic oligonucleotide"
uugucuuuagauuauauccu

SEQ ID NO: 2019 - RNA, 20 nt, Artificial Sequence
  source: /note="Description of Artificial Sequence: Synthetic oligonucleotide"
uauauccuugguuuuucaug

SEQ ID NO: 2020 - RNA, 20 nt, Artificial Sequence
  source: /note="Description of Artificial Sequence: Synthetic oligonucleotide"
cuugguuuuucaugugguac

SEQ ID NO: 2021 - RNA, 20 nt, Artificial Sequence
  source: /note="Description of Artificial Sequence: Synthetic oligonucleotide"
uugguuuuucaugugguacu

SEQ ID NO: 2022 - RNA, 20 nt, Artificial Sequence
  source: /note="Description of Artificial Sequence: Synthetic oligonucleotide"
ugguuuuucaugugguacug

SEQ ID NO: 2023 - RNA, 20 nt, Artificial Sequence
  source: /note="Description of Artificial Sequence: Synthetic oligonucleotide"
uuucuucaucuauaaaauga

SEQ ID NO: 2024 - RNA, 20 nt, Artificial Sequence
  source: /note="Description of Artificial Sequence: Synthetic oligonucleotide"
caucuauaaaaugaaggacc

SEQ ID NO: 2025 - RNA, 20 nt, Artificial Sequence
  source: /note="Description of Artificial Sequence: Synthetic oligonucleotide"
aucuauaaaaugaaggaccu

SEQ ID NO: 2026 - RNA, 20 nt, Artificial Sequence
  source: /note="Description of Artificial Sequence: Synthetic oligonucleotide"
aacuuugagcucagcaaagu

SEQ ID NO: 2027 - RNA, 20 nt, Artificial Sequence
  source: /note="Description of Artificial Sequence: Synthetic oligonucleotide"
acuuugagcucagcaaagua

SEQ ID NO: 2028 - RNA, 20 nt, Artificial Sequence
  source: /note="Description of Artificial Sequence: Synthetic oligonucleotide"
caguugacccuugaauaaca

SEQ ID NO: 2029 - RNA, 20 nt, Artificial Sequence
  source: /note="Description of Artificial Sequence: Synthetic oligonucleotide"
uugacccuugaauaacaugg

SEQ ID NO: 2030 - RNA, 20 nt, Artificial Sequence
  source: /note="Description of Artificial Sequence: Synthetic oligonucleotide"
acuaauagccugcuguuguc

SEQ ID NO: 2031 - RNA, 20 nt, Artificial Sequence
  source: /note="Description of Artificial Sequence: Synthetic oligonucleotide"
aauagccugcuguugucugg

SEQ ID NO: 2032 - RNA, 20 nt, Artificial Sequence
  source: /note="Description of Artificial Sequence: Synthetic oligonucleotide"
cuguuauuaagaaaaucgua

SEQ ID NO: 2033 - RNA, 20 nt, Artificial Sequence
  source: /note="Description of Artificial Sequence: Synthetic oligonucleotide"
uauauuuacuauuuauuaaa

SEQ ID NO: 2034 - RNA, 20 nt, Artificial Sequence
  source: /note="Description of Artificial Sequence: Synthetic oligonucleotide"
ccuugaguaugcugaagaag

SEQ ID NO: 2035 - RNA, 20 nt, Artificial Sequence
  source: /note="Description of Artificial Sequence: Synthetic oligonucleotide"
ugaguaugcugaagaagagg

SEQ ID NO: 2036 - RNA, 20 nt, Artificial Sequence
  source: /note="Description of Artificial Sequence: Synthetic oligonucleotide"
ugcugaagaagaggaggaaa

SEQ ID NO: 2037 - RNA, 20 nt, Artificial Sequence
  source: /note="Description of Artificial Sequence: Synthetic oligonucleotide"
gaagaagaggaggaaaagga

SEQ ID NO: 2038 - RNA, 20 nt, Artificial Sequence
  source: /note="Description of Artificial Sequence: Synthetic oligonucleotide"
aagaagaggaggaaaaggau

SEQ ID NO: 2039 - RNA, 20 nt, Artificial Sequence
  source: /note="Description of Artificial Sequence: Synthetic oligonucleotide"
agaggaggaaaaggaugggu

SEQ ID NO: 2040 - RNA, 20 nt, Artificial Sequence
  source: /note="Description of Artificial Sequence: Synthetic oligonucleotide"
uggguuggucuugcuguucc

SEQ ID NO: 2041 - RNA, 20 nt, Artificial Sequence
  source: /note="Description of Artificial Sequence: Synthetic oligonucleotide"
ggguuggucuugcuguucca

SEQ ID NO: 2042 - RNA, 20 nt, Artificial Sequence
  source: /note="Description of Artificial Sequence: Synthetic oligonucleotide"
gguuggucuugcuguuccag

SEQ ID NO: 2043 - RNA, 20 nt, Artificial Sequence
  source: /note="Description of Artificial Sequence: Synthetic oligonucleotide"
uggucuugcuguuccagggg

SEQ ID NO: 2044 - RNA, 20 nt, Artificial Sequence
  source: /note="Description of Artificial Sequence: Synthetic oligonucleotide"
uguuccagggguggcagaag

SEQ ID NO: 2045 - RNA, 20 nt, Artificial Sequence
  source: /note="Description of Artificial Sequence: Synthetic oligonucleotide"
caguucaaaccuguauuuua

SEQ ID NO: 2046 - RNA, 20 nt, Artificial Sequence
  source: /note="Description of Artificial Sequence: Synthetic oligonucleotide"
aaccuguauuuuaaggucaa

SEQ ID NO: 2047 - RNA, 20 nt, Artificial Sequence
  source: /note="Description of Artificial Sequence: Synthetic oligonucleotide"
aacuaugaaaguugaauuca

SEQ ID NO: 2048 - RNA, 20 nt, Artificial Sequence
  source: /note="Description of Artificial Sequence: Synthetic oligonucleotide"
ucauauaaugagaauacuaa

SEQ ID NO: 2049 - RNA, 20 nt, Artificial Sequence
  source: /note="Description of Artificial Sequence: Synthetic oligonucleotide"
aaaaagaaaaucuuucagug

SEQ ID NO: 2050 - RNA, 20 nt, Artificial Sequence
  source: /note="Description of Artificial Sequence: Synthetic oligonucleotide"
ucuaguagaugacauauuuu

SEQ ID NO: 2051 - RNA, 20 nt, Artificial Sequence
  source: /note="Description of Artificial Sequence: Synthetic oligonucleotide"
uuuugguaaugaaauugaua

SEQ ID NO: 2052 - RNA, 20 nt, Artificial Sequence
  source: /note="Description of Artificial Sequence: Synthetic oligonucleotide"
uuugguaaugaaauugauau

SEQ ID NO: 2053 - RNA, 20 nt, Artificial Sequence
  source: /note="Description of Artificial Sequence: Synthetic oligonucleotide"
auuaacagcuuuuuccaagu

SEQ ID NO: 2054 - RNA, 20 nt, Artificial Sequence
  source: /note="Description of Artificial Sequence: Synthetic oligonucleotide"
auauaaauuuucuucuuaag

SEQ ID NO: 2055 - RNA, 20 nt, Artificial Sequence
  source: /note="Description of Artificial Sequence: Synthetic oligonucleotide"
auucuugcaugccaacacaa

SEQ ID NO: 2056 - RNA, 20 nt, Artificial Sequence
  source: /note="Description of Artificial Sequence: Synthetic oligonucleotide"
accuauccuuaguuucuaag

SEQ ID NO: 2057 - RNA, 20 nt, Artificial Sequence
  source: /note="Description of Artificial Sequence: Synthetic oligonucleotide"
gauaaguuccaacucaaucu

SEQ ID NO: 2058 - RNA, 20 nt, Artificial Sequence
  source: /note="Description of Artificial Sequence: Synthetic oligonucleotide"
aguuccaacucaaucuuggu

SEQ ID NO: 2059 - RNA, 20 nt, Artificial Sequence
  source: /note="Description of Artificial Sequence: Synthetic oligonucleotide"
guuccaacucaaucuugguu

SEQ ID NO: 2060 - RNA, 20 nt, Artificial Sequence
  source: /note="Description of Artificial Sequence: Synthetic oligonucleotide"
aacucaaucuugguugggug

SEQ ID NO: 2061 - RNA, 20 nt, Artificial Sequence
  source: /note="Description of Artificial Sequence: Synthetic oligonucleotide"
ucaaucuugguugggugugg

SEQ ID NO: 2062 - RNA, 20 nt, Artificial Sequence
  source: /note="Description of Artificial Sequence: Synthetic oligonucleotide"
guggcucacgccugugaucc

SEQ ID NO: 2063 - RNA, 20 nt, Artificial Sequence
  source: /note="Description of Artificial Sequence: Synthetic oligonucleotide"
cgccugugaucccggcacuu

SEQ ID NO: 2064 - RNA, 20 nt, Artificial Sequence
  source: /note="Description of Artificial Sequence: Synthetic oligonucleotide"
gccugugaucccggcacuuu

SEQ ID NO: 2065 - RNA, 20 nt, Artificial Sequence
  source: /note="Description of Artificial Sequence: Synthetic oligonucleotide"
ugugaucccggcacuuuggg

SEQ ID NO: 2066 - RNA, 20 nt, Artificial Sequence
  source: /note="Description of Artificial Sequence: Synthetic oligonucleotide"
cccggcacuuugggaggccg

SEQ ID NO: 2067 - RNA, 20 nt, Artificial Sequence
  source: /note="Description of Artificial Sequence: Synthetic oligonucleotide"
ggcacuuugggaggccgagg

SEQ ID NO: 2068 - RNA, 20 nt, Artificial Sequence
  source: /note="Description of Artificial Sequence: Synthetic oligonucleotide"
gcacuuugggaggccgaggu

SEQ ID NO: 2069 - RNA, 20 nt, Artificial Sequence
  source: /note="Description of Artificial Sequence: Synthetic oligonucleotide"
ggugggcagaucacgagcuc

SEQ ID NO: 2070 - RNA, 20 nt, Artificial Sequence
  source: /note="Description of Artificial Sequence: Synthetic oligonucleotide"
ucaggaguuugagaccagcc

SEQ ID NO: 2071 - RNA, 20 nt, Artificial Sequence
  source: /note="Description of Artificial Sequence: Synthetic oligonucleotide"
ugagaccagccuggccaaua

SEQ ID NO: 2072 - RNA, 20 nt, Artificial Sequence
  source: /note="Description of Artificial Sequence: Synthetic oligonucleotide"
aaaaaaaaacaaaacuagcc

SEQ ID NO: 2073 - RNA, 20 nt, Artificial Sequence
  source: /note="Description of Artificial Sequence: Synthetic oligonucleotide"
aaaacaaaacuagcccggca

SEQ ID NO: 2074 - RNA, 20 nt, Artificial Sequence
  source: /note="Description of Artificial Sequence: Synthetic oligonucleotide"
acaaaacuagcccggcaugg

SEQ ID NO: 2075 - RNA, 20 nt, Artificial Sequence
  source: /note="Description of Artificial Sequence: Synthetic oligonucleotide"
cucccguagucccagcuacu

SEQ ID NO: 2076 - RNA, 20 nt, Artificial Sequence
  source: /note="Description of Artificial Sequence: Synthetic oligonucleotide"
ucccguagucccagcuacuu

SEQ ID NO: 2077 - RNA, 20 nt, Artificial Sequence
  source: /note="Description of Artificial Sequence: Synthetic oligonucleotide"
cguagucccagcuacuuggg

SEQ ID NO: 2078 - RNA, 20 nt, Artificial Sequence
  source: /note="Description of Artificial Sequence: Synthetic oligonucleotide"
cccagcuacuugggaggcug

SEQ ID NO: 2079 - RNA, 20 nt, Artificial Sequence
  source: /note="Description of Artificial Sequence: Synthetic oligonucleotide"
gcuacuugggaggcugaggc

SEQ ID NO: 2080 - RNA, 20 nt, Artificial Sequence
  source: /note="Description of Artificial Sequence: Synthetic oligonucleotide"
caggagaaucgauugaaccc

SEQ ID NO: 2081 - RNA, 20 nt, Artificial Sequence
  source: /note="Description of Artificial Sequence: Synthetic oligonucleotide"
gagaaucgauugaacccagg

SEQ ID NO: 2082 - RNA, 20 nt, Artificial Sequence
  source: /note="Description of Artificial Sequence: Synthetic oligonucleotide"
aaucgauugaacccaggagg

SEQ ID NO: 2083 - RNA, 20 nt, Artificial Sequence
  source: /note="Description of Artificial Sequence: Synthetic oligonucleotide"
cgauugaacccaggaggugg

SEQ ID NO: 2084 - RNA, 20 nt, Artificial Sequence
  source: /note="Description of Artificial Sequence: Synthetic oligonucleotide"
ugcaccacugcacuccagcc

SEQ ID NO: 2085 - RNA, 20 nt, Artificial Sequence
  source: /note="Description of Artificial Sequence: Synthetic oligonucleotide"
gcaccacugcacuccagccu

SEQ ID NO: 2086 - RNA, 20 nt, Artificial Sequence
  source: /note="Description of Artificial Sequence: Synthetic oligonucleotide"
cacuccagccugggcaaaag

SEQ ID NO: 2087 - RNA, 20 nt, Artificial Sequence
  source: /note="Description of Artificial Sequence: Synthetic oligonucleotide"
acuccagccugggcaaaaga

SEQ ID NO: 2088 - RNA, 20 nt, Artificial Sequence
  source: /note="Description of Artificial Sequence: Synthetic oligonucleotide"
ugagucauuuuagucaauaa

SEQ ID NO: 2089 - RNA, 20 nt, Artificial Sequence
  source: /note="Description of Artificial Sequence: Synthetic oligonucleotide"
aauuugcuacaagaaugcaa

SEQ ID NO: 2090 - RNA, 20 nt, Artificial Sequence
  source: /note="Description of Artificial Sequence: Synthetic oligonucleotide"
aaugcaaaggugaugacaug

SEQ ID NO: 2091 - RNA, 20 nt, Artificial Sequence
  source: /note="Description of Artificial Sequence: Synthetic oligonucleotide"
ggugaugacaugaggaaaaa

SEQ ID NO: 2092 - RNA, 20 nt, Artificial Sequence
  source: /note="Description of Artificial Sequence: Synthetic oligonucleotide"
gugaugacaugaggaaaaaa

SEQ ID NO: 2093 - RNA, 20 nt, Artificial Sequence
  source: /note="Description of Artificial Sequence: Synthetic oligonucleotide"
ugaugacaugaggaaaaaag

SEQ ID NO: 2094 - RNA, 20 nt, Artificial Sequence
  source: /note="Description of Artificial Sequence: Synthetic oligonucleotide"
cucuacuacucagcaaaugc

SEQ ID NO: 2095 - RNA, 20 nt, Artificial Sequence
  source: /note="Description of Artificial Sequence: Synthetic oligonucleotide"
cuacucagcaaaugcaggcc

SEQ ID NO: 2096 - RNA, 20 nt, Artificial Sequence
  source: /note="Description of Artificial Sequence: Synthetic oligonucleotide"
uuauucaaauauuuauuaca

SEQ ID NO: 2097 - RNA, 20 nt, Artificial Sequence
  source: /note="Description of Artificial Sequence: Synthetic oligonucleotide"
auuaaaacauuuauaaaauu

SEQ ID NO: 2098 - RNA, 20 nt, Artificial Sequence
  source: /note="Description of Artificial Sequence: Synthetic oligonucleotide"
uaaacaagauuauaaucuaa

SEQ ID NO: 2099 - RNA, 20 nt, Artificial Sequence
  source: /note="Description of Artificial Sequence: Synthetic oligonucleotide"
aaucuaauggagauuaauau

SEQ ID NO: 2100 - RNA, 20 nt, Artificial Sequence
  source: /note="Description of Artificial Sequence: Synthetic oligonucleotide"
guuuaauaaaauauugacuu

SEQ ID NO: 2101 - RNA, 20 nt, Artificial Sequence
  source: /note="Description of Artificial Sequence: Synthetic oligonucleotide"
gacuuagguagauauaugug

SEQ ID NO: 2102 - RNA, 20 nt, Artificial Sequence
  source: /note="Description of Artificial Sequence: Synthetic oligonucleotide"
uauguauuucuuaaaagagu

SEQ ID NO: 2103 - RNA, 20 nt, Artificial Sequence
  source: /note="Description of Artificial Sequence: Synthetic oligonucleotide"
guagguagcaaugacuucaa

SEQ ID NO: 2104 - RNA, 20 nt, Artificial Sequence
  source: /note="Description of Artificial Sequence: Synthetic oligonucleotide"
ucauauauaaguaaaauuuu

SEQ ID NO: 2105 - RNA, 20 nt, Artificial Sequence
  source: /note="Description of Artificial Sequence: Synthetic oligonucleotide"
cauauauaaguaaaauuuua

SEQ ID NO: 2106 - RNA, 20 nt, Artificial Sequence
  source: /note="Description of Artificial Sequence: Synthetic oligonucleotide"
auauauaaguaaaauuuuag

SEQ ID NO: 2107 - RNA, 20 nt, Artificial Sequence
  source: /note="Description of Artificial Sequence: Synthetic oligonucleotide"
aguauuuccuaagauuuauu

SEQ ID NO: 2108 - RNA, 20 nt, Artificial Sequence
  source: /note="Description of Artificial Sequence: Synthetic oligonucleotide"
auagaagaucgauauuuuuc

SEQ ID NO: 2109 - RNA, 20 nt, Artificial Sequence
  source: /note="Description of Artificial Sequence: Synthetic oligonucleotide"
uagaagaucgauauuuuucu

SEQ ID NO: 2110 - RNA, 20 nt, Artificial Sequence
  source: /note="Description of Artificial Sequence: Synthetic oligonucleotide"
uauuuuucugggaugacaua

SEQ ID NO: 2111 - RNA, 20 nt, Artificial Sequence
  source: /note="Description of Artificial Sequence: Synthetic oligonucleotide"
aaguaaaaagcugaaugaau

SEQ ID NO: 2112 - RNA, 20 nt, Artificial Sequence
  source: /note="Description of Artificial Sequence: Synthetic oligonucleotide"
ugucagaaaaaugagauuau

SEQ ID NO: 2113 - RNA, 20 nt, Artificial Sequence
  source: /note="Description of Artificial Sequence: Synthetic oligonucleotide"
gucagaaaaaugagauuaua

SEQ ID NO: 2114 - RNA, 20 nt, Artificial Sequence
  source: /note="Description of Artificial Sequence: Synthetic oligonucleotide"
caaauauuagagaagcagac

SEQ ID NO: 2115 - RNA, 20 nt, Artificial Sequence
  source: /note="Description of Artificial Sequence: Synthetic oligonucleotide"
uagaaagaaucacaacuuag

SEQ ID NO: 2116 - RNA, 20 nt, Artificial Sequence
  source: /note="Description of Artificial Sequence: Synthetic oligonucleotide"
agaaagaaucacaacuuagu

SEQ ID NO: 2117 - RNA, 20 nt, Artificial Sequence
  source: /note="Description of Artificial Sequence: Synthetic oligonucleotide"
gaaagaaucacaacuuagug

SEQ ID NO: 2118 - RNA, 20 nt, Artificial Sequence
  source: /note="Description of Artificial Sequence: Synthetic oligonucleotide"
uaguggggcaaaaaccuaca

SEQ ID NO: 2119 - RNA, 20 nt, Artificial Sequence
  source: /note="Description of Artificial Sequence: Synthetic oligonucleotide"
accuacaaggaaaauuuuug

SEQ ID NO: 2120 - RNA, 20 nt, Artificial Sequence
  source: /note="Description of Artificial Sequence: Synthetic oligonucleotide"
ccuacaaggaaaauuuuugu

SEQ ID NO: 2121 - RNA, 20 nt, Artificial Sequence
  source: /note="Description of Artificial Sequence: Synthetic oligonucleotide"
aggaaaauuuuugugggaac

SEQ ID NO: 2122 - RNA, 20 nt, Artificial Sequence
  source: /note="Description of Artificial Sequence: Synthetic oligonucleotide"
uuuuugugggaaccggugcc

SEQ ID NO: 2123 - RNA, 20 nt, Artificial Sequence
  source: /note="Description of Artificial Sequence: Synthetic oligonucleotide"
ugugggaaccggugccaggu

SEQ ID NO: 2124 - RNA, 20 nt, Artificial Sequence
  source: /note="Description of Artificial Sequence: Synthetic oligonucleotide"
aauugaaaaauuguucagug

SEQ ID NO: 2125 - RNA, 20 nt, Artificial Sequence
  source: /note="Description of Artificial Sequence: Synthetic oligonucleotide"
auugaaaaauuguucagugu

SEQ ID NO: 2126 - RNA, 20 nt, Artificial Sequence
  source: /note="Description of Artificial Sequence: Synthetic oligonucleotide"
gaaaaauuguucaguguggg

SEQ ID NO: 2127 - RNA, 20 nt, Artificial Sequence
  source: /note="Description of Artificial Sequence: Synthetic oligonucleotide"
gugugggcgguuguucagug

SEQ ID NO: 2128 - RNA, 20 nt, Artificial Sequence
  source: /note="Description of Artificial Sequence: Synthetic oligonucleotide"
uguucaguguggcaagucug

SEQ ID NO: 2129 - RNA, 20 nt, Artificial Sequence
  source: /note="Description of Artificial Sequence: Synthetic oligonucleotide"
guucaguguggcaagucuga

SEQ ID NO: 2130 - RNA, 20 nt, Artificial Sequence
  source: /note="Description of Artificial Sequence: Synthetic oligonucleotide"
gucugaggguuaaaaacucc

SEQ ID NO: 2131 - RNA, 20 nt, Artificial Sequence
  source: /note="Description of Artificial Sequence: Synthetic oligonucleotide"
ugaggguuaaaaacuccagg

SEQ ID NO: 2132 - RNA, 20 nt, Artificial Sequence
  source: /note="Description of Artificial Sequence: Synthetic oligonucleotide"
acuccaggaggacucacuua

SEQ ID NO: 2133 - RNA, 20 nt, Artificial Sequence
  source: /note="Description of Artificial Sequence: Synthetic oligonucleotide"
caggaggacucacuuacgga

SEQ ID NO: 2134 - RNA, 20 nt, Artificial Sequence
  source: /note="Description of Artificial Sequence: Synthetic oligonucleotide"
aggaggacucacuuacggaa

SEQ ID NO: 2135 - RNA, 20 nt, Artificial Sequence
  source: /note="Description of Artificial Sequence: Synthetic oligonucleotide"
cuuuugugaguuuaaccucc

SEQ ID NO: 2136 - RNA, 20 nt, Artificial Sequence
  source: /note="Description of Artificial Sequence: Synthetic oligonucleotide"
ggaguguucacagugacuac

SEQ ID NO: 2137 - RNA, 20 nt, Artificial Sequence
  source: /note="Description of Artificial Sequence: Synthetic oligonucleotide"
cuacuggagaaaauucccua

SEQ ID NO: 2138 - RNA, 20 nt, Artificial Sequence
  source: /note="Description of Artificial Sequence: Synthetic oligonucleotide"
uacuggagaaaauucccuaa

SEQ ID NO: 2139 - RNA, 20 nt, Artificial Sequence
  source: /note="Description of Artificial Sequence: Synthetic oligonucleotide"
acuggagaaaauucccuaag

SEQ ID NO: 2140 - RNA, 20 nt, Artificial Sequence
  source: /note="Description of Artificial Sequence: Synthetic oligonucleotide"
uucccuaaggggagaagaaa

SEQ ID NO: 2141 - RNA, 20 nt, Artificial Sequence
  source: /note="Description of Artificial Sequence: Synthetic oligonucleotide"
aauaugucagagcauuuugu

SEQ ID NO: 2142 - RNA, 20 nt, Artificial Sequence
  source: /note="Description of Artificial Sequence: Synthetic oligonucleotide"
uuuaccagagccuaaacuuu

SEQ ID NO: 2143 - RNA, 20 nt, Artificial Sequence
  source: /note="Description of Artificial Sequence: Synthetic oligonucleotide"
uuaccagagccuaaacuuuu

SEQ ID NO: 2144 - RNA, 20 nt, Artificial Sequence
  source: /note="Description of Artificial Sequence: Synthetic oligonucleotide"
auaagaguguaaccucccaa

SEQ ID NO: 2145 - RNA, 20 nt, Artificial Sequence
  source: /note="Description of Artificial Sequence: Synthetic oligonucleotide"
uaagaguguaaccucccaaa

SEQ ID NO: 2146 - RNA, 20 nt, Artificial Sequence
  source: /note="Description of Artificial Sequence: Synthetic oligonucleotide"
aguguaaccucccaaaggga

SEQ ID NO: 2147 - RNA, 20 nt, Artificial Sequence
  source: /note="Description of Artificial Sequence: Synthetic oligonucleotide"
guguaaccucccaaagggaa

SEQ ID NO: 2148 - RNA, 20 nt, Artificial Sequence
  source: /note="Description of Artificial Sequence: Synthetic oligonucleotide"
ccccuuuuagcuuuccacau

SEQ ID NO: 2149 - RNA, 20 nt, Artificial Sequence
  source: /note="Description of Artificial Sequence: Synthetic oligonucleotide"
cccuuuuagcuuuccacaua

SEQ ID NO: 2150 - RNA, 20 nt, Artificial Sequence
  source: /note="Description of Artificial Sequence: Synthetic oligonucleotide"
uuagcuuuccacauagggaa

SEQ ID NO: 2151 - RNA, 20 nt, Artificial Sequence
  source: /note="Description of Artificial Sequence: Synthetic oligonucleotide"
gaaaggaaaauauauaacuc

SEQ ID NO: 2152 - RNA, 20 nt, Artificial Sequence
  source: /note="Description of Artificial Sequence: Synthetic oligonucleotide"
caaaccauccuguccacguu

SEQ ID NO: 2153 - RNA, 20 nt, Artificial Sequence
  source: /note="Description of Artificial Sequence: Synthetic oligonucleotide"
aaaccauccuguccacguua

SEQ ID NO: 2154 - RNA, 20 nt, Artificial Sequence
  source: /note="Description of Artificial Sequence: Synthetic oligonucleotide"
aaccauccuguccacguuag

SEQ ID NO: 2155 - RNA, 20 nt, Artificial Sequence
  source: /note="Description of Artificial Sequence: Synthetic oligonucleotide"
accauccuguccacguuagg

SEQ ID NO: 2156 - RNA, 20 nt, Artificial Sequence
  source: /note="Description of Artificial Sequence: Synthetic oligonucleotide"
cuguccacguuagggggccu

SEQ ID NO: 2157 - RNA, 20 nt, Artificial Sequence
  source: /note="Description of Artificial Sequence: Synthetic oligonucleotide"
uguccacguuagggggccua

SEQ ID NO: 2158 - RNA, 20 nt, Artificial Sequence
  source: /note="Description of Artificial Sequence: Synthetic oligonucleotide"
guccacguuagggggccuag

SEQ ID NO: 2159 - RNA, 20 nt, Artificial Sequence
  source: /note="Description of Artificial Sequence: Synthetic oligonucleotide"
ccuaggggaacugagaaaac

SEQ ID NO: 2160 - RNA, 20 nt, Artificial Sequence
  source: /note="Description of Artificial Sequence: Synthetic oligonucleotide"
cuggugaaguucauagucca

SEQ ID NO: 2161 - RNA, 20 nt, Artificial Sequence
  source: /note="Description of Artificial Sequence: Synthetic oligonucleotide"
uggugaaguucauaguccau

SEQ ID NO: 2162 - RNA, 20 nt, Artificial Sequence
  source: /note="Description of Artificial Sequence: Synthetic oligonucleotide"
uggguacaguuucaccaaag

SEQ ID NO: 2163 - RNA, 20 nt, Artificial Sequence
  source: /note="Description of Artificial Sequence: Synthetic oligonucleotide"
ggguacaguuucaccaaaga

SEQ ID NO: 2164 - RNA, 20 nt, Artificial Sequence
  source: /note="Description of Artificial Sequence: Synthetic oligonucleotide"
aagagggagaccaaauuaua

SEQ ID NO: 2165 - RNA, 20 nt, Artificial Sequence
  source: /note="Description of Artificial Sequence: Synthetic oligonucleotide"
cauucaaccaaaaaauuaua

SEQ ID NO: 2166 - RNA, 20 nt, Artificial Sequence
  source: /note="Description of Artificial Sequence: Synthetic oligonucleotide"
aaauuauaaggcaugcuaaa

SEQ ID NO: 2167 - RNA, 20 nt, Artificial Sequence
  source: /note="Description of Artificial Sequence: Synthetic oligonucleotide"
uauaaggcaugcuaaaaggc

SEQ ID NO: 2168 - RNA, 20 nt, Artificial Sequence
  source: /note="Description of Artificial Sequence: Synthetic oligonucleotide"
aucagaagcagagucaaaua

SEQ ID NO: 2169 - RNA, 20 nt, Artificial Sequence
  source: /note="Description of Artificial Sequence: Synthetic oligonucleotide"
gucaaauauggcagugacau

SEQ ID NO: 2170 - RNA, 20 nt, Artificial Sequence
  source: /note="Description of Artificial Sequence: Synthetic oligonucleotide"
agaaacuuuauaaaaaacua

SEQ ID NO: 2171 - RNA, 20 nt, Artificial Sequence
  source: /note="Description of Artificial Sequence: Synthetic oligonucleotide"
auaaaaaacuaugguuaaua

SEQ ID NO: 2172 - RNA, 20 nt, Artificial Sequence
  source: /note="Description of Artificial Sequence: Synthetic oligonucleotide"
aaacuaugguuaauauggug

SEQ ID NO: 2173 - RNA, 20 nt, Artificial Sequence
  source: /note="Description of Artificial Sequence: Synthetic oligonucleotide"
aacuaugguuaauaugguga

SEQ ID NO: 2174 - RNA, 20 nt, Artificial Sequence
  source: /note="Description of Artificial Sequence: Synthetic oligonucleotide"
aaaugacauacaagaacaga

SEQ ID NO: 2175 - RNA, 20 nt, Artificial Sequence
  source: /note="Description of Artificial Sequence: Synthetic oligonucleotide"
ggauaauguaaauauagaga

SEQ ID NO: 2176 - RNA, 20 nt, Artificial Sequence
  source: /note="Description of Artificial Sequence: Synthetic oligonucleotide"
aauauagagacggaaauuuu

SEQ ID NO: 2177 - RNA, 20 nt, Artificial Sequence
  source: /note="Description of Artificial Sequence: Synthetic oligonucleotide"
augauuaaaaugucuuugau

SEQ ID NO: 2178 - RNA, 20 nt, Artificial Sequence
  source: /note="Description of Artificial Sequence: Synthetic oligonucleotide"
aaguagauugaacauagccg

SEQ ID NO: 2179 - RNA, 20 nt, Artificial Sequence
  source: /note="Description of Artificial Sequence: Synthetic oligonucleotide"
ggaaaaaaucuuugaaguua

SEQ ID NO: 2180 - RNA, 20 nt, Artificial Sequence
  source: /note="Description of Artificial Sequence: Synthetic oligonucleotide"
gaaguuaaggauaugauaau

SEQ ID NO: 2181 - RNA, 20 nt, Artificial Sequence
  source: /note="Description of Artificial Sequence: Synthetic oligonucleotide"
agagauuauucaagaacugc

SEQ ID NO: 2182 - RNA, 20 nt, Artificial Sequence
  source: /note="Description of Artificial Sequence: Synthetic oligonucleotide"
aacugcaggagaacuacaaa

SEQ ID NO: 2183 - RNA, 20 nt, Artificial Sequence
  source: /note="Description of Artificial Sequence: Synthetic oligonucleotide"
aagguauaauguacgugcaa

SEQ ID NO: 2184 - RNA, 20 nt, Artificial Sequence
  source: /note="Description of Artificial Sequence: Synthetic oligonucleotide"
agguauaauguacgugcaau

SEQ ID NO: 2185 - RNA, 20 nt, Artificial Sequence
  source: /note="Description of Artificial Sequence: Synthetic oligonucleotide"
cauacuagaaaaagaaagaa

SEQ ID NO: 2186 - RNA, 20 nt, Artificial Sequence
  source: /note="Description of Artificial Sequence: Synthetic oligonucleotide"
gagcucaaagaacaccaagc

SEQ ID NO: 2187 - RNA, 20 nt, Artificial Sequence
  source: /note="Description of Artificial Sequence: Synthetic oligonucleotide"
aaaugucccaaaacuacuca

SEQ ID NO: 2188 - RNA, 20 nt, Artificial Sequence
  source: /note="Description of Artificial Sequence: Synthetic oligonucleotide"
aaugucccaaaacuacucau

SEQ ID NO: 2189 - RNA, 20 nt, Artificial Sequence
  source: /note="Description of Artificial Sequence: Synthetic oligonucleotide"
aaauaucgaaagaauccaga

SEQ ID NO: 2190 - RNA, 20 nt, Artificial Sequence
  source: /note="Description of Artificial Sequence: Synthetic oligonucleotide"
gaaggaaaaaacaccuauag

SEQ ID NO: 2191 - RNA, 20 nt, Artificial Sequence
  source: /note="Description of Artificial Sequence: Synthetic oligonucleotide"
aagauguugaaagaaaaauc

SEQ ID NO: 2192 - RNA, 20 nt, Artificial Sequence
  source: /note="Description of Artificial Sequence: Synthetic oligonucleotide"
aauccggcaguguacgauuc

SEQ ID NO: 2193 - RNA, 20 nt, Artificial Sequence
  source: /note="Description of Artificial Sequence: Synthetic oligonucleotide"
cuuaaagaaacaaaaauuuc

SEQ ID NO: 2194 - RNA, 20 nt, Artificial Sequence
  source: /note="Description of Artificial Sequence: Synthetic oligonucleotide"
uuucaggaauuuguugccag

SEQ ID NO: 2195 - RNA, 20 nt, Artificial Sequence
  source: /note="Description of Artificial Sequence: Synthetic oligonucleotide"
guuuaaaguucuuuagagag

SEQ ID NO: 2196 - RNA, 20 nt, Artificial Sequence
  source: /note="Description of Artificial Sequence: Synthetic oligonucleotide"
agagagagguaaaaugauac

SEQ ID NO: 2197 - RNA, 20 nt, Artificial Sequence
  source: /note="Description of Artificial Sequence: Synthetic oligonucleotide"
uagaaacucagauccacaua

SEQ ID NO: 2198 - RNA, 20 nt, Artificial Sequence
  source: /note="Description of Artificial Sequence: Synthetic oligonucleotide"
cacauaaggaaaauaaaauu

SEQ ID NO: 2199 - RNA, 20 nt, Artificial Sequence
  source: /note="Description of Artificial Sequence: Synthetic oligonucleotide"
acauaaggaaaauaaaauua

SEQ ID NO: 2200 - RNA, 20 nt, Artificial Sequence
  source: /note="Description of Artificial Sequence: Synthetic oligonucleotide"
uaagaucaagaacaagacaa

SEQ ID NO: 2201 - RNA, 20 nt, Artificial Sequence
  source: /note="Description of Artificial Sequence: Synthetic oligonucleotide"
cuuaccacuuuguuuccuac

SEQ ID NO: 2202 - RNA, 20 nt, Artificial Sequence
  source: /note="Description of Artificial Sequence: Synthetic oligonucleotide"
uaccuaaugcaauaagacaa

SEQ ID NO: 2203 - RNA, 20 nt, Artificial Sequence
  source: /note="Description of Artificial Sequence: Synthetic oligonucleotide"
aaugaaaagcauacagauuc

SEQ ID NO: 2204 - RNA, 20 nt, Artificial Sequence
  source: /note="Description of Artificial Sequence: Synthetic oligonucleotide"
gaaaagcauacagauuccgg

SEQ ID NO: 2205 - RNA, 20 nt, Artificial Sequence
  source: /note="Description of Artificial Sequence: Synthetic oligonucleotide"
aaucaaacugucuuuguuca

SEQ ID NO: 2206 - RNA, 20 nt, Artificial Sequence
  source: /note="Description of Artificial Sequence: Synthetic oligonucleotide"
acggaugacaguuguuuaua

SEQ ID NO: 2207 - RNA, 20 nt, Artificial Sequence
  source: /note="Description of Artificial Sequence: Synthetic oligonucleotide"
uguuuauauggaauauccaa

SEQ ID NO: 2208 - RNA, 20 nt, Artificial Sequence
  source: /note="Description of Artificial Sequence: Synthetic oligonucleotide"
aggaucagaaaaaagaaaac

SEQ ID NO: 2209 - RNA, 20 nt, Artificial Sequence
  source: /note="Description of Artificial Sequence: Synthetic oligonucleotide"
acuaauaaaugauuauugua

SEQ ID NO: 2210 - RNA, 20 nt, Artificial Sequence
  source: /note="Description of Artificial Sequence: Synthetic oligonucleotide"
aaacacagcacgauauuuua

SEQ ID NO: 2211 - RNA, 20 nt, Artificial Sequence
  source: /note="Description of Artificial Sequence: Synthetic oligonucleotide"
auuuuauggauaucaacaaa

SEQ ID NO: 2212 - RNA, 20 nt, Artificial Sequence
  source: /note="Description of Artificial Sequence: Synthetic oligonucleotide"
aaaggauucuaaaguuuaua

SEQ ID NO: 2213 - RNA, 20 nt, Artificial Sequence
  source: /note="Description of Artificial Sequence: Synthetic oligonucleotide"
auucuaaaguuuauauggag

SEQ ID NO: 2214 - RNA, 20 nt, Artificial Sequence
  source: /note="Description of Artificial Sequence: Synthetic oligonucleotide"
aauagccaacucaguauuug

SEQ ID NO: 2215 - RNA, 20 nt, Artificial Sequence
  source: /note="Description of Artificial Sequence: Synthetic oligonucleotide"
gaggagaacaacaaagucag

SEQ ID NO: 2216 - RNA, 20 nt, Artificial Sequence
  source: /note="Description of Artificial Sequence: Synthetic oligonucleotide"
gucagaggacugacacuacc

SEQ ID NO: 2217 - RNA, 20 nt, Artificial Sequence
  source: /note="Description of Artificial Sequence: Synthetic oligonucleotide"
agcucagauaaucaauguag

SEQ ID NO: 2218 - RNA, 20 nt, Artificial Sequence
  source: /note="Description of Artificial Sequence: Synthetic oligonucleotide"
gcucagauaaucaauguagu

SEQ ID NO: 2219 - RNA, 20 nt, Artificial Sequence
  source: /note="Description of Artificial Sequence: Synthetic oligonucleotide"
auaaucaauguaguggguac

SEQ ID NO: 2220 - RNA, 20 nt, Artificial Sequence
  source: /note="Description of Artificial Sequence: Synthetic oligonucleotide"
agaauauucaaauagaccaa

SEQ ID NO: 2221 - RNA, 20 nt, Artificial Sequence
  source: /note="Description of Artificial Sequence: Synthetic oligonucleotide"
uaaucaaaugaucuuugaca

SEQ ID NO: 2222 - RNA, 20 nt, Artificial Sequence
  source: /note="Description of Artificial Sequence: Synthetic oligonucleotide"
aaucaaaugaucuuugacaa

SEQ ID NO: 2223 - RNA, 20 nt, Artificial Sequence
  source: /note="Description of Artificial Sequence: Synthetic oligonucleotide"
gaucuuugacaagggagcaa

SEQ ID NO: 2224 - RNA, 20 nt, Artificial Sequence
  source: /note="Description of Artificial Sequence: Synthetic oligonucleotide"
agggagcaaaggcaauacaa

SEQ ID NO: 2225 - RNA, 20 nt, Artificial Sequence
  source: /note="Description of Artificial Sequence: Synthetic oligonucleotide"
gcaauacaauggagcaaaga

SEQ ID NO: 2226 - RNA, 20 nt, Artificial Sequence
  source: /note="Description of Artificial Sequence: Synthetic oligonucleotide"
gucuuuucaacaaauaaugc

SEQ ID NO: 2227 - RNA, 20 nt, Artificial Sequence
  source: /note="Description of Artificial Sequence: Synthetic oligonucleotide"
aaacucccagaagauaacac

SEQ ID NO: 2228 - RNA, 20 nt, Artificial Sequence
  source: /note="Description of Artificial Sequence: Synthetic oligonucleotide"
ggaaaaauccuagaugacuu

SEQ ID NO: 2229 - RNA, 20 nt, Artificial Sequence
  source: /note="Description of Artificial Sequence: Synthetic oligonucleotide"
aauccuagaugacuuuggua

SEQ ID NO: 2230 - RNA, 20 nt, Artificial Sequence
  source: /note="Description of Artificial Sequence: Synthetic oligonucleotide"
agaugacuuugguauggcag

SEQ ID NO: 2231 - RNA, 20 nt, Artificial Sequence
  source: /note="Description of Artificial Sequence: Synthetic oligonucleotide"
uuuuuuagauacagcuccaa

SEQ ID NO: 2232 - RNA, 20 nt, Artificial Sequence
  source: /note="Description of Artificial Sequence: Synthetic oligonucleotide"
uccaaaggcacgauacauga

SEQ ID NO: 2233 - RNA, 20 nt, Artificial Sequence
  source: /note="Description of Artificial Sequence: Synthetic oligonucleotide"
gaaggaaaugauugacaagc

SEQ ID NO: 2234 - RNA, 20 nt, Artificial Sequence
  source: /note="Description of Artificial Sequence: Synthetic oligonucleotide"
augagaagacaagccacaga

SEQ ID NO: 2235 - RNA, 20 nt, Artificial Sequence
  source: /note="Description of Artificial Sequence: Synthetic oligonucleotide"
gcaaaagauacuucucauaa

SEQ ID NO: 2236 - RNA, 20 nt, Artificial Sequence
  source: /note="Description of Artificial Sequence: Synthetic oligonucleotide"
cacaagugucaagaaagcau

SEQ ID NO: 2237 - RNA, 20 nt, Artificial Sequence
  source: /note="Description of Artificial Sequence: Synthetic oligonucleotide"
uguuaaacaucauagucauu

SEQ ID NO: 2238 - RNA, 20 nt, Artificial Sequence
  source: /note="Description of Artificial Sequence: Synthetic oligonucleotide"
guuaaacaucauagucauua

SEQ ID NO: 2239 - RNA, 20 nt, Artificial Sequence
  source: /note="Description of Artificial Sequence: Synthetic oligonucleotide"
ccgcuacauaccuguuagaa

SEQ ID NO: 2240 - RNA, 20 nt, Artificial Sequence
  source: /note="Description of Artificial Sequence: Synthetic oligonucleotide"
acacugaugaaaccaagugc

SEQ ID NO: 2241 - RNA, 20 nt, Artificial Sequence
  source: /note="Description of Artificial Sequence: Synthetic oligonucleotide"
accaagugcuggugagaaug

SEQ ID NO: 2242 - RNA, 20 nt, Artificial Sequence
  source: /note="Description of Artificial Sequence: Synthetic oligonucleotide"
uggugagaauguggagcaac

SEQ ID NO: 2243 - RNA, 20 nt, Artificial Sequence
  source: /note="Description of Artificial Sequence: Synthetic oligonucleotide"
caggaaccuucauucauugc

SEQ ID NO: 2244 - RNA, 20 nt, Artificial Sequence
  source: /note="Description of Artificial Sequence: Synthetic oligonucleotide"
uugcugguaagaauucaaaa

SEQ ID NO: 2245 - RNA, 20 nt, Artificial Sequence
  source: /note="Description of Artificial Sequence: Synthetic oligonucleotide"
ucaaaauggcauagucacuu

SEQ ID NO: 2246 - RNA, 20 nt, Artificial Sequence
  source: /note="Description of Artificial Sequence: Synthetic oligonucleotide"
agucacuuuggaagacaguu

SEQ ID NO: 2247 - RNA, 20 nt, Artificial Sequence
  source: /note="Description of Artificial Sequence: Synthetic oligonucleotide"
gauucagcaauagcgcuccu

SEQ ID NO: 2248 - RNA, 20 nt, Artificial Sequence
  source: /note="Description of Artificial Sequence: Synthetic oligonucleotide"
agcaauagcgcuccuuggua

SEQ ID NO: 2249 - RNA, 20 nt, Artificial Sequence
  source: /note="Description of Artificial Sequence: Synthetic oligonucleotide"
ggacuugaaaacuuaugucc

SEQ ID NO: 2250 - RNA, 20 nt, Artificial Sequence
  source: /note="Description of Artificial Sequence: Synthetic oligonucleotide"
uugaaaacuuauguccuggc

SEQ ID NO: 2251 - RNA, 20 nt, Artificial Sequence
  source: /note="Description of Artificial Sequence: Synthetic oligonucleotide"
ugaaaacuuauguccuggcc

SEQ ID NO: 2252 - RNA, 20 nt, Artificial Sequence
  source: /note="Description of Artificial Sequence: Synthetic oligonucleotide"
cgccuguaauugcagcacuu

SEQ ID NO: 2253 - RNA, 20 nt, Artificial Sequence
  source: /note="Description of Artificial Sequence: Synthetic oligonucleotide"
gccuguaauugcagcacuuu

SEQ ID NO: 2254 - RNA, 20 nt, Artificial Sequence
  source: /note="Description of Artificial Sequence: Synthetic oligonucleotide"
uguaauugcagcacuuuggg

SEQ ID NO: 2255 - RNA, 20 nt, Artificial Sequence
  source: /note="Description of Artificial Sequence: Synthetic oligonucleotide"
ugcagcacuuugggaggccc

SEQ ID NO: 2256 - RNA, 20 nt, Artificial Sequence
  source: /note="Description of Artificial Sequence: Synthetic oligonucleotide"
gcacuuugggaggcccaggc

SEQ ID NO: 2257 - RNA, 20 nt, Artificial Sequence
  source: /note="Description of Artificial Sequence: Synthetic oligonucleotide"
cuuugggaggcccaggcagg

SEQ ID NO: 2258 - RNA, 20 nt, Artificial Sequence
  source: /note="Description of Artificial Sequence: Synthetic oligonucleotide"
ccaggcagguggaucauuug

SEQ ID NO: 2259 - RNA, 20 nt, Artificial Sequence
  source: /note="Description of Artificial Sequence: Synthetic oligonucleotide"
cagguggaucauuugagguc

SEQ ID NO: 2260 - RNA, 20 nt, Artificial Sequence
  source: /note="Description of Artificial Sequence: Synthetic oligonucleotide"
ucaggaguucaagaccagcc

SEQ ID NO: 2261 - RNA, 20 nt, Artificial Sequence
  source: /note="Description of Artificial Sequence: Synthetic oligonucleotide"
accagccuggugaaauccca

SEQ ID NO: 2262 - RNA, 20 nt, Artificial Sequence
  source: /note="Description of Artificial Sequence: Synthetic oligonucleotide"
uaaagauacaaaaaaguagc

SEQ ID NO: 2263 - RNA, 20 nt, Artificial Sequence
  source: /note="Description of Artificial Sequence: Synthetic oligonucleotide"
aaagauacaaaaaaguagcu

SEQ ID NO: 2264 - RNA, 20 nt, Artificial Sequence
  source: /note="Description of Artificial Sequence: Synthetic oligonucleotide"
uacaaaaaaguagcugggug

SEQ ID NO: 2265 - RNA, 20 nt, Artificial Sequence
  source: /note="Description of Artificial Sequence: Synthetic oligonucleotide"
cgccuguaaucucagcuacu

SEQ ID NO: 2266 - RNA, 20 nt, Artificial Sequence
  source: /note="Description of Artificial Sequence: Synthetic oligonucleotide"
gccuguaaucucagcuacua

SEQ ID NO: 2267 - RNA, 20 nt, Artificial Sequence
  source: /note="Description of Artificial Sequence: Synthetic oligonucleotide"
uguaaucucagcuacuaggg

SEQ ID NO: 2268 - RNA, 20 nt, Artificial Sequence
  source: /note="Description of Artificial Sequence: Synthetic oligonucleotide"
cucagcuacuagggaggcug

SEQ ID NO: 2269 - RNA, 20 nt, Artificial Sequence
  source: /note="Description of Artificial Sequence: Synthetic oligonucleotide"
gcuacuagggaggcugaggc

SEQ ID NO: 2270 - RNA, 20 nt, Artificial Sequence
  source: /note="Description of Artificial Sequence: Synthetic oligonucleotide"
caggagaaucacuugagccc

SEQ ID NO: 2271 - RNA, 20 nt, Artificial Sequence
  source: /note="Description of Artificial Sequence: Synthetic oligonucleotide"
gagaaucacuugagcccagg

SEQ ID NO: 2272 - RNA, 20 nt, Artificial Sequence
  source: /note="Description of Artificial Sequence: Synthetic oligonucleotide"
aaucacuugagcccaggagg

SEQ ID NO: 2273 - RNA, 20 nt, Artificial Sequence
  source: /note="Description of Artificial Sequence: Synthetic oligonucleotide"
cacuugagcccaggaggcgg

SEQ ID NO: 2274 - RNA, 20 nt, Artificial Sequence
  source: /note="Description of Artificial Sequence: Synthetic oligonucleotide"
uuuacauaauugccaaaacu

SEQ ID NO: 2275 - RNA, 20 nt, Artificial Sequence
  source: /note="Description of Artificial Sequence: Synthetic oligonucleotide"
uuacauaauugccaaaacuu

SEQ ID NO: 2276 - RNA, 20 nt, Artificial Sequence
  source: /note="Description of Artificial Sequence: Synthetic oligonucleotide"
gauauccuuuaauauuugag

SEQ ID NO: 2277 - RNA, 20 nt, Artificial Sequence
  source: /note="Description of Artificial Sequence: Synthetic oligonucleotide"
auauuugaguggauaaacug

SEQ ID NO: 2278 - RNA, 20 nt, Artificial Sequence
  source: /note="Description of Artificial Sequence: Synthetic oligonucleotide"
uaucacaucauaaaacgaca

SEQ ID NO: 2279 - RNA, 20 nt, Artificial Sequence
  source: /note="Description of Artificial Sequence: Synthetic oligonucleotide"
ugaaagaagcuaauccgaaa

SEQ ID NO: 2280 - RNA, 20 nt, Artificial Sequence
  source: /note="Description of Artificial Sequence: Synthetic oligonucleotide"
auuccaacuauaugacauuc

SEQ ID NO: 2281 - RNA, 20 nt, Artificial Sequence
  source: /note="Description of Artificial Sequence: Synthetic oligonucleotide"
uuccggaaaagccaaaauua

SEQ ID NO: 2282 - RNA, 20 nt, Artificial Sequence
  source: /note="Description of Artificial Sequence: Synthetic oligonucleotide"
aaaagagcaguguuuuccag

SEQ ID NO: 2283 - RNA, 20 nt, Artificial Sequence
  source: /note="Description of Artificial Sequence: Synthetic oligonucleotide"
aaagagcaguguuuuccaga

SEQ ID NO: 2284 - RNA, 20 nt, Artificial Sequence
  source: /note="Description of Artificial Sequence: Synthetic oligonucleotide"
gagcaguguuuuccagaggg

SEQ ID NO: 2285 - RNA, 20 nt, Artificial Sequence
  source: /note="Description of Artificial Sequence: Synthetic oligonucleotide"
uuccagagggaggaauguau

SEQ ID NO: 2286 - RNA, 20 nt, Artificial Sequence
  source: /note="Description of Artificial Sequence: Synthetic oligonucleotide"
gaaucuauguaauacuauag

SEQ ID NO: 2287 - RNA, 20 nt, Artificial Sequence
  source: /note="Description of Artificial Sequence: Synthetic oligonucleotide"
ucuauguaauacuauagugg

SEQ ID NO: 2288 - RNA, 20 nt, Artificial Sequence
  source: /note="Description of Artificial Sequence: Synthetic oligonucleotide"
auacauuuguccaaacacgu

SEQ ID NO: 2289 - RNA, 20 nt, Artificial Sequence
  source: /note="Description of Artificial Sequence: Synthetic oligonucleotide"
gugaacccuaauguaaacua

SEQ ID NO: 2290 - RNA, 20 nt, Artificial Sequence
  source: /note="Description of Artificial Sequence: Synthetic oligonucleotide"
ugaacccuaauguaaacuau

SEQ ID NO: 2291 - RNA, 20 nt, Artificial Sequence
  source: /note="Description of Artificial Sequence: Synthetic oligonucleotide"
gaacccuaauguaaacuaug

SEQ ID NO: 2292 - RNA, 20 nt, Artificial Sequence
  source: /note="Description of Artificial Sequence: Synthetic oligonucleotide"
cuaauguaaacuaugggguu

SEQ ID NO: 2293 - RNA, 20 nt, Artificial Sequence
  source: /note="Description of Artificial Sequence: Synthetic oligonucleotide"
uaauguaaacuaugggguuu

SEQ ID NO: 2294 - RNA, 20 nt, Artificial Sequence
  source: /note="Description of Artificial Sequence: Synthetic oligonucleotide"
guaucaaaaugcaucaaugu

SEQ ID NO: 2295 - RNA, 20 nt, Artificial Sequence
  source: /note="Description of Artificial Sequence: Synthetic oligonucleotide"
uuguaacaaauauaccacuc

SEQ ID NO: 2296 - RNA, 20 nt, Artificial Sequence
  source: /note="Description of Artificial Sequence: Synthetic oligonucleotide"
acaaauauaccacucuggua

SEQ ID NO: 2297 - RNA, 20 nt, Artificial Sequence
  source: /note="Description of Artificial Sequence: Synthetic oligonucleotide"
caaauauaccacucugguau

SEQ ID NO: 2298 - RNA, 20 nt, Artificial Sequence
  source: /note="Description of Artificial Sequence: Synthetic oligonucleotide"
cugguaugggauguugauaa

SEQ ID NO: 2299 - RNA, 20 nt, Artificial Sequence
  source: /note="Description of Artificial Sequence: Synthetic oligonucleotide"
ugguaugggauguugauaau

SEQ ID NO: 2300 - RNA, 20 nt, Artificial Sequence
  source: /note="Description of Artificial Sequence: Synthetic oligonucleotide"
gguaugggauguugauaaug

SEQ ID NO: 2301 - RNA, 20 nt, Artificial Sequence
  source: /note="Description of Artificial Sequence: Synthetic oligonucleotide"
ugggauguugauaaugggga

SEQ ID NO: 2302 - RNA, 20 nt, Artificial Sequence
  source: /note="Description of Artificial Sequence: Synthetic oligonucleotide"
guugauaauggggaagguug

SEQ ID NO: 2303 - RNA, 20 nt, Artificial Sequence
  source: /note="Description of Artificial Sequence: Synthetic oligonucleotide"
uugauaauggggaagguugu

SEQ ID NO: 2304 - RNA, 20 nt, Artificial Sequence
  source: /note="Description of Artificial Sequence: Synthetic oligonucleotide"
uggggaagguugugggucug

SEQ ID NO: 2305 - RNA, 20 nt, Artificial Sequence
  source: /note="Description of Artificial Sequence: Synthetic oligonucleotide"
ggggaagguugugggucugu

SEQ ID NO: 2306 - RNA, 20 nt, Artificial Sequence
  source: /note="Description of Artificial Sequence: Synthetic oligonucleotide"
gggaagguugugggucugug

SEQ ID NO: 2307 - RNA, 20 nt, Artificial Sequence
  source: /note="Description of Artificial Sequence: Synthetic oligonucleotide"
gguugugggucuguggggac

SEQ ID NO: 2308 - RNA, 20 nt, Artificial Sequence
  source: /note="Description of Artificial Sequence: Synthetic oligonucleotide"
guugugggucuguggggaca

SEQ ID NO: 2309 - RNA, 20 nt, Artificial Sequence
  source: /note="Description of Artificial Sequence: Synthetic oligonucleotide"
uugugggucuguggggacag

SEQ ID NO: 2310 - RNA, 20 nt, Artificial Sequence
  source: /note="Description of Artificial Sequence: Synthetic oligonucleotide"
ucuguggggacagggguaua

SEQ ID NO: 2311 - RNA, 20 nt, Artificial Sequence
  source: /note="Description of Artificial Sequence: Synthetic oligonucleotide"
cuguggggacagggguauau

SEQ ID NO: 2312 - RNA, 20 nt, Artificial Sequence
  source: /note="Description of Artificial Sequence: Synthetic oligonucleotide"
aauaauaauaaaauaaauuu

SEQ ID NO: 2313 - RNA, 20 nt, Artificial Sequence
  source: /note="Description of Artificial Sequence: Synthetic oligonucleotide"
ugagacugaguaauuuauaa

SEQ ID NO: 2314 - RNA, 20 nt, Artificial Sequence
  source: /note="Description of Artificial Sequence: Synthetic oligonucleotide"
aauugacucacaguuuagca

SEQ ID NO: 2315 - RNA, 20 nt, Artificial Sequence
  source: /note="Description of Artificial Sequence: Synthetic oligonucleotide"
gacucacaguuuagcauggc

SEQ ID NO: 2316 - RNA, 20 nt, Artificial Sequence
  source: /note="Description of Artificial Sequence: Synthetic oligonucleotide"
acucacaguuuagcauggcu

SEQ ID NO: 2317 - RNA, 20 nt, Artificial Sequence
  source: /note="Description of Artificial Sequence: Synthetic oligonucleotide"
cucacaguuuagcauggcug

SEQ ID NO: 2318 - RNA, 20 nt, Artificial Sequence
  source: /note="Description of Artificial Sequence: Synthetic oligonucleotide"
acaguuuagcauggcugggg

SEQ ID NO: 2319 - RNA, 20 nt, Artificial Sequence
  source: /note="Description of Artificial Sequence: Synthetic oligonucleotide"
agcauggcuggggaggucuc

SEQ ID NO: 2320 - RNA, 20 nt, Artificial Sequence
  source: /note="Description of Artificial Sequence: Synthetic oligonucleotide"
cucaggaaacuuaacaguca

SEQ ID NO: 2321 - RNA, 20 nt, Artificial Sequence
  source: /note="Description of Artificial Sequence: Synthetic oligonucleotide"
ggaaacuuaacagucauggc

SEQ ID NO: 2322 - RNA, 20 nt, Artificial Sequence
  source: /note="Description of Artificial Sequence: Synthetic oligonucleotide"
uggcaggugacuucacaaag

SEQ ID NO: 2323 - RNA, 20 nt, Artificial Sequence
  source: /note="Description of Artificial Sequence: Synthetic oligonucleotide"
aggugacuucacaaaguggc

SEQ ID NO: 2324 - RNA, 20 nt, Artificial Sequence
  source: /note="Description of Artificial Sequence: Synthetic oligonucleotide"
gacuucacaaaguggcagga

SEQ ID NO: 2325 - RNA, 20 nt, Artificial Sequence
  source: /note="Description of Artificial Sequence: Synthetic oligonucleotide"
ucccuaugaugagaacagca

SEQ ID NO: 2326 - RNA, 20 nt, Artificial Sequence
  source: /note="Description of Artificial Sequence: Synthetic oligonucleotide"
cccuaugaugagaacagcau

SEQ ID NO: 2327 - RNA, 20 nt, Artificial Sequence
  source: /note="Description of Artificial Sequence: Synthetic oligonucleotide"
ccuaugaugagaacagcaug

SEQ ID NO: 2328 - RNA, 20 nt, Artificial Sequence
  source: /note="Description of Artificial Sequence: Synthetic oligonucleotide"
cuaugaugagaacagcaugg

SEQ ID NO: 2329 - RNA, 20 nt, Artificial Sequence
  source: /note="Description of Artificial Sequence: Synthetic oligonucleotide"
augauccaauuacuuccacc

SEQ ID NO: 2330 - RNA, 20 nt, Artificial Sequence
  source: /note="Description of Artificial Sequence: Synthetic oligonucleotide"
cuggucucugccuugacaca

SEQ ID NO: 2331 - RNA, 20 nt, Artificial Sequence
  source: /note="Description of Artificial Sequence: Synthetic oligonucleotide"
uggucucugccuugacacau

SEQ ID NO: 2332 - RNA, 20 nt, Artificial Sequence
  source: /note="Description of Artificial Sequence: Synthetic oligonucleotide"
gccuugacacauggguauua

SEQ ID NO: 2333 - RNA, 20 nt, Artificial Sequence
  source: /note="Description of Artificial Sequence: Synthetic oligonucleotide"
cauggguauuauggagauua

SEQ ID NO: 2334 - RNA, 20 nt, Artificial Sequence
  source: /note="Description of Artificial Sequence: Synthetic oligonucleotide"
auggguauuauggagauuau

SEQ ID NO: 2335 - RNA, 20 nt, Artificial Sequence
  source: /note="Description of Artificial Sequence: Synthetic oligonucleotide"
uggguauuauggagauuaug

SEQ ID NO: 2336 - RNA, 20 nt, Artificial Sequence
  source: /note="Description of Artificial Sequence: Synthetic oligonucleotide"
uuauaauucaagaugagauu

SEQ ID NO: 2337 - RNA, 20 nt, Artificial Sequence
  source: /note="Description of Artificial Sequence: Synthetic oligonucleotide"
uauaauucaagaugagauuu

SEQ ID NO: 2338 - RNA, 20 nt, Artificial Sequence
  source: /note="Description of Artificial Sequence: Synthetic oligonucleotide"
aauucaagaugagauuuggg

SEQ ID NO: 2339 - RNA, 20 nt, Artificial Sequence
  source: /note="Description of Artificial Sequence: Synthetic oligonucleotide"
auucaagaugagauuugggu

SEQ ID NO: 2340 - RNA, 20 nt, Artificial Sequence
  source: /note="Description of Artificial Sequence: Synthetic oligonucleotide"
uucaagaugagauuugggug

SEQ ID NO: 2341 - RNA, 20 nt, Artificial Sequence
  source: /note="Description of Artificial Sequence: Synthetic oligonucleotide"
aaacuaugucuuuucuuuua

SEQ ID NO: 2342 - RNA, 20 nt, Artificial Sequence
  source: /note="Description of Artificial Sequence: Synthetic oligonucleotide"
aacuaugucuuuucuuuuau

SEQ ID NO: 2343 - RNA, 20 nt, Artificial Sequence
  source: /note="Description of Artificial Sequence: Synthetic oligonucleotide"
acuaugucuuuucuuuuaug

SEQ ID NO: 2344 - RNA, 20 nt, Artificial Sequence
  source: /note="Description of Artificial Sequence: Synthetic oligonucleotide"
gaccuccauuuuccaauuuc

SEQ ID NO: 2345 - RNA, 20 nt, Artificial Sequence
  source: /note="Description of Artificial Sequence: Synthetic oligonucleotide"
ccauuuuccaauuucugguu

SEQ ID NO: 2346 - RNA, 20 nt, Artificial Sequence
  source: /note="Description of Artificial Sequence: Synthetic oligonucleotide"
aaucuuucauuaaaagaaau

SEQ ID NO: 2347 - RNA, 20 nt, Artificial Sequence
  source: /note="Description of Artificial Sequence: Synthetic oligonucleotide"
aucuuucauuaaaagaaaua

SEQ ID NO: 2348 - RNA, 20 nt, Artificial Sequence
  source: /note="Description of Artificial Sequence: Synthetic oligonucleotide"
ucuuucauuaaaagaaauag

SEQ ID NO: 2349 - RNA, 20 nt, Artificial Sequence
  source: /note="Description of Artificial Sequence: Synthetic oligonucleotide"
uucauuaaaagaaauagggg

SEQ ID NO: 2350 - RNA, 20 nt, Artificial Sequence
  source: /note="Description of Artificial Sequence: Synthetic oligonucleotide"
aaaagaaauaggggagguga

SEQ ID NO: 2351 - RNA, 20 nt, Artificial Sequence
  source: /note="Description of Artificial Sequence: Synthetic oligonucleotide"
aaagaaauaggggaggugau

SEQ ID NO: 2352 - RNA, 20 nt, Artificial Sequence
  source: /note="Description of Artificial Sequence: Synthetic oligonucleotide"
aagaaauaggggaggugaug

SEQ ID NO: 2353 - RNA, 20 nt, Artificial Sequence
  source: /note="Description of Artificial Sequence: Synthetic oligonucleotide"
agaaauaggggaggugaugg

SEQ ID NO: 2354 - RNA, 20 nt, Artificial Sequence
  source: /note="Description of Artificial Sequence: Synthetic oligonucleotide"
gggauauccaugagugucca

SEQ ID NO: 2355 - RNA, 20 nt, Artificial Sequence
  source: /note="Description of Artificial Sequence: Synthetic oligonucleotide"
ggauauccaugaguguccau

SEQ ID NO: 2356 - RNA, 20 nt, Artificial Sequence
  source: /note="Description of Artificial Sequence: Synthetic oligonucleotide"
augauacugcaaagccuaca

SEQ ID NO: 2357 - RNA, 20 nt, Artificial Sequence
  source: /note="Description of Artificial Sequence: Synthetic oligonucleotide"
aucuuguuucauuuuaugug

SEQ ID NO: 2358 - RNA, 20 nt, Artificial Sequence
  source: /note="Description of Artificial Sequence: Synthetic oligonucleotide"
ugaaaaauauccucuucauu

SEQ ID NO: 2359 - RNA, 20 nt, Artificial Sequence
  source: /note="Description of Artificial Sequence: Synthetic oligonucleotide"
gaaaaauauccucuucauuu

SEQ ID NO: 2360 - RNA, 20 nt, Artificial Sequence
  source: /note="Description of Artificial Sequence: Synthetic oligonucleotide"
auaaugcaugacuucauuca

SEQ ID NO: 2361 - RNA, 20 nt, Artificial Sequence
  source: /note="Description of Artificial Sequence: Synthetic oligonucleotide"
gacuucauucauggcucucu

SEQ ID NO: 2362 - RNA, 20 nt, Artificial Sequence
  source: /note="Description of Artificial Sequence: Synthetic oligonucleotide"
gugaccuguguacccugacc

SEQ ID NO: 2363 - RNA, 20 nt, Artificial Sequence
  source: /note="Description of Artificial Sequence: Synthetic oligonucleotide"
agaguauuaagucauuucag

SEQ ID NO: 2364 - RNA, 20 nt, Artificial Sequence
  source: /note="Description of Artificial Sequence: Synthetic oligonucleotide"
auuucaguggcacauguuug

SEQ ID NO: 2365 - RNA, 20 nt, Artificial Sequence
  source: /note="Description of Artificial Sequence: Synthetic oligonucleotide"
uuucaguggcacauguuuga

SEQ ID NO: 2366 - RNA, 20 nt, Artificial Sequence
  source: /note="Description of Artificial Sequence: Synthetic oligonucleotide"
agggaagauugacaucccac

SEQ ID NO: 2367 - RNA, 20 nt, Artificial Sequence
  source: /note="Description of Artificial Sequence: Synthetic oligonucleotide"
aagcagcugcauuccuagug

SEQ ID NO: 2368 - RNA, 20 nt, Artificial Sequence
  source: /note="Description of Artificial Sequence: Synthetic oligonucleotide"
auuaaguuuaucccacuauu

SEQ ID NO: 2369 - RNA, 20 nt, Artificial Sequence
  source: /note="Description of Artificial Sequence: Synthetic oligonucleotide"
uuuaucccacuauuagguuc

SEQ ID NO: 2370 - RNA, 20 nt, Artificial Sequence
  source: /note="Description of Artificial Sequence: Synthetic oligonucleotide"
uauuacuugucaugcccaag

SEQ ID NO: 2371 - RNA, 20 nt, Artificial Sequence
  source: /note="Description of Artificial Sequence: Synthetic oligonucleotide"
uuucuagcaugcagaguauc

SEQ ID NO: 2372 - RNA, 20 nt, Artificial Sequence
  source: /note="Description of Artificial Sequence: Synthetic oligonucleotide"
gcagaguaucugguuuuuaa

SEQ ID NO: 2373 - RNA, 20 nt, Artificial Sequence
  source: /note="Description of Artificial Sequence: Synthetic oligonucleotide"
gaaauaaaaugugccuacua

SEQ ID NO: 2374 - RNA, 20 nt, Artificial Sequence
  source: /note="Description of Artificial Sequence: Synthetic oligonucleotide"
aaauaaaaugugccuacuaa

SEQ ID NO: 2375 - RNA, 20 nt, Artificial Sequence
  source: /note="Description of Artificial Sequence: Synthetic oligonucleotide"
ucuuucacuguuuuuuuucu

SEQ ID NO: 2376 - RNA, 20 nt, Artificial Sequence
  source: /note="Description of Artificial Sequence: Synthetic oligonucleotide"
uucacuguuuuuuuucuugg

SEQ ID NO: 2377 - RNA, 20 nt, Artificial Sequence
  source: /note="Description of Artificial Sequence: Synthetic oligonucleotide"
uuacaguaguuaugccuuuc

SEQ ID NO: 2378 - RNA, 20 nt, Artificial Sequence
  source: /note="Description of Artificial Sequence: Synthetic oligonucleotide"
guuaugccuuucuggucagc

SEQ ID NO: 2379 - RNA, 20 nt, Artificial Sequence
  source: /note="Description of Artificial Sequence: Synthetic oligonucleotide"
cuuucacaucuucaagugua

SEQ ID NO: 2380 - RNA, 20 nt, Artificial Sequence
  source: /note="Description of Artificial Sequence: Synthetic oligonucleotide"
cuuucaguauugauuucuca

SEQ ID NO: 2381 - RNA, 20 nt, Artificial Sequence
  source: /note="Description of Artificial Sequence: Synthetic oligonucleotide"
ccuaugaaccugagucaacu

SEQ ID NO: 2382 - RNA, 20 nt, Artificial Sequence
  source: /note="Description of Artificial Sequence: Synthetic oligonucleotide"
ccugagucaacuuggcauaa

SEQ ID NO: 2383 - RNA, 20 nt, Artificial Sequence
  source: /note="Description of Artificial Sequence: Synthetic oligonucleotide"
uucucuaaaugcagagucag

SEQ ID NO: 2384 - RNA, 20 nt, Artificial Sequence
  source: /note="Description of Artificial Sequence: Synthetic oligonucleotide"
gcucagugauaacauuaaaa

SEQ ID NO: 2385 - RNA, 20 nt, Artificial Sequence
  source: /note="Description of Artificial Sequence: Synthetic oligonucleotide"
aaaucucagucauuaauaca

SEQ ID NO: 2386 - RNA, 20 nt, Artificial Sequence
  source: /note="Description of Artificial Sequence: Synthetic oligonucleotide"
ucucagucauuaauacaugg

SEQ ID NO: 2387 - RNA, 20 nt, Artificial Sequence
  source: /note="Description of Artificial Sequence: Synthetic oligonucleotide"
uauuacaugccugugcuucu

SEQ ID NO: 2388 - RNA, 20 nt, Artificial Sequence
  source: /note="Description of Artificial Sequence: Synthetic oligonucleotide"
uuaucuuuuuuuguuuuacc

SEQ ID NO: 2389 - RNA, 20 nt, Artificial Sequence
  source: /note="Description of Artificial Sequence: Synthetic oligonucleotide"
aauauucuccaugaucucca

SEQ ID NO: 2390 - RNA, 20 nt, Artificial Sequence
  source: /note="Description of Artificial Sequence: Synthetic oligonucleotide"
uaucauuuuuuuuuuuuucu

SEQ ID NO: 2391 - RNA, 20 nt, Artificial Sequence
  source: /note="Description of Artificial Sequence: Synthetic oligonucleotide"
acagucucacucuguugccc

SEQ ID NO: 2392 - RNA, 20 nt, Artificial Sequence
  source: /note="Description of Artificial Sequence: Synthetic oligonucleotide"
ucucacucuguugcccaggc

SEQ ID NO: 2393 - RNA, 20 nt, Artificial Sequence
  source: /note="Description of Artificial Sequence: Synthetic oligonucleotide"
cucacucuguugcccaggcu

SEQ ID NO: 2394 - RNA, 20 nt, Artificial Sequence
  source: /note="Description of Artificial Sequence: Synthetic oligonucleotide"
auucuccugccucagccugc

SEQ ID NO: 2395 - RNA, 20 nt, Artificial Sequence
  source: /note="Description of Artificial Sequence: Synthetic oligonucleotide"
uucuccugccucagccugcc

SEQ ID NO: 2396 - RNA, 20 nt, Artificial Sequence
  source: /note="Description of Artificial Sequence: Synthetic oligonucleotide"
ugccggguagcuagaauuac

SEQ ID NO: 2397 - RNA, 20 nt, Artificial Sequence
  source: /note="Description of Artificial Sequence: Synthetic oligonucleotide"
caggcaugugccaccacacc

SEQ ID NO: 2398 - RNA, 20 nt, Artificial Sequence
  source: /note="Description of Artificial Sequence: Synthetic oligonucleotide"
ucuguauuuuuaguagagac

SEQ ID NO: 2399 - RNA, 20 nt, Artificial Sequence
  source: /note="Description of Artificial Sequence: Synthetic oligonucleotide"
cuguauuuuuaguagagaca

SEQ ID NO: 2400 - RNA, 20 nt, Artificial Sequence
  source: /note="Description of Artificial Sequence: Synthetic oligonucleotide"
gagacaggguuucacgaugu

SEQ ID NO: 2401 - RNA, 20 nt, Artificial Sequence
  source: /note="Description of Artificial Sequence: Synthetic oligonucleotide"
uuucacgauguuggccagac

SEQ ID NO: 2402 - RNA, 20 nt, Artificial Sequence
  source: /note="Description of Artificial Sequence: Synthetic oligonucleotide"
ggucuugaacuccugaccuc

SEQ ID NO: 2403 - RNA, 20 nt, Artificial Sequence
  source: /note="Description of Artificial Sequence: Synthetic oligonucleotide"
accgcagccucccaaagugc

SEQ ID NO: 2404 - RNA, 20 nt, Artificial Sequence
  source: /note="Description of Artificial Sequence: Synthetic oligonucleotide"
ucccaaagugcuggaauuac

SEQ ID NO: 2405 - RNA, 20 nt, Artificial Sequence
  source: /note="Description of Artificial Sequence: Synthetic oligonucleotide"
gugcuggaauuacaggcgug

SEQ ID NO: 2406 - RNA, 20 nt, Artificial Sequence
  source: /note="Description of Artificial Sequence: Synthetic oligonucleotide"
caggcgugaggcacugcauc

SEQ ID NO: 2407 - RNA, 20 nt, Artificial Sequence
  source: /note="Description of Artificial Sequence: Synthetic oligonucleotide"
gcuacgaucuauauacuccu

SEQ ID NO: 2408 - RNA, 20 nt, Artificial Sequence
  source: /note="Description of Artificial Sequence: Synthetic oligonucleotide"
ugugugugucuguauaguag

SEQ ID NO: 2409 - RNA, 20 nt, Artificial Sequence
  source: /note="Description of Artificial Sequence: Synthetic oligonucleotide"
uagucacaauaugcuuuuug

SEQ ID NO: 2410 - RNA, 20 nt, Artificial Sequence
  source: /note="Description of Artificial Sequence: Synthetic oligonucleotide"
uuugaggauuuuccuuuucc

SEQ ID NO: 2411 - RNA, 20 nt, Artificial Sequence
  source: /note="Description of Artificial Sequence: Synthetic oligonucleotide"
uugaggauuuuccuuuuccu

SEQ ID NO: 2412 - RNA, 20 nt, Artificial Sequence
  source: /note="Description of Artificial Sequence: Synthetic oligonucleotide"
cucuuccaucuuagaagagc

SEQ ID NO: 2413 - RNA, 20 nt, Artificial Sequence
  source: /note="Description of Artificial Sequence: Synthetic oligonucleotide"
aaccgacucuucuuuuaucu

SEQ ID NO: 2414 - RNA, 20 nt, Artificial Sequence
  source: /note="Description of Artificial Sequence: Synthetic oligonucleotide"
ucuugguuucuacaacacag

SEQ ID NO: 2415 - RNA, 20 nt, Artificial Sequence
  source: /note="Description of Artificial Sequence: Synthetic oligonucleotide"
acuuuaaucccuuuuaacac

SEQ ID NO: 2416 - RNA, 20 nt, Artificial Sequence
  source: /note="Description of Artificial Sequence: Synthetic oligonucleotide"
aaaaucuagcaaauaaaaaa

SEQ ID NO: 2417 - RNA, 20 nt, Artificial Sequence
  source: /note="Description of Artificial Sequence: Synthetic oligonucleotide"
auuaugauaugcuuauucau

SEQ ID NO: 2418 - RNA, 20 nt, Artificial Sequence
  source: /note="Description of Artificial Sequence: Synthetic oligonucleotide"
gcaauaguguagccccuucu

SEQ ID NO: 2419 - RNA, 20 nt, Artificial Sequence
  source: /note="Description of Artificial Sequence: Synthetic oligonucleotide"
uuguuauaaaaauacucauu

SEQ ID NO: 2420 - RNA, 20 nt, Artificial Sequence
  source: /note="Description of Artificial Sequence: Synthetic oligonucleotide"
uuauacuacuuucuuuauuu

SEQ ID NO: 2421 - RNA, 20 nt, Artificial Sequence
  source: /note="Description of Artificial Sequence: Synthetic oligonucleotide"
uauacuacuuucuuuauuua

SEQ ID NO: 2422 - RNA, 20 nt, Artificial Sequence
  source: /note="Description of Artificial Sequence: Synthetic oligonucleotide"
acuacuuucuuuauuuaggg

SEQ ID NO: 2423 - RNA, 20 nt, Artificial Sequence
  source: /note="Description of Artificial Sequence: Synthetic oligonucleotide"
guauuuaaauucuguuaucu

SEQ ID NO: 2424 - RNA, 20 nt, Artificial Sequence
  source: /note="Description of Artificial Sequence: Synthetic oligonucleotide"
uuucccuaucauuuguucuc

SEQ ID NO: 2425 - RNA, 20 nt, Artificial Sequence
  source: /note="Description of Artificial Sequence: Synthetic oligonucleotide"
cauuuuuuuccagugacaaa

SEQ ID NO: 2426 - RNA, 20 nt, Artificial Sequence
  source: /note="Description of Artificial Sequence: Synthetic oligonucleotide"
ugcaaacaaccagagcugau

SEQ ID NO: 2427 - RNA, 20 nt, Artificial Sequence
  source: /note="Description of Artificial Sequence: Synthetic oligonucleotide"
aaccagagcugauaggcagc

SEQ ID NO: 2428 - RNA, 20 nt, Artificial Sequence
  source: /note="Description of Artificial Sequence: Synthetic oligonucleotide"
gcagcaggugcacaugagug

SEQ ID NO: 2429 - RNA, 20 nt, Artificial Sequence
  source: /note="Description of Artificial Sequence: Synthetic oligonucleotide"
caugaguguggcugugcuga

SEQ ID NO: 2430 - RNA, 20 nt, Artificial Sequence
  source: /note="Description of Artificial Sequence: Synthetic oligonucleotide"
ugguuacugaaagauuucca

SEQ ID NO: 2431 - RNA, 20 nt, Artificial Sequence
  source: /note="Description of Artificial Sequence: Synthetic oligonucleotide"
gcuccuuccccauuacuccc

SEQ ID NO: 2432 - RNA, 20 nt, Artificial Sequence
  source: /note="Description of Artificial Sequence: Synthetic oligonucleotide"
cuccuuccccauuacucccu

SEQ ID NO: 2433 - RNA, 20 nt, Artificial Sequence
  source: /note="Description of Artificial Sequence: Synthetic oligonucleotide"
ccugcagcuagaauaauaaa

SEQ ID NO: 2434 - RNA, 20 nt, Artificial Sequence
  source: /note="Description of Artificial Sequence: Synthetic oligonucleotide"
uagaauaauaaauggcaugu

SEQ ID NO: 2435 - RNA, 20 nt, Artificial Sequence
  source: /note="Description of Artificial Sequence: Synthetic oligonucleotide"
aauggcauguagguuccucu

SEQ ID NO: 2436 - RNA, 20 nt, Artificial Sequence
  source: /note="Description of Artificial Sequence: Synthetic oligonucleotide"
ccagcacuaugucucaugcc

SEQ ID NO: 2437 - RNA, 20 nt, Artificial Sequence
  source: /note="Description of Artificial Sequence: Synthetic oligonucleotide"
uuuugauuaucacuccugug

SEQ ID NO: 2438 - RNA, 20 nt, Artificial Sequence
  source: /note="Description of Artificial Sequence: Synthetic oligonucleotide"
auuaucacuccuguguggua

SEQ ID NO: 2439 - RNA, 20 nt, Artificial Sequence
  source: /note="Description of Artificial Sequence: Synthetic oligonucleotide"
uuaucacuccugugugguaa

SEQ ID NO: 2440 - RNA, 20 nt, Artificial Sequence
  source: /note="Description of Artificial Sequence: Synthetic oligonucleotide"
uaguuuguuuuuaacaaacc

SEQ ID NO: 2441 - RNA, 20 nt, Artificial Sequence
  source: /note="Description of Artificial Sequence: Synthetic oligonucleotide"
uuagagaauauuguuacuga

SEQ ID NO: 2442 - RNA, 20 nt, Artificial Sequence
  source: /note="Description of Artificial Sequence: Synthetic oligonucleotide"
cuuuaaaccuuagcucauau

SEQ ID NO: 2443 - RNA, 20 nt, Artificial Sequence
  source: /note="Description of Artificial Sequence: Synthetic oligonucleotide"
cauccuuagaugaagauauu

SEQ ID NO: 2444 - RNA, 20 nt, Artificial Sequence
  source: /note="Description of Artificial Sequence: Synthetic oligonucleotide"
auccuuagaugaagauauuu

SEQ ID NO: 2445 - RNA, 20 nt, Artificial Sequence
  source: /note="Description of Artificial Sequence: Synthetic oligonucleotide"
uccauuuugaagaaauugua

SEQ ID NO: 2446 - RNA, 20 nt, Artificial Sequence
  source: /note="Description of Artificial Sequence: Synthetic oligonucleotide"
uuuugaagaaauuguaaggu

SEQ ID NO: 2447 - RNA, 20 nt, Artificial Sequence
  source: /note="Description of Artificial Sequence: Synthetic oligonucleotide"
uuugaagaaauuguaaggua

SEQ ID NO: 2448 - RNA, 20 nt, Artificial Sequence
  source: /note="Description of Artificial Sequence: Synthetic oligonucleotide"
aaaaucauuuuuaaaauauc

SEQ ID NO: 2449 - RNA, 20 nt, Artificial Sequence
  source: /note="Description of Artificial Sequence: Synthetic oligonucleotide"
aaaucauuuuuaaaauaucu

SEQ ID NO: 2450 - RNA, 20 nt, Artificial Sequence
  source: /note="Description of Artificial Sequence: Synthetic oligonucleotide"
ucuggguuaaugcuauagau

SEQ ID NO: 2451 - RNA, 20 nt, Artificial Sequence
  source: /note="Description of Artificial Sequence: Synthetic oligonucleotide"
guuuauugauccucaaucug

SEQ ID NO: 2452 - RNA, 20 nt, Artificial Sequence
  source: /note="Description of Artificial Sequence: Synthetic oligonucleotide"
caaucuguggcuguuuuaaa

SEQ ID NO: 2453 - RNA, 20 nt, Artificial Sequence
  source: /note="Description of Artificial Sequence: Synthetic oligonucleotide"
aguucagucuaagagaacca

SEQ ID NO: 2454 - RNA, 20 nt, Artificial Sequence
  source: /note="Description of Artificial Sequence: Synthetic oligonucleotide"
auauuaaauuacuaaauaua

SEQ ID NO: 2455 - RNA, 20 nt, Artificial Sequence
  source: /note="Description of Artificial Sequence: Synthetic oligonucleotide"
auauauuguaaaaauugcuu

SEQ ID NO: 2456 - RNA, 20 nt, Artificial Sequence
  source: /note="Description of Artificial Sequence: Synthetic oligonucleotide"
ggaaucaauaauaaguauug

SEQ ID NO: 2457 - RNA, 20 nt, Artificial Sequence
  source: /note="Description of Artificial Sequence: Synthetic oligonucleotide"
uaguuauauauuacaaugua

SEQ ID NO: 2458 - RNA, 20 nt, Artificial Sequence
  source: /note="Description of Artificial Sequence: Synthetic oligonucleotide"
aguuauauauuacaauguaa

SEQ ID NO: 2459 - RNA, 20 nt, Artificial Sequence
  source: /note="Description of Artificial Sequence: Synthetic oligonucleotide"
auucgauaguaucuaaauca

SEQ ID NO: 2460 - RNA, 20 nt, Artificial Sequence
  source: /note="Description of Artificial Sequence: Synthetic oligonucleotide"
gaaucauaaaaccuuaaagc

SEQ ID NO: 2461 - RNA, 20 nt, Artificial Sequence
  source: /note="Description of Artificial Sequence: Synthetic oligonucleotide"
aaucauaaaaccuuaaagcu

SEQ ID NO: 2462 - RNA, 20 nt, Artificial Sequence
  source: /note="Description of Artificial Sequence: Synthetic oligonucleotide"
auaaaaccuuaaagcugggu

SEQ ID NO: 2463 - RNA, 20 nt, Artificial Sequence
  source: /note="Description of Artificial Sequence: Synthetic oligonucleotide"
aauacaauuuaacaucuuau

SEQ ID NO: 2464 - RNA, 20 nt, Artificial Sequence
  source: /note="Description of Artificial Sequence: Synthetic oligonucleotide"
ccucaguuucccuaagugau

SEQ ID NO: 2465 - RNA, 20 nt, Artificial Sequence
  source: /note="Description of Artificial Sequence: Synthetic oligonucleotide"
ggcucaagaucaugaauuua

SEQ ID NO: 2466 - RNA, 20 nt, Artificial Sequence
  source: /note="Description of Artificial Sequence: Synthetic oligonucleotide"
ucaagaucaugaauuuaugg

SEQ ID NO: 2467 - RNA, 20 nt, Artificial Sequence
  source: /note="Description of Artificial Sequence: Synthetic oligonucleotide"
cuacccccuuaguuugccug

SEQ ID NO: 2468 - RNA, 20 nt, Artificial Sequence
  source: /note="Description of Artificial Sequence: Synthetic oligonucleotide"
uacccccuuaguuugccugu

SEQ ID NO: 2469 - RNA, 20 nt, Artificial Sequence
  source: /note="Description of Artificial Sequence: Synthetic oligonucleotide"
uuaguuugccuguggguuua

SEQ ID NO: 2470 - RNA, 20 nt, Artificial Sequence
  source: /note="Description of Artificial Sequence: Synthetic oligonucleotide"
uguggguuuauggaaguuac

SEQ ID NO: 2471 - RNA, 20 nt, Artificial Sequence
  source: /note="Description of Artificial Sequence: Synthetic oligonucleotide"
auacuacuugaaauuucuag

SEQ ID NO: 2472 - RNA, 20 nt, Artificial Sequence
  source: /note="Description of Artificial Sequence: Synthetic oligonucleotide"
uacuacuugaaauuucuagc

SEQ ID NO: 2473 - RNA, 20 nt, Artificial Sequence
  source: /note="Description of Artificial Sequence: Synthetic oligonucleotide"
acuacuugaaauuucuagcg

SEQ ID NO: 2474 - RNA, 20 nt, Artificial Sequence
  source: /note="Description of Artificial Sequence: Synthetic oligonucleotide"
gcggggaucucuaaaaugcc

SEQ ID NO: 2475 - RNA, 20 nt, Artificial Sequence
  source: /note="Description of Artificial Sequence: Synthetic oligonucleotide"
cucuaaaaugccuggauguu

SEQ ID NO: 2476 - RNA, 20 nt, Artificial Sequence
  source: /note="Description of Artificial Sequence: Synthetic oligonucleotide"
aaaugccuggauguuaggaa

SEQ ID NO: 2477 - RNA, 20 nt, Artificial Sequence
  source: /note="Description of Artificial Sequence: Synthetic oligonucleotide"
aauuauauuuucuauuuuag

SEQ ID NO: 2478 - RNA, 20 nt, Artificial Sequence
  source: /note="Description of Artificial Sequence: Synthetic oligonucleotide"
aaauaaaccauacccuuaag

SEQ ID NO: 2479 - RNA, 20 nt, Artificial Sequence
  source: /note="Description of Artificial Sequence: Synthetic oligonucleotide"
auuuugagcacauccuucau

SEQ ID NO: 2480 - RNA, 20 nt, Artificial Sequence
  source: /note="Description of Artificial Sequence: Synthetic oligonucleotide"
ggcccagucucugaccagug

SEQ ID NO: 2481 - RNA, 20 nt, Artificial Sequence
  source: /note="Description of Artificial Sequence: Synthetic oligonucleotide"
auuuucugugugauguuuau

SEQ ID NO: 2482 - RNA, 20 nt, Artificial Sequence
  source: /note="Description of Artificial Sequence: Synthetic oligonucleotide"
uuuucugugugauguuuaua

SEQ ID NO: 2483 - RNA, 20 nt, Artificial Sequence
  source: /note="Description of Artificial Sequence: Synthetic oligonucleotide"
uucugaaauguuuuccaucu

SEQ ID NO: 2484 - RNA, 20 nt, Artificial Sequence
  source: /note="Description of Artificial Sequence: Synthetic oligonucleotide"
ucauaacuucuuuuuauuuu

SEQ ID NO: 2485 - RNA, 20 nt, Artificial Sequence
  source: /note="Description of Artificial Sequence: Synthetic oligonucleotide"
accucucauguuccaguguu

SEQ ID NO: 2486 - RNA, 20 nt, Artificial Sequence
  source: /note="Description of Artificial Sequence: Synthetic oligonucleotide"
uaaauaaucacuuuguauaa

SEQ ID NO: 2487 - RNA, 20 nt, Artificial Sequence
  source: /note="Description of Artificial Sequence: Synthetic oligonucleotide"
uauguuaaauuguuuauaac

SEQ ID NO: 2488 - RNA, 20 nt, Artificial Sequence
  source: /note="Description of Artificial Sequence: Synthetic oligonucleotide"
guuaaauuguuuauaacugg

SEQ ID NO: 2489 - RNA, 20 nt, Artificial Sequence
  source: /note="Description of Artificial Sequence: Synthetic oligonucleotide"
guugauauuucagccuuguu

SEQ ID NO: 2490 - RNA, 20 nt, Artificial Sequence
  source: /note="Description of Artificial Sequence: Synthetic oligonucleotide"
uaauuagaaacaaccucaua

SEQ ID NO: 2491 - RNA, 20 nt, Artificial Sequence
  source: /note="Description of Artificial Sequence: Synthetic oligonucleotide"
uaugcuuguuuuuaucuuca

SEQ ID NO: 2492 - RNA, 20 nt, Artificial Sequence
  source: /note="Description of Artificial Sequence: Synthetic oligonucleotide"
gcaaacacugaguucuuuac

SEQ ID NO: 2493 - RNA, 20 nt, Artificial Sequence
  source: /note="Description of Artificial Sequence: Synthetic oligonucleotide"
caaacacugaguucuuuacu

SEQ ID NO: 2494 - RNA, 20 nt, Artificial Sequence
  source: /note="Description of Artificial Sequence: Synthetic oligonucleotide"
gucaccacuuugucuauguu

SEQ ID NO: 2495 - RNA, 20 nt, Artificial Sequence
  source: /note="Description of Artificial Sequence: Synthetic oligonucleotide"
accacuuugucuauguuagg

SEQ ID NO: 2496 - RNA, 20 nt, Artificial Sequence
  source: /note="Description of Artificial Sequence: Synthetic oligonucleotide"
uugucuauguuaggaggagc

SEQ ID NO: 2497 - RNA, 20 nt, Artificial Sequence
  source: /note="Description of Artificial Sequence: Synthetic oligonucleotide"
gcaggaagugaauacauuua

SEQ ID NO: 2498 - RNA, 20 nt, Artificial Sequence
  source: /note="Description of Artificial Sequence: Synthetic oligonucleotide"
uaaaacuuugacuacuguag

SEQ ID NO: 2499 - RNA, 20 nt, Artificial Sequence
  source: /note="Description of Artificial Sequence: Synthetic oligonucleotide"
ugguuuuuuaaagcauuaac

SEQ ID NO: 2500 - RNA, 20 nt, Artificial Sequence
  source: /note="Description of Artificial Sequence: Synthetic oligonucleotide"
cugaaauagcacuucccuuu

SEQ ID NO: 2501 - RNA, 20 nt, Artificial Sequence
  source: /note="Description of Artificial Sequence: Synthetic oligonucleotide"
cccuuuaggcacuguacagu

SEQ ID NO: 2502 - RNA, 20 nt, Artificial Sequence
  source: /note="Description of Artificial Sequence: Synthetic oligonucleotide"
ggaaucauuuacuugcagag

SEQ ID NO: 2503 - RNA, 20 nt, Artificial Sequence
  source: /note="Description of Artificial Sequence: Synthetic oligonucleotide"
guacucauguguauaagaau

SEQ ID NO: 2504 - RNA, 20 nt, Artificial Sequence
  source: /note="Description of Artificial Sequence: Synthetic oligonucleotide"
agaauaggagaaacacuuug

SEQ ID NO: 2505 - RNA, 20 nt, Artificial Sequence
  source: /note="Description of Artificial Sequence: Synthetic oligonucleotide"
gaauaggagaaacacuuugu

SEQ ID NO: 2506 - RNA, 20 nt, Artificial Sequence
  source: /note="Description of Artificial Sequence: Synthetic oligonucleotide"
uuugugggcauauccugcug

SEQ ID NO: 2507 - RNA, 20 nt, Artificial Sequence
  source: /note="Description of Artificial Sequence: Synthetic oligonucleotide"
agucucaucccauuuaaacc

SEQ ID NO: 2508 - RNA, 20 nt, Artificial Sequence
  source: /note="Description of Artificial Sequence: Synthetic oligonucleotide"
cucaucccauuuaaaccugg

SEQ ID NO: 2509 - RNA, 20 nt, Artificial Sequence
  source: /note="Description of Artificial Sequence: Synthetic oligonucleotide"
agccaaagcagcauuucaac

SEQ ID NO: 2510 - RNA, 20 nt, Artificial Sequence
  source: /note="Description of Artificial Sequence: Synthetic oligonucleotide"
aaagcagcauuucaacagga

SEQ ID NO: 2511 - RNA, 20 nt, Artificial Sequence
  source: /note="Description of Artificial Sequence: Synthetic oligonucleotide"
aggaaggaaacaucuauuac

SEQ ID NO: 2512 - RNA, 20 nt, Artificial Sequence
  source: /note="Description of Artificial Sequence: Synthetic oligonucleotide"
ggaaggaaacaucuauuacu

SEQ ID NO: 2513 - RNA, 20 nt, Artificial Sequence
  source: /note="Description of Artificial Sequence: Synthetic oligonucleotide"
gaaggaaacaucuauuacug

SEQ ID NO: 2514 - RNA, 20 nt, Artificial Sequence
  source: /note="Description of Artificial Sequence: Synthetic oligonucleotide"
uuugaagaaacaugccauga

SEQ ID NO: 2515 - RNA, 20 nt, Artificial Sequence
  source: /note="Description of Artificial Sequence: Synthetic oligonucleotide"
aagguguacuaauaucacaa

SEQ ID NO: 2516 - RNA, 20 nt, Artificial Sequence
  source: /note="Description of Artificial Sequence: Synthetic oligonucleotide"
agguguacuaauaucacaaa

SEQ ID NO: 2517 - RNA, 20 nt, Artificial Sequence
  source: /note="Description of Artificial Sequence: Synthetic oligonucleotide"
guacuaauaucacaaaggga

SEQ ID NO: 2518 - RNA, 20 nt, Artificial Sequence
  source: /note="Description of Artificial Sequence: Synthetic oligonucleotide"
uacuaauaucacaaagggaa

SEQ ID NO: 2519 - RNA, 20 nt, Artificial Sequence
  source: /note="Description of Artificial Sequence: Synthetic oligonucleotide"
aauaucacaaagggaaggga

SEQ ID NO: 2520 - RNA, 20 nt, Artificial Sequence
  source: /note="Description of Artificial Sequence: Synthetic oligonucleotide"
acaaagucccuuuuuuguaa

SEQ ID NO: 2521 - RNA, 20 nt, Artificial Sequence
  source: /note="Description of Artificial Sequence: Synthetic oligonucleotide"
guuugaugauguuugaucaa

SEQ ID NO: 2522 - RNA, 20 nt, Artificial Sequence
  source: /note="Description of Artificial Sequence: Synthetic oligonucleotide"
ugaugauguuugaucaaugg

SEQ ID NO: 2523 - RNA, 20 nt, Artificial Sequence
  source: /note="Description of Artificial Sequence: Synthetic oligonucleotide"
ugguggaucuaucucuugaa

SEQ ID NO: 2524 - RNA, 20 nt, Artificial Sequence
  source: /note="Description of Artificial Sequence: Synthetic oligonucleotide"
aaaugcauuuaaaccccaaa

SEQ ID NO: 2525 - RNA, 20 nt, Artificial Sequence
  source: /note="Description of Artificial Sequence: Synthetic oligonucleotide"
ugcauuuaaaccccaaaugg

SEQ ID NO: 2526 - RNA, 20 nt, Artificial Sequence
  source: /note="Description of Artificial Sequence: Synthetic oligonucleotide"
aaauggaggauucuuauaua

SEQ ID NO: 2527 - RNA, 20 nt, Artificial Sequence
  source: /note="Description of Artificial Sequence: Synthetic oligonucleotide"
aaugauauauucauguuuau

SEQ ID NO: 2528 - RNA, 20 nt, Artificial Sequence
  source: /note="Description of Artificial Sequence: Synthetic oligonucleotide"
auguuuauagguagagugac

SEQ ID NO: 2529 - RNA, 20 nt, Artificial Sequence
  source: /note="Description of Artificial Sequence: Synthetic oligonucleotide"
gugacugguuuuuagagaag

SEQ ID NO: 2530 - RNA, 20 nt, Artificial Sequence
  source: /note="Description of Artificial Sequence: Synthetic oligonucleotide"
acgaaaacuugucugucucu

SEQ ID NO: 2531 - RNA, 20 nt, Artificial Sequence
  source: /note="Description of Artificial Sequence: Synthetic oligonucleotide"
cugaaucuccuacaagcuug

SEQ ID NO: 2532 - RNA, 20 nt, Artificial Sequence
  source: /note="Description of Artificial Sequence: Synthetic oligonucleotide"
aaucuccuacaagcuugugg

SEQ ID NO: 2533 - RNA, 20 nt, Artificial Sequence
  source: /note="Description of Artificial Sequence: Synthetic oligonucleotide"
agcauguugaauaagagcac

SEQ ID NO: 2534 - RNA, 20 nt, Artificial Sequence
  source: /note="Description of Artificial Sequence: Synthetic oligonucleotide"
uugaauaagagcacaggcuc

SEQ ID NO: 2535 - RNA, 20 nt, Artificial Sequence
  source: /note="Description of Artificial Sequence: Synthetic oligonucleotide"
aauaagagcacaggcucugg

SEQ ID NO: 2536 - RNA, 20 nt, Artificial Sequence
  source: /note="Description of Artificial Sequence: Synthetic oligonucleotide"
ggaggcccugccacccacaa

SEQ ID NO: 2537 - RNA, 20 nt, Artificial Sequence
  source: /note="Description of Artificial Sequence: Synthetic oligonucleotide"
gaggcccugccacccacaaa

SEQ ID NO: 2538 - RNA, 20 nt, Artificial Sequence
  source: /note="Description of Artificial Sequence: Synthetic oligonucleotide"
cacccacaaagggugugcua

SEQ ID NO: 2539 - RNA, 20 nt, Artificial Sequence
  source: /note="Description of Artificial Sequence: Synthetic oligonucleotide"
cuuuuuuuucuaaaucuauu

SEQ ID NO: 2540 - RNA, 20 nt, Artificial Sequence
  source: /note="Description of Artificial Sequence: Synthetic oligonucleotide"
uucuaaaacacagugagacc

SEQ ID NO: 2541 - RNA, 20 nt, Artificial Sequence
  source: /note="Description of Artificial Sequence: Synthetic oligonucleotide"
cacagugagaccaggcgcag

SEQ ID NO: 2542 - RNA, 20 nt, Artificial Sequence
  source: /note="Description of Artificial Sequence: Synthetic oligonucleotide"
gccuguaaucccagcacuuu

SEQ ID NO: 2543 - RNA, 20 nt, Artificial Sequence
  source: /note="Description of Artificial Sequence: Synthetic oligonucleotide"
uguaaucccagcacuuucgg

SEQ ID NO: 2544 - RNA, 20 nt, Artificial Sequence
  source: /note="Description of Artificial Sequence: Synthetic oligonucleotide"
cccagcacuuucggaggccg

SEQ ID NO: 2545 - RNA, 20 nt, Artificial Sequence
  source: /note="Description of Artificial Sequence: Synthetic oligonucleotide"
cuuucggaggccgagguaug

SEQ ID NO: 2546 - RNA, 20 nt, Artificial Sequence
  source: /note="Description of Artificial Sequence: Synthetic oligonucleotide"
gccgagguaugcggaucacg

SEQ ID NO: 2547 - RNA, 20 nt, Artificial Sequence
  source: /note="Description of Artificial Sequence: Synthetic oligonucleotide"
gguaugcggaucacgagguc

SEQ ID NO: 2548 - RNA, 20 nt, Artificial Sequence
  source: /note="Description of Artificial Sequence: Synthetic oligonucleotide"
ucaggagaucgagaccaucc

SEQ ID NO: 2549 - RNA, 20 nt, Artificial Sequence
  source: /note="Description of Artificial Sequence: Synthetic oligonucleotide"
cgagaccauccuggcuaaca

SEQ ID NO: 2550 - RNA, 20 nt, Artificial Sequence
  source: /note="Description of Artificial Sequence: Synthetic oligonucleotide"
uaaaaauacaaaaauuagcc

SEQ ID NO: 2551 - RNA, 20 nt, Artificial Sequence
  source: /note="Description of Artificial Sequence: Synthetic oligonucleotide"
auacaaaaauuagccaggcg

SEQ ID NO: 2552 - RNA, 20 nt, Artificial Sequence
  source: /note="Description of Artificial Sequence: Synthetic oligonucleotide"
uacaaaaauuagccaggcgu

SEQ ID NO: 2553 - RNA, 20 nt, Artificial Sequence
  source: /note="Description of Artificial Sequence: Synthetic oligonucleotide"
acaaaaauuagccaggcgug

SEQ ID NO: 2554 - RNA, 20 nt, Artificial Sequence
  source: /note="Description of Artificial Sequence: Synthetic oligonucleotide"
caaaaauuagccaggcgugg

SEQ ID NO: 2555 - RNA, 20 nt, Artificial Sequence
  source: /note="Description of Artificial Sequence: Synthetic oligonucleotide"
gccuguaaucccagcuacuc

SEQ ID NO: 2556 - RNA, 20 nt, Artificial Sequence
  source: /note="Description of Artificial Sequence: Synthetic oligonucleotide"
uguaaucccagcuacucagg

SEQ ID NO: 2557 - RNA, 20 nt, Artificial Sequence
  source: /note="Description of Artificial Sequence: Synthetic oligonucleotide"
cccagcuacucaggaggcug

SEQ ID NO: 2558 - RNA, 20 nt, Artificial Sequence
  source: /note="Description of Artificial Sequence: Synthetic oligonucleotide"
gcuacucaggaggcugaggc

SEQ ID NO: 2559 - RNA, 20 nt, Artificial Sequence
  source: /note="Description of Artificial Sequence: Synthetic oligonucleotide"
aggaggcugaggcaggagaa

SEQ ID NO: 2560 - RNA, 20 nt, Artificial Sequence
  source: /note="Description of Artificial Sequence: Synthetic oligonucleotide"
ggcaggagaauggcgugaac

SEQ ID NO: 2561 - RNA, 20 nt, Artificial Sequence
  source: /note="Description of Artificial Sequence: Synthetic oligonucleotide"
gcaggagaauggcgugaacc

SEQ ID NO: 2562 - RNA, 20 nt, Artificial Sequence
  source: /note="Description of Artificial Sequence: Synthetic oligonucleotide"
caggagaauggcgugaaccg

SEQ ID NO: 2563 - RNA, 20 nt, Artificial Sequence
  source: /note="Description of Artificial Sequence: Synthetic oligonucleotide"
gagaauggcgugaaccgggg

SEQ ID NO: 2564 - RNA, 20 nt, Artificial Sequence
  source: /note="Description of Artificial Sequence: Synthetic oligonucleotide"
aauggcgugaaccggggagg

SEQ ID NO: 2565 - RNA, 20 nt, Artificial Sequence
  source: /note="Description of Artificial Sequence: Synthetic oligonucleotide"
cgcaccacugcacuccagcc

SEQ ID NO: 2566 - RNA, 20 nt, Artificial Sequence
  source: /note="Description of Artificial Sequence: Synthetic oligonucleotide"
gcaccacugcacuccagccu

SEQ ID NO: 2567 - RNA, 20 nt, Artificial Sequence
  source: /note="Description of Artificial Sequence: Synthetic oligonucleotide"
uuauaaagauaaaauagaau

SEQ ID NO: 2568 - RNA, 20 nt, Artificial Sequence
  source: /note="Description of Artificial Sequence: Synthetic oligonucleotide"
aauagaauaggcuucaauuu

SEQ ID NO: 2569 - RNA, 20 nt, Artificial Sequence
  source: /note="Description of Artificial Sequence: Synthetic oligonucleotide"
auagaauaggcuucaauuua

SEQ ID NO: 2570 - RNA, 20 nt, Artificial Sequence
  source: /note="Description of Artificial Sequence: Synthetic oligonucleotide"
ggcuucaauuuagggaacaa

SEQ ID NO: 2571 - RNA, 20 nt, Artificial Sequence
  source: /note="Description of Artificial Sequence: Synthetic oligonucleotide"
gaacaaaggaaaauauguuu

SEQ ID NO: 2572 - RNA, 20 nt, Artificial Sequence
  source: /note="Description of Artificial Sequence: Synthetic oligonucleotide"
caaaaugauugcaacuuuga

SEQ ID NO: 2573 - RNA, 20 nt, Artificial Sequence
  source: /note="Description of Artificial Sequence: Synthetic oligonucleotide"
uucaauuaaaaauguagaua

SEQ ID NO: 2574 - RNA, 20 nt, Artificial Sequence
  source: /note="Description of Artificial Sequence: Synthetic oligonucleotide"
auuaaaaauguagauauggc

SEQ ID NO: 2575 - RNA, 20 nt, Artificial Sequence
  source: /note="Description of Artificial Sequence: Synthetic oligonucleotide"
uuaaaaauguagauauggcu

SEQ ID NO: 2576 - RNA, 20 nt, Artificial Sequence
  source: /note="Description of Artificial Sequence: Synthetic oligonucleotide"
aauguagauauggcugggcg

SEQ ID NO: 2577 - RNA, 20 nt, Artificial Sequence
  source: /note="Description of Artificial Sequence: Synthetic oligonucleotide"
guagauauggcugggcgugg

SEQ ID NO: 2578 - RNA, 20 nt, Artificial Sequence
  source: /note="Description of Artificial Sequence: Synthetic oligonucleotide"
caccuguaaucccagcacuu

SEQ ID NO: 2579 - RNA, 20 nt, Artificial Sequence
  source: /note="Description of Artificial Sequence: Synthetic oligonucleotide"
uguaaucccagcacuuugga

SEQ ID NO: 2580 - RNA, 20 nt, Artificial Sequence
  source: /note="Description of Artificial Sequence: Synthetic oligonucleotide"
gcacuuuggaagguugacgc

SEQ ID NO: 2581 - RNA, 20 nt, Artificial Sequence
  source: /note="Description of Artificial Sequence: Synthetic oligonucleotide"
cuuuggaagguugacgcagg

SEQ ID NO: 2582 - RNA, 20 nt, Artificial Sequence
  source: /note="Description of Artificial Sequence: Synthetic oligonucleotide"
ugacgcagguggaucacuug

SEQ ID NO: 2583 - RNA, 20 nt, Artificial Sequence
  source: /note="Description of Artificial Sequence: Synthetic oligonucleotide"
cagguggaucacuugagguu

SEQ ID NO: 2584 - RNA, 20 nt, Artificial Sequence
  source: /note="Description of Artificial Sequence: Synthetic oligonucleotide"
uuaggaguuugagaccugcc

SEQ ID NO: 2585 - RNA, 20 nt, Artificial Sequence
  source: /note="Description of Artificial Sequence: Synthetic oligonucleotide"
uaggaguuugagaccugccu

SEQ ID NO: 2586 - RNA, 20 nt, Artificial Sequence
  source: /note="Description of Artificial Sequence: Synthetic oligonucleotide"
aaaauaaacaaaaaaugugc

SEQ ID NO: 2587 - RNA, 20 nt, Artificial Sequence
  source: /note="Description of Artificial Sequence: Synthetic oligonucleotide"
aaauaaacaaaaaaugugcu

SEQ ID NO: 2588 - RNA, 20 nt, Artificial Sequence
  source: /note="Description of Artificial Sequence: Synthetic oligonucleotide"
aacaaaaaaugugcugggug

SEQ ID NO: 2589 - RNA, 20 nt, Artificial Sequence
  source: /note="Description of Artificial Sequence: Synthetic oligonucleotide"
aaaaaaugugcugggugugg

SEQ ID NO: 2590 - RNA, 20 nt, Artificial Sequence
  source: /note="Description of Artificial Sequence: Synthetic oligonucleotide"
ugccuguaguccuagccacu

SEQ ID NO: 2591 - RNA, 20 nt, Artificial Sequence
  source: /note="Description of Artificial Sequence: Synthetic oligonucleotide"
gccuguaguccuagccacuu

SEQ ID NO: 2592 - RNA, 20 nt, Artificial Sequence
  source: /note="Description of Artificial Sequence: Synthetic oligonucleotide"
agccacuugggagacugaga

SEQ ID NO: 2593 - RNA, 20 nt, Artificial Sequence
  source: /note="Description of Artificial Sequence: Synthetic oligonucleotide"
acuugggagacugagaugga

SEQ ID NO: 2594 - RNA, 20 nt, Artificial Sequence
  source: /note="Description of Artificial Sequence: Synthetic oligonucleotide"
auggaaggauagcuugaguc

SEQ ID NO: 2595 - RNA, 20 nt, Artificial Sequence
  source: /note="Description of Artificial Sequence: Synthetic oligonucleotide"
uggaaggauagcuugagucu

SEQ ID NO: 2596 - RNA, 20 nt, Artificial Sequence
  source: /note="Description of Artificial Sequence: Synthetic oligonucleotide"
aaggauagcuugagucuggg

SEQ ID NO: 2597 - RNA, 20 nt, Artificial Sequence
  source: /note="Description of Artificial Sequence: Synthetic oligonucleotide"
cgugccacugcacuugagcc

SEQ ID NO: 2598 - RNA, 20 nt, Artificial Sequence
  source: /note="Description of Artificial Sequence: Synthetic oligonucleotide"
gugccacugcacuugagccu

SEQ ID NO: 2599 - RNA, 20 nt, Artificial Sequence
  source: /note="Description of Artificial Sequence: Synthetic oligonucleotide"
aacaacaguagauaugugug

SEQ ID NO: 2600 - RNA, 20 nt, Artificial Sequence
  source: /note="Description of Artificial Sequence: Synthetic oligonucleotide"
acaacaguagauaugugugu

SEQ ID NO: 2601 - RNA, 20 nt, Artificial Sequence
  source: /note="Description of Artificial Sequence: Synthetic oligonucleotide"
gaacauuuaaaugugcucau

SEQ ID NO: 2602 - RNA, 20 nt, Artificial Sequence
  source: /note="Description of Artificial Sequence: Synthetic oligonucleotide"
uuuuucuuuaacccccuuca

SEQ ID NO: 2603 - RNA, 20 nt, Artificial Sequence
  source: /note="Description of Artificial Sequence: Synthetic oligonucleotide"
uuauaacucucaauguauca

SEQ ID NO: 2604 - RNA, 20 nt, Artificial Sequence
  source: /note="Description of Artificial Sequence: Synthetic oligonucleotide"
ucucaauguaucauggcaga

SEQ ID NO: 2605 - RNA, 20 nt, Artificial Sequence
  source: /note="Description of Artificial Sequence: Synthetic oligonucleotide"
uuuuuuuuuuuuuuuugaga

SEQ ID NO: 2606 - RNA, 20 nt, Artificial Sequence
  source: /note="Description of Artificial Sequence: Synthetic oligonucleotide"
ggagucucacucugucaccc

SEQ ID NO: 2607 - RNA, 20 nt, Artificial Sequence
  source: /note="Description of Artificial Sequence: Synthetic oligonucleotide"
ucucacucugucacccaggc

SEQ ID NO: 2608 - RNA, 20 nt, Artificial Sequence
  source: /note="Description of Artificial Sequence: Synthetic oligonucleotide"
ucacccaggcuggagugcag

SEQ ID NO: 2609 - RNA, 20 nt, Artificial Sequence
  source: /note="Description of Artificial Sequence: Synthetic oligonucleotide"
uuauugcaaccuccgccucc

SEQ ID NO: 2610 - RNA, 20 nt, Artificial Sequence
  source: /note="Description of Artificial Sequence: Synthetic oligonucleotide"
uugcaaccuccgccuccugg

SEQ ID NO: 2611 - RNA, 20 nt, Artificial Sequence
  source: /note="Description of Artificial Sequence: Synthetic oligonucleotide"
gccucagccuccccaguagc

SEQ ID NO: 2612 - RNA, 20 nt, Artificial Sequence
  source: /note="Description of Artificial Sequence: Synthetic oligonucleotide"
ccucagccuccccaguagcu

SEQ ID NO: 2613 - RNA, 20 nt, Artificial Sequence
  source: /note="Description of Artificial Sequence: Synthetic oligonucleotide"
uccccaguagcugggacuac

SEQ ID NO: 2614 - RNA, 20 nt, Artificial Sequence
  source: /note="Description of Artificial Sequence: Synthetic oligonucleotide"
caggcuugcaccaccaugcc

SEQ ID NO: 2615 - RNA, 20 nt, Artificial Sequence
  source: /note="Description of Artificial Sequence: Synthetic oligonucleotide"
uuuuauauuuuuaguagaga

SEQ ID NO: 2616 - RNA, 20 nt, Artificial Sequence
  source: /note="Description of Artificial Sequence: Synthetic oligonucleotide"
uuuauauuuuuaguagagac

SEQ ID NO: 2617 - RNA, 20 nt, Artificial Sequence
  source: /note="Description of Artificial Sequence: Synthetic oligonucleotide"
uuauauuuuuaguagagacg

SEQ ID NO: 2618 - RNA, 20 nt, Artificial Sequence
  source: /note="Description of Artificial Sequence: Synthetic oligonucleotide"
gggguuucaucauguugucu

SEQ ID NO: 2619 - RNA, 20 nt, Artificial Sequence
  source: /note="Description of Artificial Sequence: Synthetic oligonucleotide"
uuucaucauguugucuaggc

SEQ ID NO: 2620 - RNA, 20 nt, Artificial Sequence
  source: /note="Description of Artificial Sequence: Synthetic oligonucleotide"
cucaagugauccacccaccu

SEQ ID NO: 2621 - RNA, 20 nt, Artificial Sequence
  source: /note="Description of Artificial Sequence: Synthetic oligonucleotide"
accuuggccucccaaagugc

SEQ ID NO: 2622 - RNA, 20 nt, Artificial Sequence
  source: /note="Description of Artificial Sequence: Synthetic oligonucleotide"
ccuuggccucccaaagugcu

SEQ ID NO: 2623 - RNA, 20 nt, Artificial Sequence
  source: /note="Description of Artificial Sequence: Synthetic oligonucleotide"
ucccaaagugcugggauugc

SEQ ID NO: 2624 - RNA, 20 nt, Artificial Sequence
  source: /note="Description of Artificial Sequence: Synthetic oligonucleotide"
auugcaggcaugagccaccg

SEQ ID NO: 2625 - RNA, 20 nt, Artificial Sequence
  source: /note="Description of Artificial Sequence: Synthetic oligonucleotide"
aggcaugagccaccgcggcc

SEQ ID NO: 2626 - RNA, 20 nt, Artificial Sequence
  source: /note="Description of Artificial Sequence: Synthetic oligonucleotide"
uuaucagaauauuaucauau

SEQ ID NO: 2627 - RNA, 20 nt, Artificial Sequence
  source: /note="Description of Artificial Sequence: Synthetic oligonucleotide"
cugaacaaagccagaauuau

SEQ ID NO: 2628 - RNA, 20 nt, Artificial Sequence
  source: /note="Description of Artificial Sequence: Synthetic oligonucleotide"
gccagaauuauuggcuacug

SEQ ID NO: 2629 - RNA, 20 nt, Artificial Sequence
  source: /note="Description of Artificial Sequence: Synthetic oligonucleotide"
caagagacuauucuauuugu

SEQ ID NO: 2630 - RNA, 20 nt, Artificial Sequence
  source: /note="Description of Artificial Sequence: Synthetic oligonucleotide"
aagagacuauucuauuuguu

SEQ ID NO: 2631 - RNA, 20 nt, Artificial Sequence
  source: /note="Description of Artificial Sequence: Synthetic oligonucleotide"
agagacuauucuauuuguug

SEQ ID NO: 2632 - RNA, 20 nt, Artificial Sequence
  source: /note="Description of Artificial Sequence: Synthetic oligonucleotide"
ggaucaccucuuuuuacuaa

SEQ ID NO: 2633 - RNA, 20 nt, Artificial Sequence
  source: /note="Description of Artificial Sequence: Synthetic oligonucleotide"
gaucaccucuuuuuacuaaa

SEQ ID NO: 2634 - RNA, 20 nt, Artificial Sequence
  source: /note="Description of Artificial Sequence: Synthetic oligonucleotide"
aucaccucuuuuuacuaaag

SEQ ID NO: 2635 - RNA, 20 nt, Artificial Sequence
  source: /note="Description of Artificial Sequence: Synthetic oligonucleotide"
uuuacuaaaggggacuguuu

SEQ ID NO: 2636 - RNA, 20 nt, Artificial Sequence
  source: /note="Description of Artificial Sequence: Synthetic oligonucleotide"
uuacuaaaggggacuguuuu

SEQ ID NO: 2637 - RNA, 20 nt, Artificial Sequence
  source: /note="Description of Artificial Sequence: Synthetic oligonucleotide"
gcauauaaaacuagaauuca

SEQ ID NO: 2638 - RNA, 20 nt, Artificial Sequence
  source: /note="Description of Artificial Sequence: Synthetic oligonucleotide"
ccagucaaccagauaacugc

SEQ ID NO: 2639 - RNA, 20 nt, Artificial Sequence
  source: /note="Description of Artificial Sequence: Synthetic oligonucleotide"
uagugacacucauguccucc

SEQ ID NO: 2640 - RNA, 20 nt, Artificial Sequence
  source: /note="Description of Artificial Sequence: Synthetic oligonucleotide"
aaucuugugccagcucagag

SEQ ID NO: 2641 - RNA, 20 nt, Artificial Sequence
  source: /note="Description of Artificial Sequence: Synthetic oligonucleotide"
aucuugugccagcucagaga

SEQ ID NO: 2642 - RNA, 20 nt, Artificial Sequence
  source: /note="Description of Artificial Sequence: Synthetic oligonucleotide"
aagaaccacaagcaccaccu

SEQ ID NO: 2643 - RNA, 20 nt, Artificial Sequence
  source: /note="Description of Artificial Sequence: Synthetic oligonucleotide"
uauuuuaaacagaaaacaga

SEQ ID NO: 2644 - RNA, 20 nt, Artificial Sequence
  source: /note="Description of Artificial Sequence: Synthetic oligonucleotide"
ccucugccuuccucaguauu

SEQ ID NO: 2645 - RNA, 20 nt, Artificial Sequence
  source: /note="Description of Artificial Sequence: Synthetic oligonucleotide"
uuaagagucuaaucauauac

SEQ ID NO: 2646 - RNA, 20 nt, Artificial Sequence
  source: /note="Description of Artificial Sequence: Synthetic oligonucleotide"
cugccugaugaauauuuauu

SEQ ID NO: 2647 - RNA, 20 nt, Artificial Sequence
  source: /note="Description of Artificial Sequence: Synthetic oligonucleotide"
uucuaccacuucacacucac

SEQ ID NO: 2648 - RNA, 20 nt, Artificial Sequence
  source: /note="Description of Artificial Sequence: Synthetic oligonucleotide"
ucuaccacuucacacucacu

SEQ ID NO: 2649 - RNA, 20 nt, Artificial Sequence
  source: /note="Description of Artificial Sequence: Synthetic oligonucleotide"
ccacuucacacucacuggga

SEQ ID NO: 2650 - RNA, 20 nt, Artificial Sequence
  source: /note="Description of Artificial Sequence: Synthetic oligonucleotide"
uuuuuaaaacauacaauaac

SEQ ID NO: 2651 - RNA, 20 nt, Artificial Sequence
  source: /note="Description of Artificial Sequence: Synthetic oligonucleotide"
uacaauaacagguguuagug

SEQ ID NO: 2652 - RNA, 20 nt, Artificial Sequence
  source: /note="Description of Artificial Sequence: Synthetic oligonucleotide"
aacagguguuagugcggaua

SEQ ID NO: 2653 - RNA, 20 nt, Artificial Sequence
  source: /note="Description of Artificial Sequence: Synthetic oligonucleotide"
uagugcggauauggaaaaau

SEQ ID NO: 2654 - RNA, 20 nt, Artificial Sequence
  source: /note="Description of Artificial Sequence: Synthetic oligonucleotide"
gaacccugacacauugcuag

SEQ ID NO: 2655 - RNA, 20 nt, Artificial Sequence
  source: /note="Description of Artificial Sequence: Synthetic oligonucleotide"
auugcuaguggaauguaaaa

SEQ ID NO: 2656 - RNA, 20 nt, Artificial Sequence
  source: /note="Description of Artificial Sequence: Synthetic oligonucleotide"
agccacuuugcaaaacaguu

SEQ ID NO: 2657 - RNA, 20 nt, Artificial Sequence
  source: /note="Description of Artificial Sequence: Synthetic oligonucleotide"
guucaucaaaagauuaagca

SEQ ID NO: 2658 - RNA, 20 nt, Artificial Sequence
  source: /note="Description of Artificial Sequence: Synthetic oligonucleotide"
gacccaguaguuucgcucuu

SEQ ID NO: 2659 - RNA, 20 nt, Artificial Sequence
  source: /note="Description of Artificial Sequence: Synthetic oligonucleotide"
acccaguaguuucgcucuua

SEQ ID NO: 2660 - RNA, 20 nt, Artificial Sequence
  source: /note="Description of Artificial Sequence: Synthetic oligonucleotide"
cauuauucacaauagccuaa

SEQ ID NO: 2661 - RNA, 20 nt, Artificial Sequence
  source: /note="Description of Artificial Sequence: Synthetic oligonucleotide"
gcaacccaaaugccuacaga

SEQ ID NO: 2662 - RNA, 20 nt, Artificial Sequence
  source: /note="Description of Artificial Sequence: Synthetic oligonucleotide"
aaugccuacagauggaugaa

SEQ ID NO: 2663 - RNA, 20 nt, Artificial Sequence
  source: /note="Description of Artificial Sequence: Synthetic oligonucleotide"
augaauggauaaacagaaug

SEQ ID NO: 2664 - RNA, 20 nt, Artificial Sequence
  source: /note="Description of Artificial Sequence: Synthetic oligonucleotide"
aaugugguauagacauacaa

SEQ ID NO: 2665 - RNA, 20 nt, Artificial Sequence
  source: /note="Description of Artificial Sequence: Synthetic oligonucleotide"
acuauuauucaaccuuaaag

SEQ ID NO: 2666 - RNA, 20 nt, Artificial Sequence
  source: /note="Description of Artificial Sequence: Synthetic oligonucleotide"
gacacaugcuagaaaauaaa

SEQ ID NO: 2667 - RNA, 20 nt, Artificial Sequence
  source: /note="Description of Artificial Sequence: Synthetic oligonucleotide"
cuuguauacauucuacuaag

SEQ ID NO: 2668 - RNA, 20 nt, Artificial Sequence
  source: /note="Description of Artificial Sequence: Synthetic oligonucleotide"
auuaugauuccacuuacaug

SEQ ID NO: 2669 - RNA, 20 nt, Artificial Sequence
  source: /note="Description of Artificial Sequence: Synthetic oligonucleotide"
uagaauagucaaauuaauag

SEQ ID NO: 2670 - RNA, 20 nt, Artificial Sequence
  source: /note="Description of Artificial Sequence: Synthetic oligonucleotide"
acaguagaauaaugauugcc

SEQ ID NO: 2671 - RNA, 20 nt, Artificial Sequence
  source: /note="Description of Artificial Sequence: Synthetic oligonucleotide"
caguagaauaaugauugcca

SEQ ID NO: 2672 - RNA, 20 nt, Artificial Sequence
  source: /note="Description of Artificial Sequence: Synthetic oligonucleotide"
aguagaauaaugauugccag

SEQ ID NO: 2673 - RNA, 20 nt, Artificial Sequence
  source: /note="Description of Artificial Sequence: Synthetic oligonucleotide"
gaauaaugauugccaggggc

SEQ ID NO: 2674 - RNA, 20 nt, Artificial Sequence
  source: /note="Description of Artificial Sequence: Synthetic oligonucleotide"
aauaaugauugccaggggcu

SEQ ID NO: 2675 - RNA, 20 nt, Artificial Sequence
  source: /note="Description of Artificial Sequence: Synthetic oligonucleotide"
aaugauugccaggggcuggg

SEQ ID NO: 2676 - RNA, 20 nt, Artificial Sequence
  source: /note="Description of Artificial Sequence: Synthetic oligonucleotide"
gauugccaggggcugggagg

SEQ ID NO: 2677 - RNA, 20 nt, Artificial Sequence
  source: /note="Description of Artificial Sequence: Synthetic oligonucleotide"
gggcugggaggaggagcaaa

SEQ ID NO: 2678 - RNA, 20 nt, Artificial Sequence
  source: /note="Description of Artificial Sequence: Synthetic oligonucleotide"
ggcugggaggaggagcaaau

SEQ ID NO: 2679 - RNA, 20 nt, Artificial Sequence
  source: /note="Description of Artificial Sequence: Synthetic oligonucleotide"
ugaguauagaauuucuguuu

SEQ ID NO: 2680 - RNA, 20 nt, Artificial Sequence
  source: /note="Description of Artificial Sequence: Synthetic oligonucleotide"
uuaggaagaugaaaaaguuc

SEQ ID NO: 2681 - RNA, 20 nt, Artificial Sequence
  source: /note="Description of Artificial Sequence: Synthetic oligonucleotide"
agaugaaaaaguucuggaga

SEQ ID NO: 2682 - RNA, 20 nt, Artificial Sequence
  source: /note="Description of Artificial Sequence: Synthetic oligonucleotide"
gaugaaaaaguucuggagau

SEQ ID NO: 2683 - RNA, 20 nt, Artificial Sequence
  source: /note="Description of Artificial Sequence: Synthetic oligonucleotide"
gaaaaaguucuggagauggg

SEQ ID NO: 2684 - RNA, 20 nt, Artificial Sequence
  source: /note="Description of Artificial Sequence: Synthetic oligonucleotide"
cuggagauggguggcaguga

SEQ ID NO: 2685 - RNA, 20 nt, Artificial Sequence
  source: /note="Description of Artificial Sequence: Synthetic oligonucleotide"
cagaauaguauacuuaaaua

SEQ ID NO: 2686 - RNA, 20 nt, Artificial Sequence
  source: /note="Description of Artificial Sequence: Synthetic oligonucleotide"
auacuuaaauaugguuugaa

SEQ ID NO: 2687 - RNA, 20 nt, Artificial Sequence
  source: /note="Description of Artificial Sequence: Synthetic oligonucleotide"
ccaaagaagcauuauuuaug

SEQ ID NO: 2688 - RNA, 20 nt, Artificial Sequence
  source: /note="Description of Artificial Sequence: Synthetic oligonucleotide"
auuauuuaugaggcuaaaag

SEQ ID NO: 2689 - RNA, 20 nt, Artificial Sequence
  source: /note="Description of Artificial Sequence: Synthetic oligonucleotide"
aguucaucauugauagcuaa

SEQ ID NO: 2690 - RNA, 20 nt, Artificial Sequence
  source: /note="Description of Artificial Sequence: Synthetic oligonucleotide"
auugauagcuaaaggaaaca

SEQ ID NO: 2691 - RNA, 20 nt, Artificial Sequence
  source: /note="Description of Artificial Sequence: Synthetic oligonucleotide"
guagaauauuagucauacaa

SEQ ID NO: 2692 - RNA, 20 nt, Artificial Sequence
  source: /note="Description of Artificial Sequence: Synthetic oligonucleotide"
ugaaagaaaccagacguaaa

SEQ ID NO: 2693 - RNA, 20 nt, Artificial Sequence
  source: /note="Description of Artificial Sequence: Synthetic oligonucleotide"
guaaaaggccaaauuuugua

SEQ ID NO: 2694 - RNA, 20 nt, Artificial Sequence
  source: /note="Description of Artificial Sequence: Synthetic oligonucleotide"
uauauaaagucguucaaaau

SEQ ID NO: 2695 - RNA, 20 nt, Artificial Sequence
  source: /note="Description of Artificial Sequence: Synthetic oligonucleotide"
aaagacugaaaguugauuag

SEQ ID NO: 2696 - RNA, 20 nt, Artificial Sequence
  source: /note="Description of Artificial Sequence: Synthetic oligonucleotide"
aaguugauuaguggucacca

SEQ ID NO: 2697 - RNA, 20 nt, Artificial Sequence
  source: /note="Description of Artificial Sequence: Synthetic oligonucleotide"
gauuaguggucaccaaggcc

SEQ ID NO: 2698 - RNA, 20 nt, Artificial Sequence
  source: /note="Description of Artificial Sequence: Synthetic oligonucleotide"
auuaguggucaccaaggccc

SEQ ID NO: 2699 - RNA, 20 nt, Artificial Sequence
  source: /note="Description of Artificial Sequence: Synthetic oligonucleotide"
uuaguggucaccaaggcccg

SEQ ID NO: 2700 - RNA, 20 nt, Artificial Sequence
  source: /note="Description of Artificial Sequence: Synthetic oligonucleotide"
uaguggucaccaaggcccgg

SEQ ID NO: 2701 - RNA, 20 nt, Artificial Sequence
  source: /note="Description of Artificial Sequence: Synthetic oligonucleotide"
uggucaccaaggcccggggg

SEQ ID NO: 2702 - RNA, 20 nt, Artificial Sequence
  source: /note="Description of Artificial Sequence: Synthetic oligonucleotide"
ggggaggaaugaaugaaaac

SEQ ID NO: 2703 - RNA, 20 nt, Artificial Sequence
  source: /note="Description of Artificial Sequence: Synthetic oligonucleotide"
gaaugaaaacuggcuccuaa

SEQ ID NO: 2704 - RNA, 20 nt, Artificial Sequence
  source: /note="Description of Artificial Sequence: Synthetic oligonucleotide"
aaugaaaacuggcuccuaau

SEQ ID NO: 2705 - RNA, 20 nt, Artificial Sequence
  source: /note="Description of Artificial Sequence: Synthetic oligonucleotide"
aacuggcuccuaauggguac

SEQ ID NO: 2706 - RNA, 20 nt, Artificial Sequence
  source: /note="Description of Artificial Sequence: Synthetic oligonucleotide"
acuggcuccuaauggguacu

SEQ ID NO: 2707 - RNA, 20 nt, Artificial Sequence
  source: /note="Description of Artificial Sequence: Synthetic oligonucleotide"
cuaauggguacuggguuuuu

SEQ ID NO: 2708 - RNA, 20 nt, Artificial Sequence
  source: /note="Description of Artificial Sequence: Synthetic oligonucleotide"
uaauggguacuggguuuuuu

SEQ ID NO: 2709 - RNA, 20 nt, Artificial Sequence
  source: /note="Description of Artificial Sequence: Synthetic oligonucleotide"
aauggguacuggguuuuuug

SEQ ID NO: 2710 - RNA, 20 nt, Artificial Sequence
  source: /note="Description of Artificial Sequence: Synthetic oligonucleotide"
guacuggguuuuuuggggcg

SEQ ID NO: 2711 - RNA, 20 nt, Artificial Sequence
  source: /note="Description of Artificial Sequence: Synthetic oligonucleotide"
uacuggguuuuuuggggcga

SEQ ID NO: 2712 - RNA, 20 nt, Artificial Sequence
  source: /note="Description of Artificial Sequence: Synthetic oligonucleotide"
acuggguuuuuuggggcgag

SEQ ID NO: 2713 - RNA, 20 nt, Artificial Sequence
  source: /note="Description of Artificial Sequence: Synthetic oligonucleotide"
cuggguuuuuuggggcgagg

SEQ ID NO: 2714 - RNA, 20 nt, Artificial Sequence
  source: /note="Description of Artificial Sequence: Synthetic oligonucleotide"
uagaauuugauaguaaugau

SEQ ID NO: 2715 - RNA, 20 nt, Artificial Sequence
  source: /note="Description of Artificial Sequence: Synthetic oligonucleotide"
auaguaaugauaggugagag

SEQ ID NO: 2716 - RNA, 20 nt, Artificial Sequence
  source: /note="Description of Artificial Sequence: Synthetic oligonucleotide"
acugacucauauacuuuaca

SEQ ID NO: 2717 - RNA, 20 nt, Artificial Sequence
  source: /note="Description of Artificial Sequence: Synthetic oligonucleotide"
cuuuacaaggauguauuuua

SEQ ID NO: 2718 - RNA, 20 nt, Artificial Sequence
  source: /note="Description of Artificial Sequence: Synthetic oligonucleotide"
accccuuaaauuuuaacgua

SEQ ID NO: 2719 - RNA, 20 nt, Artificial Sequence
  source: /note="Description of Artificial Sequence: Synthetic oligonucleotide"
agucucagcuuacuauuucu

SEQ ID NO: 2720 - RNA, 20 nt, Artificial Sequence
  source: /note="Description of Artificial Sequence: Synthetic oligonucleotide"
ucccuucuuacucuguaaaa

SEQ ID NO: 2721 - RNA, 20 nt, Artificial Sequence
  source: /note="Description of Artificial Sequence: Synthetic oligonucleotide"
cccuucuuacucuguaaaau

SEQ ID NO: 2722 - RNA, 20 nt, Artificial Sequence
  source: /note="Description of Artificial Sequence: Synthetic oligonucleotide"
auuuuuuugaguguuaaaug

SEQ ID NO: 2723 - RNA, 20 nt, Artificial Sequence
  source: /note="Description of Artificial Sequence: Synthetic oligonucleotide"
agugcaucuagcauaguguc

SEQ ID NO: 2724 - RNA, 20 nt, Artificial Sequence
  source: /note="Description of Artificial Sequence: Synthetic oligonucleotide"
cuggcauuuaccaagaaccc

SEQ ID NO: 2725 - RNA, 20 nt, Artificial Sequence
  source: /note="Description of Artificial Sequence: Synthetic oligonucleotide"
uggcauuuaccaagaacccc

SEQ ID NO: 2726 - RNA, 20 nt, Artificial Sequence
  source: /note="Description of Artificial Sequence: Synthetic oligonucleotide"
acuauuccagauacuauuuc

SEQ ID NO: 2727 - RNA, 20 nt, Artificial Sequence
  source: /note="Description of Artificial Sequence: Synthetic oligonucleotide"
aauacuguuuccauauauuc

SEQ ID NO: 2728 - RNA, 20 nt, Artificial Sequence
  source: /note="Description of Artificial Sequence: Synthetic oligonucleotide"
uuuccauauauucaggacaa

SEQ ID NO: 2729 - RNA, 20 nt, Artificial Sequence
  source: /note="Description of Artificial Sequence: Synthetic oligonucleotide"
cuuuagauucuguuucaaau

SEQ ID NO: 2730 - RNA, 20 nt, Artificial Sequence
  source: /note="Description of Artificial Sequence: Synthetic oligonucleotide"
uccucuuuucucucugcccu

SEQ ID NO: 2731 - RNA, 20 nt, Artificial Sequence
  source: /note="Description of Artificial Sequence: Synthetic oligonucleotide"
ucucugcccuuggaacucug

SEQ ID NO: 2732 - RNA, 20 nt, Artificial Sequence
  source: /note="Description of Artificial Sequence: Synthetic oligonucleotide"
uugaccaauuaagucuuacu

SEQ ID NO: 2733 - RNA, 20 nt, Artificial Sequence
  source: /note="Description of Artificial Sequence: Synthetic oligonucleotide"
ugaccaauuaagucuuacuu

SEQ ID NO: 2734 - RNA, 20 nt, Artificial Sequence
  source: /note="Description of Artificial Sequence: Synthetic oligonucleotide"
uuggguuauguuuuuaaagu

SEQ ID NO: 2735 - RNA, 20 nt, Artificial Sequence
  source: /note="Description of Artificial Sequence: Synthetic oligonucleotide"
uuuaaaguagguaucuuauu

SEQ ID NO: 2736 - RNA, 20 nt, Artificial Sequence
  source: /note="Description of Artificial Sequence: Synthetic oligonucleotide"
aaaguagguaucuuauuagg

SEQ ID NO: 2737 - RNA, 20 nt, Artificial Sequence
  source: /note="Description of Artificial Sequence: Synthetic oligonucleotide"
cuuagcauguuaccuugaca

SEQ ID NO: 2738 - RNA, 20 nt, Artificial Sequence
  source: /note="Description of Artificial Sequence: Synthetic oligonucleotide"
ugccacaucucaugaaguac

SEQ ID NO: 2739 - RNA, 20 nt, Artificial Sequence
  source: /note="Description of Artificial Sequence: Synthetic oligonucleotide"
gccacaucucaugaaguaca

SEQ ID NO: 2740 - RNA, 20 nt, Artificial Sequence
  source: /note="Description of Artificial Sequence: Synthetic oligonucleotide"
gacuucaucuuacagucacc

SEQ ID NO: 2741 - RNA, 20 nt, Artificial Sequence
  source: /note="Description of Artificial Sequence: Synthetic oligonucleotide"
aaauccucaacuucuuaccu

SEQ ID NO: 2742 - RNA, 20 nt, Artificial Sequence
  source: /note="Description of Artificial Sequence: Synthetic oligonucleotide"
uaagccacacugugaaccac

SEQ ID NO: 2743 - RNA, 20 nt, Artificial Sequence
  source: /note="Description of Artificial Sequence: Synthetic oligonucleotide"
gaugaaguaauauaagccac

SEQ ID NO: 2744 - RNA, 20 nt, Artificial Sequence
  source: /note="Description of Artificial Sequence: Synthetic oligonucleotide"
uuaagccucauugauuauug

SEQ ID NO: 2745 - RNA, 20 nt, Artificial Sequence
  source: /note="Description of Artificial Sequence: Synthetic oligonucleotide"
ugugaagacuaaagaugcuu

SEQ ID NO: 2746 - RNA, 20 nt, Artificial Sequence
  source: /note="Description of Artificial Sequence: Synthetic oligonucleotide"
gugaagacuaaagaugcuuu

SEQ ID NO: 2747 - RNA, 20 nt, Artificial Sequence
  source: /note="Description of Artificial Sequence: Synthetic oligonucleotide"
gacuaaagaugcuuugggca

SEQ ID NO: 2748 - RNA, 20 nt, Artificial Sequence
  source: /note="Description of Artificial Sequence: Synthetic oligonucleotide"
agauauuagaauuguuauua

SEQ ID NO: 2749 - RNA, 20 nt, Artificial Sequence
  source: /note="Description of Artificial Sequence: Synthetic oligonucleotide"
uuuuaacagccacacuguaa

SEQ ID NO: 2750 - RNA, 20 nt, Artificial Sequence
  source: /note="Description of Artificial Sequence: Synthetic oligonucleotide"
uaauggaaauauccaauuau

SEQ ID NO: 2751 - RNA, 20 nt, Artificial Sequence
  source: /note="Description of Artificial Sequence: Synthetic oligonucleotide"
ccuuuuaaacucuuuauauc

SEQ ID NO: 2752 - RNA, 20 nt, Artificial Sequence
  source: /note="Description of Artificial Sequence: Synthetic oligonucleotide"
agaagaaagggagaguuucg

SEQ ID NO: 2753 - RNA, 20 nt, Artificial Sequence
  source: /note="Description of Artificial Sequence: Synthetic oligonucleotide"
aaagcgaaggggagaagaaa

SEQ ID NO: 2754 - RNA, 20 nt, Artificial Sequence
  source: /note="Description of Artificial Sequence: Synthetic oligonucleotide"
aaaagcgaaggggagaagaa

SEQ ID NO: 2755 - RNA, 20 nt, Artificial Sequence
  source: /note="Description of Artificial Sequence: Synthetic oligonucleotide"
aagcccgagaaaaagcgaag

SEQ ID NO: 2756 - RNA, 20 nt, Artificial Sequence
  source: /note="Description of Artificial Sequence: Synthetic oligonucleotide"
gaagcccgagaaaaagcgaa

SEQ ID NO: 2757 - RNA, 20 nt, Artificial Sequence
  source: /note="Description of Artificial Sequence: Synthetic oligonucleotide"
ggaagcccgagaaaaagcga

SEQ ID NO: 2758 - RNA, 20 nt, Artificial Sequence
  source: /note="Description of Artificial Sequence: Synthetic oligonucleotide"
aggguuugcuccccaguccc

SEQ ID NO: 2759 - RNA, 20 nt, Artificial Sequence
  source: /note="Description of Artificial Sequence: Synthetic oligonucleotide"
uauuugugggugacacuaca

SEQ ID NO: 2760 - RNA, 20 nt, Artificial Sequence
  source: /note="Description of Artificial Sequence: Synthetic oligonucleotide"
guauuugugggugacacuac

SEQ ID NO: 2761 - RNA, 20 nt, Artificial Sequence
  source: /note="Description of Artificial Sequence: Synthetic oligonucleotide"
ucuucccucuugguauuugu

SEQ ID NO: 2762 - RNA, 20 nt, Artificial Sequence
  source: /note="Description of Artificial Sequence: Synthetic oligonucleotide"
cucuucccucuugguauuug

SEQ ID NO: 2763 - RNA, 20 nt, Artificial Sequence
  source: /note="Description of Artificial Sequence: Synthetic oligonucleotide"
gaagcuucccucuucccucu

SEQ ID NO: 2764 - RNA, 20 nt, Artificial Sequence
  source: /note="Description of Artificial Sequence: Synthetic oligonucleotide"
auuugucagccauguugaag

SEQ ID NO: 2765 - RNA, 20 nt, Artificial Sequence
  source: /note="Description of Artificial Sequence: Synthetic oligonucleotide"
acagguuuaaaagggguaga

SEQ ID NO: 2766 - RNA, 20 nt, Artificial Sequence
  source: /note="Description of Artificial Sequence: Synthetic oligonucleotide"
uacagguuuaaaagggguag

SEQ ID NO: 2767 - RNA, 20 nt, Artificial Sequence
  source: /note="Description of Artificial Sequence: Synthetic oligonucleotide"
cagaacuacagguuuaaaag

SEQ ID NO: 2768 - RNA, 20 nt, Artificial Sequence
  source: /note="Description of Artificial Sequence: Synthetic oligonucleotide"
acagaacuacagguuuaaaa

SEQ ID NO: 2769 - RNA, 20 nt, Artificial Sequence
  source: /note="Description of Artificial Sequence: Synthetic oligonucleotide"
cacagaacuacagguuuaaa

SEQ ID NO: 2770 - RNA, 20 nt, Artificial Sequence
  source: /note="Description of Artificial Sequence: Synthetic oligonucleotide"
agaagagaacacagaacuac

SEQ ID NO: 2771 - RNA, 20 nt, Artificial Sequence
  source: /note="Description of Artificial Sequence: Synthetic oligonucleotide"
augaggggacgagcauuagg

SEQ ID NO: 2772 - RNA, 20 nt, Artificial Sequence
  source: /note="Description of Artificial Sequence: Synthetic oligonucleotide"
gagaugaggggacgagcauu

SEQ ID NO: 2773 - RNA, 20 nt, Artificial Sequence
  source: /note="Description of Artificial Sequence: Synthetic oligonucleotide"
uaaguuuucugggagaugag

SEQ ID NO: 2774 - RNA, 20 nt, Artificial Sequence
  source: /note="Description of Artificial Sequence: Synthetic oligonucleotide"
guaaguuuucugggagauga

SEQ ID NO: 2775 - RNA, 20 nt, Artificial Sequence
  source: /note="Description of Artificial Sequence: Synthetic oligonucleotide"
gguaaguuuucugggagaug

SEQ ID NO: 2776 - RNA, 20 nt, Artificial Sequence
  source: /note="Description of Artificial Sequence: Synthetic oligonucleotide"
ggcacaaagguaaguuuucu

SEQ ID NO: 2777 - RNA, 20 nt, Artificial Sequence
  source: /note="Description of Artificial Sequence: Synthetic oligonucleotide"
aggcacaaagguaaguuuuc

SEQ ID NO: 2778 - RNA, 20 nt, Artificial Sequence
  source: /note="Description of Artificial Sequence: Synthetic oligonucleotide"
ccggcucgucggaggcacaa

SEQ ID NO: 2779 - RNA, 20 nt, Artificial Sequence
  source: /note="Description of Artificial Sequence: Synthetic oligonucleotide"
ccgggaaaccggcucgucgg

SEQ ID NO: 2780 - RNA, 20 nt, Artificial Sequence
  source: /note="Description of Artificial Sequence: Synthetic oligonucleotide"
aggccgggaaaccggcucgu

SEQ ID NO: 2781 - RNA, 20 nt, Artificial Sequence
  source: /note="Description of Artificial Sequence: Synthetic oligonucleotide"
auuaaaaaaggccgggaaac

SEQ ID NO: 2782 - RNA, 20 nt, Artificial Sequence
  source: /note="Description of Artificial Sequence: Synthetic oligonucleotide"
ucugaggauuaaaaaaggcc

SEQ ID NO: 2783 - RNA, 20 nt, Artificial Sequence
  source: /note="Description of Artificial Sequence: Synthetic oligonucleotide"
uucugaggauuaaaaaaggc

SEQ ID NO: 2784 - RNA, 20 nt, Artificial Sequence
  source: /note="Description of Artificial Sequence: Synthetic oligonucleotide"
acuuuucugaggauuaaaaa

SEQ ID NO: 2785 - RNA, 20 nt, Artificial Sequence
  source: /note="Description of Artificial Sequence: Synthetic oligonucleotide"
auuuaaaaaucacuuuucug

SEQ ID NO: 2786 - RNA, 20 nt, Artificial Sequence
  source: /note="Description of Artificial Sequence: Synthetic oligonucleotide"
aaagcugaacuauuuuagaa

SEQ ID NO: 2787 - RNA, 20 nt, Artificial Sequence
  source: /note="Description of Artificial Sequence: Synthetic oligonucleotide"
aacaggggaagaggauuaaa

SEQ ID NO: 2788 - RNA, 20 nt, Artificial Sequence
  source: /note="Description of Artificial Sequence: Synthetic oligonucleotide"
aaacaggggaagaggauuaa

SEQ ID NO: 2789 - RNA, 20 nt, Artificial Sequence
  source: /note="Description of Artificial Sequence: Synthetic oligonucleotide"
cacgaaagaaacaggggaag

SEQ ID NO: 2790 - RNA, 20 nt, Artificial Sequence
  source: /note="Description of Artificial Sequence: Synthetic oligonucleotide"
cacuuacacgaaagaaacag

SEQ ID NO: 2791 - RNA, 20 nt, Artificial Sequence
  source: /note="Description of Artificial Sequence: Synthetic oligonucleotide"
ucacuuacacgaaagaaaca

SEQ ID NO: 2792 - RNA, 20 nt, Artificial Sequence
  source: /note="Description of Artificial Sequence: Synthetic oligonucleotide"
uucacuuacacgaaagaaac

SEQ ID NO: 2793 - RNA, 20 nt, Artificial Sequence
  source: /note="Description of Artificial Sequence: Synthetic oligonucleotide"
ugagguuguucaggauaaac

SEQ ID NO: 2794 - RNA, 20 nt, Artificial Sequence
  source: /note="Description of Artificial Sequence: Synthetic oligonucleotide"
cugagguuguucaggauaaa

SEQ ID NO: 2795 - RNA, 20 nt, Artificial Sequence
  source: /note="Description of Artificial Sequence: Synthetic oligonucleotide"
uguucucucugagguuguuc

SEQ ID NO: 2796 - RNA, 20 nt, Artificial Sequence
  source: /note="Description of Artificial Sequence: Synthetic oligonucleotide"
cccuaucaguguucucucug

SEQ ID NO: 2797 - RNA, 20 nt, Artificial Sequence
  source: /note="Description of Artificial Sequence: Synthetic oligonucleotide"
agacccuacagcugauaaaa

SEQ ID NO: 2798 - RNA, 20 nt, Artificial Sequence
  source: /note="Description of Artificial Sequence: Synthetic oligonucleotide"
cagacccuacagcugauaaa

SEQ ID NO: 2799 - RNA, 20 nt, Artificial Sequence
  source: /note="Description of Artificial Sequence: Synthetic oligonucleotide"
ggggauaagaagguaggagg

SEQ ID NO: 2800 - RNA, 20 nt, Artificial Sequence
  source: /note="Description of Artificial Sequence: Synthetic oligonucleotide"
aagggggauaagaagguagg

SEQ ID NO: 2801 - RNA, 20 nt, Artificial Sequence
  source: /note="Description of Artificial Sequence: Synthetic oligonucleotide"
cuaaagggggauaagaaggu

SEQ ID NO: 2802 - RNA, 20 nt, Artificial Sequence
  source: /note="Description of Artificial Sequence: Synthetic oligonucleotide"
cccccuaaagggggauaaga

SEQ ID NO: 2803 - RNA, 20 nt, Artificial Sequence
  source: /note="Description of Artificial Sequence: Synthetic oligonucleotide"
uucguacagcccccuaaagg

SEQ ID NO: 2804 - RNA, 20 nt, Artificial Sequence
  source: /note="Description of Artificial Sequence: Synthetic oligonucleotide"
cuucguacagcccccuaaag

SEQ ID NO: 2805 - RNA, 20 nt, Artificial Sequence
  source: /note="Description of Artificial Sequence: Synthetic oligonucleotide"
acuucguacagcccccuaaa

SEQ ID NO: 2806 - RNA, 20 nt, Artificial Sequence
  source: /note="Description of Artificial Sequence: Synthetic oligonucleotide"
cacuucguacagcccccuaa

SEQ ID NO: 2807 - RNA, 20 nt, Artificial Sequence
  source: /note="Description of Artificial Sequence: Synthetic oligonucleotide"
uaacaaaacgcgcggacuua

SEQ ID NO: 2808 - RNA, 20 nt, Artificial Sequence
  source: /note="Description of Artificial Sequence: Synthetic oligonucleotide"
agcgccgcuaacaaaacgcg

SEQ ID NO: 2809 - RNA, 20 nt, Artificial Sequence
  source: /note="Description of Artificial Sequence: Synthetic oligonucleotide"
gugaguucuggucuuguuug

SEQ ID NO: 2810 - RNA, 20 nt, Artificial Sequence
  source: /note="Description of Artificial Sequence: Synthetic oligonucleotide"
agugaguucuggucuuguuu

SEQ ID NO: 2811 - RNA, 20 nt, Artificial Sequence
  source: /note="Description of Artificial Sequence: Synthetic oligonucleotide"
aagugaguucuggucuuguu

SEQ ID NO: 2812 - RNA, 20 nt, Artificial Sequence
  source: /note="Description of Artificial Sequence: Synthetic oligonucleotide"
accuugagaaaagugaguuc

SEQ ID NO: 2813 - RNA, 20 nt, Artificial Sequence
  source: /note="Description of Artificial Sequence: Synthetic oligonucleotide"
cauacauuccccaggcugga

SEQ ID NO: 2814 - RNA, 20 nt, Artificial Sequence
  source: /note="Description of Artificial Sequence: Synthetic oligonucleotide"
cuuacauacauuccccaggc

SEQ ID NO: 2815 - RNA, 20 nt, Artificial Sequence
  source: /note="Description of Artificial Sequence: Synthetic oligonucleotide"
uucucuuacauacauucccc

SEQ ID NO: 2816 - RNA, 20 nt, Artificial Sequence
  source: /note="Description of Artificial Sequence: Synthetic oligonucleotide"
uucgggagaagcacaaagcc

SEQ ID NO: 2817 - RNA, 20 nt, Artificial Sequence
  source: /note="Description of Artificial Sequence: Synthetic oligonucleotide"
auucgggagaagcacaaagc

SEQ ID NO: 2818 - RNA, 20 nt, Artificial Sequence
  source: /note="Description of Artificial Sequence: Synthetic oligonucleotide"
gaaccaaacgaagcugauuc

SEQ ID NO: 2819 - RNA, 20 nt, Artificial Sequence
  source: /note="Description of Artificial Sequence: Synthetic oligonucleotide"
ggaaccaaacgaagcugauu

SEQ ID NO: 2820 - RNA, 20 nt, Artificial Sequence
  source: /note="Description of Artificial Sequence: Synthetic oligonucleotide"
ugucugccugucacuuacca

SEQ ID NO: 2821 - RNA, 20 nt, Artificial Sequence
  source: /note="Description of Artificial Sequence: Synthetic oligonucleotide"
cccccucccgcccccucccc

SEQ ID NO: 2822 - RNA, 20 nt, Artificial Sequence
  source: /note="Description of Artificial Sequence: Synthetic oligonucleotide"
acccccucccgcccccuccc

SEQ ID NO: 2823 - RNA, 20 nt, Artificial Sequence
  source: /note="Description of Artificial Sequence: Synthetic oligonucleotide"
ggauuggguuucauuucuuu

SEQ ID NO: 2824 - RNA, 20 nt, Artificial Sequence
  source: /note="Description of Artificial Sequence: Synthetic oligonucleotide"
uucacuucuuugcugggauu

SEQ ID NO: 2825 - RNA, 20 nt, Artificial Sequence
  source: /note="Description of Artificial Sequence: Synthetic oligonucleotide"
cuucacuucuuugcugggau

SEQ ID NO: 2826 - RNA, 20 nt, Artificial Sequence
  source: /note="Description of Artificial Sequence: Synthetic oligonucleotide"
cugcucuucacuucuuugcu

SEQ ID NO: 2827 - RNA, 20 nt, Artificial Sequence
  source: /note="Description of Artificial Sequence: Synthetic oligonucleotide"
ucugcucuucacuucuuugc

SEQ ID NO: 2828 - RNA, 20 nt, Artificial Sequence
  source: /note="Description of Artificial Sequence: Synthetic oligonucleotide"
ucgguuucucuaauuuggau

SEQ ID NO: 2829 - RNA, 20 nt, Artificial Sequence
  source: /note="Description of Artificial Sequence: Synthetic oligonucleotide"
uucgguuucucuaauuugga

SEQ ID NO: 2830 - RNA, 20 nt, Artificial Sequence
  source: /note="Description of Artificial Sequence: Synthetic oligonucleotide"
ucucuucgguuucucuaauu

SEQ ID NO: 2831 - RNA, 20 nt, Artificial Sequence
  source: /note="Description of Artificial Sequence: Synthetic oligonucleotide"
cucuccucugugucucucuu

SEQ ID NO: 2832 - RNA, 20 nt, Artificial Sequence
  source: /note="Description of Artificial Sequence: Synthetic oligonucleotide"
ucucucuucuuucucaucuc

SEQ ID NO: 2833 - RNA, 20 nt, Artificial Sequence
  source: /note="Description of Artificial Sequence: Synthetic oligonucleotide"
gauucagcaagaugcgagug

SEQ ID NO: 2834 - RNA, 20 nt, Artificial Sequence
  source: /note="Description of Artificial Sequence: Synthetic oligonucleotide"
gccacacuucauuaugucau

SEQ ID NO: 2835 - RNA, 20 nt, Artificial Sequence
  source: /note="Description of Artificial Sequence: Synthetic oligonucleotide"
gccuuuccaggagucuaucc

SEQ ID NO: 2836 - RNA, 20 nt, Artificial Sequence
  source: /note="Description of Artificial Sequence: Synthetic oligonucleotide"
auuucauuuucggccuuucc

SEQ ID NO: 2837 - RNA, 20 nt, Artificial Sequence
  source: /note="Description of Artificial Sequence: Synthetic oligonucleotide"
uaacacuuauauuucauuuu

SEQ ID NO: 2838 - RNA, 20 nt, Artificial Sequence
  source: /note="Description of Artificial Sequence: Synthetic oligonucleotide"
aauuaaaaguauaucaugag

SEQ ID NO: 2839 - RNA, 20 nt, Artificial Sequence
  source: /note="Description of Artificial Sequence: Synthetic oligonucleotide"
uaauuaaaaguauaucauga

SEQ ID NO: 2840 - RNA, 20 nt, Artificial Sequence
  source: /note="Description of Artificial Sequence: Synthetic oligonucleotide"
guaauuaaaaguauaucaug

SEQ ID NO: 2841 - RNA, 20 nt, Artificial Sequence
  source: /note="Description of Artificial Sequence: Synthetic oligonucleotide"
cuuaaacauuagaugaagaa

SEQ ID NO: 2842 - RNA, 20 nt, Artificial Sequence
  source: /note="Description of Artificial Sequence: Synthetic oligonucleotide"
ucuuaaacauuagaugaaga

SEQ ID NO: 2843 - RNA, 20 nt, Artificial Sequence
  source: /note="Description of Artificial Sequence: Synthetic oligonucleotide"
uaugcacuaaauuuuaccgc

SEQ ID NO: 2844 - RNA, 20 nt, Artificial Sequence
  source: /note="Description of Artificial Sequence: Synthetic oligonucleotide"
auuauaaucccugacugaag

SEQ ID NO: 2845 - RNA, 20 nt, Artificial Sequence
  source: /note="Description of Artificial Sequence: Synthetic oligonucleotide"
cauuauaaucccugacugaa

SEQ ID NO: 2846 - RNA, 20 nt, Artificial Sequence
  source: /note="Description of Artificial Sequence: Synthetic oligonucleotide"
ccauuauaaucccugacuga

SEQ ID NO: 2847 - RNA, 20 nt, Artificial Sequence
  source: /note="Description of Artificial Sequence: Synthetic oligonucleotide"
ugaugaauaucuuugaauuu

SEQ ID NO: 2848 - RNA, 20 nt, Artificial Sequence
  source: /note="Description of Artificial Sequence: Synthetic oligonucleotide"
uugaugaauaucuuugaauu

SEQ ID NO: 2849 - RNA, 20 nt, Artificial Sequence
  source: /note="Description of Artificial Sequence: Synthetic oligonucleotide"
auacaaucuuauuccuauga

SEQ ID NO: 2850 - RNA, 20 nt, Artificial Sequence
  source: /note="Description of Artificial Sequence: Synthetic oligonucleotide"
auguaaugauuucauuagcc

SEQ ID NO: 2851 - RNA, 20 nt, Artificial Sequence
  source: /note="Description of Artificial Sequence: Synthetic oligonucleotide"
aguuuuggaaauucgacuua

SEQ ID NO: 2852 - RNA, 20 nt, Artificial Sequence
  source: /note="Description of Artificial Sequence: Synthetic oligonucleotide"
cuaucgaggacaaauaguuu

SEQ ID NO: 2853 - RNA, 20 nt, Artificial Sequence
  source: /note="Description of Artificial Sequence: Synthetic oligonucleotide"
aguuacaaagugaacuaucg

SEQ ID NO: 2854 - RNA, 20 nt, Artificial Sequence
  source: /note="Description of Artificial Sequence: Synthetic oligonucleotide"
uaauuuuuguuuuaauuuua

SEQ ID NO: 2855 - RNA, 20 nt, Artificial Sequence
  source: /note="Description of Artificial Sequence: Synthetic oligonucleotide"
cuaauuuuuguuuuaauuuu

SEQ ID NO: 2856 - RNA, 20 nt, Artificial Sequence
  source: /note="Description of Artificial Sequence: Synthetic oligonucleotide"
uuuaccaugaacagcauuaa

SEQ ID NO: 2857 - RNA, 20 nt, Artificial Sequence
  source: /note="Description of Artificial Sequence: Synthetic oligonucleotide"
uguuuuuaauucugaauugc

SEQ ID NO: 2858 - RNA, 20 nt, Artificial Sequence
  source: /note="Description of Artificial Sequence: Synthetic oligonucleotide"
aauauuaguuuguuagcaaa

SEQ ID NO: 2859 - RNA, 20 nt, Artificial Sequence
  source: /note="Description of Artificial Sequence: Synthetic oligonucleotide"
aguuauucuuauuuauugag

SEQ ID NO: 2860 - RNA, 20 nt, Artificial Sequence
  source: /note="Description of Artificial Sequence: Synthetic oligonucleotide"
aagaaucuaaauuugaugac

SEQ ID NO: 2861 - RNA, 20 nt, Artificial Sequence
  source: /note="Description of Artificial Sequence: Synthetic oligonucleotide"
gcuauuuucaguauaaaagu

SEQ ID NO: 2862 - RNA, 20 nt, Artificial Sequence
  source: /note="Description of Artificial Sequence: Synthetic oligonucleotide"
uaauuucucuuuuccaacaa

SEQ ID NO: 2863 - RNA, 20 nt, Artificial Sequence
  source: /note="Description of Artificial Sequence: Synthetic oligonucleotide"
auaugguaaagaaagaacug

SEQ ID NO: 2864 - RNA, 20 nt, Artificial Sequence
  source: /note="Description of Artificial Sequence: Synthetic oligonucleotide"
agguaguaugaucacauaua

SEQ ID NO: 2865 - RNA, 20 nt, Artificial Sequence
  source: /note="Description of Artificial Sequence: Synthetic oligonucleotide"
auggaauuuuuggagcaccu

SEQ ID NO: 2866 - RNA, 20 nt, Artificial Sequence
  source: /note="Description of Artificial Sequence: Synthetic oligonucleotide"
agacaguccuauggaauuuu

SEQ ID NO: 2867 - RNA, 20 nt, Artificial Sequence
  source: /note="Description of Artificial Sequence: Synthetic oligonucleotide"
aauaacccaagacaguccua

SEQ ID NO: 2868 - RNA, 20 nt, Artificial Sequence
  source: /note="Description of Artificial Sequence: Synthetic oligonucleotide"
ugacaauuuaaacaaagcaa

SEQ ID NO: 2869 - RNA, 20 nt, Artificial Sequence
  source: /note="Description of Artificial Sequence: Synthetic oligonucleotide"
augacaauuuaaacaaagca

SEQ ID NO: 2870 - RNA, 20 nt, Artificial Sequence
  source: /note="Description of Artificial Sequence: Synthetic oligonucleotide"
uuaaagccuuaagaagaguu

SEQ ID NO: 2871 - RNA, 20 nt, Artificial Sequence
  source: /note="Description of Artificial Sequence: Synthetic oligonucleotide"
cuccggcuucuggcauaaac

SEQ ID NO: 2872 - RNA, 20 nt, Artificial Sequence
  source: /note="Description of Artificial Sequence: Synthetic oligonucleotide"
auaucaauuccuccggcuuc

SEQ ID NO: 2873 - RNA, 20 nt, Artificial Sequence
  source: /note="Description of Artificial Sequence: Synthetic oligonucleotide"
caaaaucauaucaauuccuc

SEQ ID NO: 2874 - RNA, 20 nt, Artificial Sequence
  source: /note="Description of Artificial Sequence: Synthetic oligonucleotide"
uucacuugccaaugucuagu

SEQ ID NO: 2875 - RNA, 20 nt, Artificial Sequence
  source: /note="Description of Artificial Sequence: Synthetic oligonucleotide"
caggugcacuucacuuguuc

SEQ ID NO: 2876 - RNA, 20 nt, Artificial Sequence
  source: /note="Description of Artificial Sequence: Synthetic oligonucleotide"
uuucauaacaacuccuuggc

SEQ ID NO: 2877 - RNA, 20 nt, Artificial Sequence
  source: /note="Description of Artificial Sequence: Synthetic oligonucleotide"
auucuuucauaacaacuccu

SEQ ID NO: 2878 - RNA, 20 nt, Artificial Sequence
  source: /note="Description of Artificial Sequence: Synthetic oligonucleotide"
ccagugcccaauaaggacuu

SEQ ID NO: 2879 - RNA, 20 nt, Artificial Sequence
  source: /note="Description of Artificial Sequence: Synthetic oligonucleotide"
uacaagaccagugcccaaua

SEQ ID NO: 2880 - RNA, 20 nt, Artificial Sequence
  source: /note="Description of Artificial Sequence: Synthetic oligonucleotide"
gagucuuagaagaauugaua

SEQ ID NO: 2881 - RNA, 20 nt, Artificial Sequence
  source: /note="Description of Artificial Sequence: Synthetic oligonucleotide"
ggagucuuagaagaauugau

SEQ ID NO: 2882 - RNA, 20 nt, Artificial Sequence
  source: /note="Description of Artificial Sequence: Synthetic oligonucleotide"
cuuacaacauuguuuggggg

SEQ ID NO: 2883 - RNA, 20 nt, Artificial Sequence
  source: /note="Description of Artificial Sequence: Synthetic oligonucleotide"
ugacuuacaacauuguuugg

SEQ ID NO: 2884 - RNA, 20 nt, Artificial Sequence
  source: /note="Description of Artificial Sequence: Synthetic oligonucleotide"
uugacuuacaacauuguuug

SEQ ID NO: 2885 - RNA, 20 nt, Artificial Sequence
  source: /note="Description of Artificial Sequence: Synthetic oligonucleotide"
uuugacuuacaacauuguuu

SEQ ID NO: 2886 - RNA, 20 nt, Artificial Sequence
  source: /note="Description of Artificial Sequence: Synthetic oligonucleotide"
auuugacuuacaacauuguu

SEQ ID NO: 2887 - RNA, 20 nt, Artificial Sequence
  source: /note="Description of Artificial Sequence: Synthetic oligonucleotide"
cuuaaugaggucaguaauua

SEQ ID NO: 2888 - RNA, 20 nt, Artificial Sequence
  source: /note="Description of Artificial Sequence: Synthetic oligonucleotide"
auaagaagggcuucuuaaug

SEQ ID NO: 2889 - RNA, 20 nt, Artificial Sequence
  source: /note="Description of Artificial Sequence: Synthetic oligonucleotide"
gugccuaugaaucauaagaa

SEQ ID NO: 2890 - RNA, 20 nt, Artificial Sequence
  source: /note="Description of Artificial Sequence: Synthetic oligonucleotide"
ugugccuaugaaucauaaga

SEQ ID NO: 2891 - RNA, 20 nt, Artificial Sequence
  source: /note="Description of Artificial Sequence: Synthetic oligonucleotide"
uggaaaauagaguuucugug

SEQ ID NO: 2892 - RNA, 20 nt, Artificial Sequence
  source: /note="Description of Artificial Sequence: Synthetic oligonucleotide"
uacucagacuuugggcagga

SEQ ID NO: 2893 - RNA, 20 nt, Artificial Sequence
  source: /note="Description of Artificial Sequence: Synthetic oligonucleotide"
uaccuacucagacuuugggc

SEQ ID NO: 2894 - RNA, 20 nt, Artificial Sequence
  source: /note="Description of Artificial Sequence: Synthetic oligonucleotide"
aauuuaccuacucagacuuu

SEQ ID NO: 2895 - RNA, 20 nt, Artificial Sequence
  source: /note="Description of Artificial Sequence: Synthetic oligonucleotide"
gaauuuaccuacucagacuu

SEQ ID NO: 2896 - RNA, 20 nt, Artificial Sequence
  source: /note="Description of Artificial Sequence: Synthetic oligonucleotide"
uuugaagauauuuuauuuca

SEQ ID NO: 2897 - RNA, 20 nt, Artificial Sequence
  source: /note="Description of Artificial Sequence: Synthetic oligonucleotide"
uaacauuaaaacagucuaca

SEQ ID NO: 2898 - RNA, 20 nt, Artificial Sequence
  source: /note="Description of Artificial Sequence: Synthetic oligonucleotide"
uuuuagccuguucccaaggu

SEQ ID NO: 2899 - RNA, 20 nt, Artificial Sequence
  source: /note="Description of Artificial Sequence: Synthetic oligonucleotide"
aaaguuuuagccuguuccca

SEQ ID NO: 2900 - RNA, 20 nt, Artificial Sequence
  source: /note="Description of Artificial Sequence: Synthetic oligonucleotide"
gaugaacaaauacugacagc

SEQ ID NO: 2901 - RNA, 20 nt, Artificial Sequence
  source: /note="Description of Artificial Sequence: Synthetic oligonucleotide"
ccuuaagaacuacugugcaa

SEQ ID NO: 2902 - RNA, 20 nt, Artificial Sequence
  source: /note="Description of Artificial Sequence: Synthetic oligonucleotide"
uauucuauugcugcuggcuu

SEQ ID NO: 2903 - RNA, 20 nt, Artificial Sequence
  source: /note="Description of Artificial Sequence: Synthetic oligonucleotide"
gggagauauucuauugcugc

SEQ ID NO: 2904 - RNA, 20 nt, Artificial Sequence
  source: /note="Description of Artificial Sequence: Synthetic oligonucleotide"
uccaauuguaaaguuggcuu

SEQ ID NO: 2905 - RNA, 20 nt, Artificial Sequence
  source: /note="Description of Artificial Sequence: Synthetic oligonucleotide"
cuccaauuguaaaguuggcu

SEQ ID NO: 2906 - RNA, 20 nt, Artificial Sequence
  source: /note="Description of Artificial Sequence: Synthetic oligonucleotide"
gaaggcuccaauuguaaagu

SEQ ID NO: 2907 - RNA, 20 nt, Artificial Sequence
  source: /note="Description of Artificial Sequence: Synthetic oligonucleotide"
acuggucuuucccacaguga

SEQ ID NO: 2908 - RNA, 20 nt, Artificial Sequence
  source: /note="Description of Artificial Sequence: Synthetic oligonucleotide"
caccagcucuacuuggcaac

SEQ ID NO: 2909 - RNA, 20 nt, Artificial Sequence
  source: /note="Description of Artificial Sequence: Synthetic oligonucleotide"
agauaaccaccagcucuacu

SEQ ID NO: 2910 - RNA, 20 nt, Artificial Sequence
  source: /note="Description of Artificial Sequence: Synthetic oligonucleotide"
auauuuggcaaaaucauuug

SEQ ID NO: 2911 - RNA, 20 nt, Artificial Sequence
  source: /note="Description of Artificial Sequence: Synthetic oligonucleotide"
ccaaguaaauacuguauauu

SEQ ID NO: 2912 - RNA, 20 nt, Artificial Sequence
  source: /note="Description of Artificial Sequence: Synthetic oligonucleotide"
cagugaguagaaauagaaau

SEQ ID NO: 2913 - RNA, 20 nt, Artificial Sequence
  source: /note="Description of Artificial Sequence: Synthetic oligonucleotide"
ucacaguauucacucaguuu

SEQ ID NO: 2914 - RNA, 20 nt, Artificial Sequence
  source: /note="Description of Artificial Sequence: Synthetic oligonucleotide"
ugacuuuccccuuucccucc

SEQ ID NO: 2915 - RNA, 20 nt, Artificial Sequence
  source: /note="Description of Artificial Sequence: Synthetic oligonucleotide"
cagacauacauaauucuuuu

SEQ ID NO: 2916 - RNA, 20 nt, Artificial Sequence
  source: /note="Description of Artificial Sequence: Synthetic oligonucleotide"
auauaggacaaaaauaaugc

SEQ ID NO: 2917 - RNA, 20 nt, Artificial Sequence
  source: /note="Description of Artificial Sequence: Synthetic oligonucleotide"
gucucugcaauguacaauau

SEQ ID NO: 2918 - RNA, 20 nt, Artificial Sequence
  source: /note="Description of Artificial Sequence: Synthetic oligonucleotide"
ccaaaauuuguuauuuggaa

SEQ ID NO: 2919 - RNA, 20 nt, Artificial Sequence
  source: /note="Description of Artificial Sequence: Synthetic oligonucleotide"
gggauccaaaauuuguuauu

SEQ ID NO: 2920 - RNA, 20 nt, Artificial Sequence
  source: /note="Description of Artificial Sequence: Synthetic oligonucleotide"
aggguuucacgauccuaaug

SEQ ID NO: 2921 - RNA, 20 nt, Artificial Sequence
  source: /note="Description of Artificial Sequence: Synthetic oligonucleotide"
ggaaccggaggguuucacga

SEQ ID NO: 2922 - RNA, 20 nt, Artificial Sequence
  source: /note="Description of Artificial Sequence: Synthetic oligonucleotide"
ggaguucacuagagagugga

SEQ ID NO: 2923 - RNA, 20 nt, Artificial Sequence
  source: /note="Description of Artificial Sequence: Synthetic oligonucleotide"
ggucccaccaaaguuugagg

SEQ ID NO: 2924 - RNA, 20 nt, Artificial Sequence
  source: /note="Description of Artificial Sequence: Synthetic oligonucleotide"
ggacugacacaacggguccc

SEQ ID NO: 2925 - RNA, 20 nt, Artificial Sequence
  source: /note="Description of Artificial Sequence: Synthetic oligonucleotide"
cccggacugacacaacgggu

SEQ ID NO: 2926 - RNA, 20 nt, Artificial Sequence
  source: /note="Description of Artificial Sequence: Synthetic oligonucleotide"
ccccggacugacacaacggg

SEQ ID NO: 2927 - RNA, 20 nt, Artificial Sequence
  source: /note="Description of Artificial Sequence: Synthetic oligonucleotide"
auuuaaaaaacaucucugac

SEQ ID NO: 2928 - RNA, 20 nt, Artificial Sequence
  source: /note="Description of Artificial Sequence: Synthetic oligonucleotide"
aauuuaaaaaacaucucuga

SEQ ID NO: 2929 - RNA, 20 nt, Artificial Sequence
  source: /note="Description of Artificial Sequence: Synthetic oligonucleotide"
aaauuuaaaaaacaucucug

SEQ ID NO: 2930 - RNA, 20 nt, Artificial Sequence
  source: /note="Description of Artificial Sequence: Synthetic oligonucleotide"
aggacucaucgacccugaug

SEQ ID NO: 2931 - RNA, 20 nt, Artificial Sequence
  source: /note="Description of Artificial Sequence: Synthetic oligonucleotide"
agagucagaggacucaucga

SEQ ID NO: 2932 - RNA, 20 nt, Artificial Sequence
  source: /note="Description of Artificial Sequence: Synthetic oligonucleotide"
uagagucagaggacucaucg

SEQ ID NO: 2933 - RNA, 20 nt, Artificial Sequence
  source: /note="Description of Artificial Sequence: Synthetic oligonucleotide"
aacggacccgaccucgcguc

SEQ ID NO: 2934 - RNA, 20 nt, Artificial Sequence
  source: /note="Description of Artificial Sequence: Synthetic oligonucleotide"
agagagggagaacggacccg

SEQ ID NO: 2935 - RNA, 20 nt, Artificial Sequence
  source: /note="Description of Artificial Sequence: Synthetic oligonucleotide"
ucccagagagggagaacgga

SEQ ID NO: 2936 - RNA, 20 nt, Artificial Sequence
  source: /note="Description of Artificial Sequence: Synthetic oligonucleotide"
aucccagagagggagaacgg

SEQ ID NO: 2937 - RNA, 20 nt, Artificial Sequence
  source: /note="Description of Artificial Sequence: Synthetic oligonucleotide"
acaacacgcugaaacucuau

SEQ ID NO: 2938 - RNA, 20 nt, Artificial Sequence
  source: /note="Description of Artificial Sequence: Synthetic oligonucleotide"
aacaacacgcugaaacucua

SEQ ID NO: 2939 - RNA, 20 nt, Artificial Sequence
  source: /note="Description of Artificial Sequence: Synthetic oligonucleotide"
aaugugcuuaaaacaaacaa

SEQ ID NO: 2940 - RNA, 20 nt, Artificial Sequence
  source: /note="Description of Artificial Sequence: Synthetic oligonucleotide"
gaauucuuaaaacugcaggu

SEQ ID NO: 2941 - RNA, 20 nt, Artificial Sequence
  source: /note="Description of Artificial Sequence: Synthetic oligonucleotide"
uucugaauucuuaaaacugc

SEQ ID NO: 2942 - RNA, 20 nt, Artificial Sequence
  source: /note="Description of Artificial Sequence: Synthetic oligonucleotide"
ggucuuacucgguggugugg

SEQ ID NO: 2943 - RNA, 20 nt, Artificial Sequence
  source: /note="Description of Artificial Sequence: Synthetic oligonucleotide"
gguccgaccagaucuugaag

SEQ ID NO: 2944 - RNA, 20 nt, Artificial Sequence
  source: /note="Description of Artificial Sequence: Synthetic oligonucleotide"
agagugauacaacggguccg

SEQ ID NO: 2945 - RNA, 20 nt, Artificial Sequence
  source: /note="Description of Artificial Sequence: Synthetic oligonucleotide"
ccauagagugauacaacggg

SEQ ID NO: 2946 - RNA, 20 nt, Artificial Sequence
  source: /note="Description of Artificial Sequence: Synthetic oligonucleotide"
auaaaaauaacuuaucucug

SEQ ID NO: 2947 - RNA, 20 nt, Artificial Sequence
  source: /note="Description of Artificial Sequence: Synthetic oligonucleotide"
augauuucaagucaguuuag

SEQ ID NO: 2948 - RNA, 20 nt, Artificial Sequence
  source: /note="Description of Artificial Sequence: Synthetic oligonucleotide"
acuuuaauucucaguuuauu

SEQ ID NO: 2949 - RNA, 20 nt, Artificial Sequence
  source: /note="Description of Artificial Sequence: Synthetic oligonucleotide"
guccguacucggugguguug

SEQ ID NO: 2950 - RNA, 20 nt, Artificial Sequence
  source: /note="Description of Artificial Sequence: Synthetic oligonucleotide"
aggguuucacgacccuaaug

SEQ ID NO: 2951 - RNA, 20 nt, Artificial Sequence
  source: /note="Description of Artificial Sequence: Synthetic oligonucleotide"
ggaacagcaggguuucacga

SEQ ID NO: 2952 - RNA, 20 nt, Artificial Sequence
  source: /note="Description of Artificial Sequence: Synthetic oligonucleotide"
cggaacagcaggguuucacg

SEQ ID NO: 2953 - RNA, 20 nt, Artificial Sequence
  source: /note="Description of Artificial Sequence: Synthetic oligonucleotide"
ccagaguuugaggacuggag

SEQ ID NO: 2954 - RNA, 20 nt, Artificial Sequence
  source: /note="Description of Artificial Sequence: Synthetic oligonucleotide"
aaagugguacaaccgguccg

SEQ ID NO: 2955 - RNA, 20 nt, Artificial Sequence
  source: /note="Description of Artificial Sequence: Synthetic oligonucleotide"
ucccaaagugguacaaccgg

SEQ ID NO: 2956 - RNA, 20 nt, Artificial Sequence
  source: /note="Description of Artificial Sequence: Synthetic oligonucleotide"
cucugucccaaagugguaca

SEQ ID NO: 2957 - RNA, 20 nt, Artificial Sequence
  source: /note="Description of Artificial Sequence: Synthetic oligonucleotide"
aacauaaaaaucaucucugu

SEQ ID NO: 2958 - RNA, 20 nt, Artificial Sequence
  source: /note="Description of Artificial Sequence: Synthetic oligonucleotide"
aaacauaaaaaucaucucug

SEQ ID NO: 2959 - RNA, 20 nt, Artificial Sequence
  source: /note="Description of Artificial Sequence: Synthetic oligonucleotide"
gaccacacacggugguacgg

SEQ ID NO: 2960 - RNA, 20 nt, Artificial Sequence
  source: /note="Description of Artificial Sequence: Synthetic oligonucleotide"
aggacucaucgacccuaaug

SEQ ID NO: 2961 - RNA, 20 nt, Artificial Sequence
  source: /note="Description of Artificial Sequence: Synthetic oligonucleotide"
ggagucggaggacucaucga

SEQ ID NO: 2962 - RNA, 20 nt, Artificial Sequence
  source: /note="Description of Artificial Sequence: Synthetic oligonucleotide"
cggagucggaggacucaucg

SEQ ID NO: 2963 - RNA, 20 nt, Artificial Sequence
  source: /note="Description of Artificial Sequence: Synthetic oligonucleotide"
ggguccgaguucacuaagag

SEQ ID NO: 2964 - RNA, 20 nt, Artificial Sequence
  source: /note="Description of Artificial Sequence: Synthetic oligonucleotide"
cggguccgaguucacuaaga

SEQ ID NO: 2965 - RNA, 20 nt, Artificial Sequence
  source: /note="Description of Artificial Sequence: Synthetic oligonucleotide"
uccauacucggugguacggg

SEQ ID NO: 2966 - RNA, 20 nt, Artificial Sequence
  source: /note="Description of Artificial Sequence: Synthetic oligonucleotide"
aggguuucacgacccuaaua

SEQ ID NO: 2967 - RNA, 20 nt, Artificial Sequence
  source: /note="Description of Artificial Sequence: Synthetic oligonucleotide"
ggagccggaggguuucacga

SEQ ID NO: 2968 - RNA, 20 nt, Artificial Sequence
  source: /note="Description of Artificial Sequence: Synthetic oligonucleotide"
cggagccggaggguuucacg

SEQ ID NO: 2969 - RNA, 20 nt, Artificial Sequence
  source: /note="Description of Artificial Sequence: Synthetic oligonucleotide"
caguccacuagguggacgga

SEQ ID NO: 2970 - RNA, 20 nt, Artificial Sequence
  source: /note="Description of Artificial Sequence: Synthetic oligonucleotide"
ccagagcuuaaggacugcag

SEQ ID NO: 2971 - RNA, 20 nt, Artificial Sequence
  source: /note="Description of Artificial Sequence: Synthetic oligonucleotide"
aaagugguacaaccggucug

SEQ ID NO: 2972 - RNA, 20 nt, Artificial Sequence
  source: /note="Description of Artificial Sequence: Synthetic oligonucleotide"
cucuaccccaaagugguaca

SEQ ID NO: 2973 - RNA, 20 nt, Artificial Sequence
  source: /note="Description of Artificial Sequence: Synthetic oligonucleotide"
aacauacaaaucaccucuac

SEQ ID NO: 2974 - RNA, 20 nt, Artificial Sequence
  source: /note="Description of Artificial Sequence: Synthetic oligonucleotide"
aaacauacaaaucaccucua

SEQ ID NO: 2975 - RNA, 20 nt, Artificial Sequence
  source: /note="Description of Artificial Sequence: Synthetic oligonucleotide"
aaaacauacaaaucaccucu

SEQ ID NO: 2976 - RNA, 20 nt, Artificial Sequence
  source: /note="Description of Artificial Sequence: Synthetic oligonucleotide"
ucgauuaaaacauacaaauc

SEQ ID NO: 2977 - RNA, 20 nt, Artificial Sequence
  source: /note="Description of Artificial Sequence: Synthetic oligonucleotide"
aggucuuaucgacucugaug

SEQ ID NO: 2978 - RNA, 20 nt, Artificial Sequence
  source: /note="Description of Artificial Sequence: Synthetic oligonucleotide"
cgucggagacggagggcccu

SEQ ID NO: 2979 - RNA, 20 nt, Artificial Sequence
  source: /note="Description of Artificial Sequence: Synthetic oligonucleotide"
gcgucggagacggagggccc

SEQ ID NO: 2980 - RNA, 20 nt, Artificial Sequence
  source: /note="Description of Artificial Sequence: Synthetic oligonucleotide"
guggcgucggagacggaggg

SEQ ID NO: 2981 - RNA, 20 nt, Artificial Sequence
  source: /note="Description of Artificial Sequence: Synthetic oligonucleotide"
aguggcgucggagacggagg

SEQ ID NO: 2982 - RNA, 20 nt, Artificial Sequence
  source: /note="Description of Artificial Sequence: Synthetic oligonucleotide"
ccucacgucgucucgguaga

SEQ ID NO: 2983 - RNA, 20 nt, Artificial Sequence
  source: /note="Description of Artificial Sequence: Synthetic oligonucleotide"
agagagacggagcggguccg

SEQ ID NO: 2984 - RNA, 20 nt, Artificial Sequence
  source: /note="Description of Artificial Sequence: Synthetic oligonucleotide"
ucucagagagacggagcggg

SEQ ID NO: 2985 - RNA, 20 nt, Artificial Sequence
  source: /note="Description of Artificial Sequence: Synthetic oligonucleotide"
uuauuaaaaaagaaaaaaac

SEQ ID NO: 2986 - RNA, 20 nt, Artificial Sequence
  source: /note="Description of Artificial Sequence: Synthetic oligonucleotide"
gucaacaguagguucuauua

SEQ ID NO: 2987 - RNA, 20 nt, Artificial Sequence
  source: /note="Description of Artificial Sequence: Synthetic oligonucleotide"
ggucaacaguagguucuauu

SEQ ID NO: 2988 - RNA, 20 nt, Artificial Sequence
  source: /note="Description of Artificial Sequence: Synthetic oligonucleotide"
uugacugagaggucaacagu

SEQ ID NO: 2989 - RNA, 20 nt, Artificial Sequence
  source: /note="Description of Artificial Sequence: Synthetic oligonucleotide"
uccauuaaauauugacugag

SEQ ID NO: 2990 - RNA, 20 nt, Artificial Sequence
  source: /note="Description of Artificial Sequence: Synthetic oligonucleotide"
uuuuuucuaguuaaauugca

SEQ ID NO: 2991 - RNA, 20 nt, Artificial Sequence
  source: /note="Description of Artificial Sequence: Synthetic oligonucleotide"
uuucuuucuuugaaagaaaa

SEQ ID NO: 2992 - RNA, 20 nt, Artificial Sequence
  source: /note="Description of Artificial Sequence: Synthetic oligonucleotide"
uguggugacgugaggucgga

SEQ ID NO: 2993 - RNA, 20 nt, Artificial Sequence
  source: /note="Description of Artificial Sequence: Synthetic oligonucleotide"
gugaacuuggaccuuccguc

SEQ ID NO: 2994 - RNA, 20 nt, Artificial Sequence
  source: /note="Description of Artificial Sequence: Synthetic oligonucleotide"
cucuuagugaacuuggaccu

SEQ ID NO: 2995 - RNA, 20 nt, Artificial Sequence
  source: /note="Description of Artificial Sequence: Synthetic oligonucleotide"
cuuucucuuagugaacuugg

SEQ ID NO: 2996 - RNA, 20 nt, Artificial Sequence
  source: /note="Description of Artificial Sequence: Synthetic oligonucleotide"
ggaucagggucgaugagacc

SEQ ID NO: 2997 - RNA, 20 nt, Artificial Sequence
  source: /note="Description of Artificial Sequence: Synthetic oligonucleotide"
aggaucagggucgaugagac

SEQ ID NO: 2998 - RNA, 20 nt, Artificial Sequence
  source: /note="Description of Artificial Sequence: Synthetic oligonucleotide"
gaggaucagggucgaugaga

SEQ ID NO: 2999 - RNA, 20 nt, Artificial Sequence
  source: /note="Description of Artificial Sequence: Synthetic oligonucleotide"
cgaggaucagggucgaugag

SEQ ID NO: 3000 - RNA, 20 nt, Artificial Sequence
  source: /note="Description of Artificial Sequence: Synthetic oligonucleotide"
uuuuaaucgguccacaccac

SEQ ID NO: 3001 - RNA, 20 nt, Artificial Sequence
  source: /note="Description of Artificial Sequence: Synthetic oligonucleotide"
uuuuuaaucgguccacacca

SEQ ID NO: 3002 - RNA, 20 nt, Artificial Sequence
  source: /note="Description of Artificial Sequence: Synthetic oligonucleotide"
cuuuuuaaucgguccacacc

SEQ ID NO: 3003 - RNA, 20 nt, Artificial Sequence
  source: /note="Description of Artificial Sequence: Synthetic oligonucleotide"
uaucuuuuuaaucgguccac

SEQ ID NO: 3004 - RNA, 20 nt, Artificial Sequence
  source: /note="Description of Artificial Sequence: Synthetic oligonucleotide"
auuuuuaucuuuuuaaucgg

SEQ ID NO: 3005 - RNA, 20 nt, Artificial Sequence
  source: /note="Description of Artificial Sequence: Synthetic oligonucleotide"
gcucuagucggaccgguugu

SEQ ID NO: 3006 - RNA, 20 nt, Artificial Sequence
  source: /note="Description of Artificial Sequence: Synthetic oligonucleotide"
gguccucaugcucuagucgg

SEQ ID NO: 3007 - RNA, 20 nt, Artificial Sequence
  source: /note="Description of Artificial Sequence: Synthetic oligonucleotide"
guccgucuaguggacucugg

SEQ ID NO: 3008 - RNA, 20 nt, Artificial Sequence
  source: /note="Description of Artificial Sequence: Synthetic oligonucleotide"
cgugaaacccucugggcccg

SEQ ID NO: 3009 - RNA, 20 nt, Artificial Sequence
  source: /note="Description of Artificial Sequence: Synthetic oligonucleotide"
gggucgugaaacccucuggg

SEQ ID NO: 3010 - RNA, 20 nt, Artificial Sequence
  source: /note="Description of Artificial Sequence: Synthetic oligonucleotide"
agggucgugaaacccucugg

SEQ ID NO: 3011 - RNA, 20 nt, Artificial Sequence
  source: /note="Description of Artificial Sequence: Synthetic oligonucleotide"
cggacauuagggucgugaaa

SEQ ID NO: 3012 - RNA, 20 nt, Artificial Sequence
  source: /note="Description of Artificial Sequence: Synthetic oligonucleotide"
acggacauuagggucgugaa

SEQ ID NO: 3013 - RNA, 20 nt, Artificial Sequence
  source: /note="Description of Artificial Sequence: Synthetic oligonucleotide"
auagauuacugguccacguc

SEQ ID NO: 3014 - RNA, 20 nt, Artificial Sequence
  source: /note="Description of Artificial Sequence: Synthetic oligonucleotide"
cauugaaaauagauuacugg

SEQ ID NO: 3015 - RNA, 20 nt, Artificial Sequence
  source: /note="Description of Artificial Sequence: Synthetic oligonucleotide"
gccuguagaaauuaaaugua

SEQ ID NO: 3016 - RNA, 20 nt, Artificial Sequence
  source: /note="Description of Artificial Sequence: Synthetic oligonucleotide"
uaaaauggguggcuuuuaua

SEQ ID NO: 3017 - RNA, 20 nt, Artificial Sequence
  source: /note="Description of Artificial Sequence: Synthetic oligonucleotide"
uuaaaauggguggcuuuuau

SEQ ID NO: 3018 - RNA, 20 nt, Artificial Sequence
  source: /note="Description of Artificial Sequence: Synthetic oligonucleotide"
acuuuugugcuuaaaauggg

SEQ ID NO: 3019 - RNA, 20 nt, Artificial Sequence
  source: /note="Description of Artificial Sequence: Synthetic oligonucleotide"
uucacuuuugugcuuaaaau

SEQ ID NO: 3020 - RNA, 20 nt, Artificial Sequence
  source: /note="Description of Artificial Sequence: Synthetic oligonucleotide"
auucacuuuugugcuuaaaa

SEQ ID NO: 3021 - RNA, 20 nt, Artificial Sequence
  source: /note="Description of Artificial Sequence: Synthetic oligonucleotide"
gagacauaauaaaguauguu

SEQ ID NO: 3022 - RNA, 20 nt, Artificial Sequence
  source: /note="Description of Artificial Sequence: Synthetic oligonucleotide"
ccuuuaacucguucauaugc

SEQ ID NO: 3023 - RNA, 20 nt, Artificial Sequence
  source: /note="Description of Artificial Sequence: Synthetic oligonucleotide"
aacguuucacaacggugacc

SEQ ID NO: 3024 - RNA, 20 nt, Artificial Sequence
  source: /note="Description of Artificial Sequence: Synthetic oligonucleotide"
aaacguuucacaacggugac

SEQ ID NO: 3025 - RNA, 20 nt, Artificial Sequence
  source: /note="Description of Artificial Sequence: Synthetic oligonucleotide"
aaaacguuucacaacgguga

SEQ ID NO: 3026 - RNA, 20 nt, Artificial Sequence
  source: /note="Description of Artificial Sequence: Synthetic oligonucleotide"
caaaacguuucacaacggug

SEQ ID NO: 3027 - RNA, 20 nt, Artificial Sequence
  source: /note="Description of Artificial Sequence: Synthetic oligonucleotide"
gguguaguuacagucauagu

SEQ ID NO: 3028 - RNA, 20 nt, Artificial Sequence
  source: /note="Description of Artificial Sequence: Synthetic oligonucleotide"
cuguagacuuauucuaauca

SEQ ID NO: 3029 - RNA, 20 nt, Artificial Sequence
  source: /note="Description of Artificial Sequence: Synthetic oligonucleotide"
uuacucauguucaauuugac

SEQ ID NO: 3030 - RNA, 20 nt, Artificial Sequence
  source: /note="Description of Artificial Sequence: Synthetic oligonucleotide"
uaugugauguacacugauuu

SEQ ID NO: 3031 - RNA, 20 nt, Artificial Sequence
  source: /note="Description of Artificial Sequence: Synthetic oligonucleotide"
uucucuguuuugagaaaaaa

SEQ ID NO: 3032 - RNA, 20 nt, Artificial Sequence
  source: /note="Description of Artificial Sequence: Synthetic oligonucleotide"
uucugacacacauuuuaaua

SEQ ID NO: 3033 - RNA, 20 nt, Artificial Sequence
  source: /note="Description of Artificial Sequence: Synthetic oligonucleotide"
aaggccauucuaucaaaaaa

SEQ ID NO: 3034 - RNA, 20 nt, Artificial Sequence
  source: /note="Description of Artificial Sequence: Synthetic oligonucleotide"
uuaaaauauuuuuaacauaa

SEQ ID NO: 3035 - RNA, 20 nt, Artificial Sequence
  source: /note="Description of Artificial Sequence: Synthetic oligonucleotide"
uucuuauuauggauagagau

SEQ ID NO: 3036 - RNA, 20 nt, Artificial Sequence
  source: /note="Description of Artificial Sequence: Synthetic oligonucleotide"
auucuuauuauggauagaga

SEQ ID NO: 3037 - RNA, 20 nt, Artificial Sequence
  source: /note="Description of Artificial Sequence: Synthetic oligonucleotide"
ucaaaggagugaguauuuau

SEQ ID NO: 3038 - RNA, 20 nt, Artificial Sequence
  source: /note="Description of Artificial Sequence: Synthetic oligonucleotide"
gucaaaggagugaguauuua

SEQ ID NO: 3039 - RNA, 20 nt, Artificial Sequence
  source: /note="Description of Artificial Sequence: Synthetic oligonucleotide"
ccuucaauaaauuggaguga

SEQ ID NO: 3040 - RNA, 20 nt, Artificial Sequence
  source: /note="Description of Artificial Sequence: Synthetic oligonucleotide"
uccuucaauaaauuggagug

SEQ ID NO: 3041 - RNA, 20 nt, Artificial Sequence
  source: /note="Description of Artificial Sequence: Synthetic oligonucleotide"
cauauccgacauacuugaau

SEQ ID NO: 3042 - RNA, 20 nt, Artificial Sequence
  source: /note="Description of Artificial Sequence: Synthetic oligonucleotide"
cgauucggauucgguacaua

SEQ ID NO: 3043 - RNA, 20 nt, Artificial Sequence
  source: /note="Description of Artificial Sequence: Synthetic oligonucleotide"
ucugacgaauugaguuuacg

SEQ ID NO: 3044 - RNA, 20 nt, Artificial Sequence
  source: /note="Description of Artificial Sequence: Synthetic oligonucleotide"
uuauaucacuaauuuucuaa

SEQ ID NO: 3045 - RNA, 20 nt, Artificial Sequence
  source: /note="Description of Artificial Sequence: Synthetic oligonucleotide"
uauuacgacauuacuuguaa

SEQ ID NO: 3046 - RNA, 20 nt, Artificial Sequence
  source: /note="Description of Artificial Sequence: Synthetic oligonucleotide"
aguacuguacuaucuguaga

SEQ ID NO: 3047 - RNA, 20 nt, Artificial Sequence
  source: /note="Description of Artificial Sequence: Synthetic oligonucleotide"
gaguacuguacuaucuguag

SEQ ID NO: 3048 - RNA, 20 nt, Artificial Sequence
  source: /note="Description of Artificial Sequence: Synthetic oligonucleotide"
gaauuauuauaaagugacau

SEQ ID NO: 3049 - RNA, 20 nt, Artificial Sequence
  source: /note="Description of Artificial Sequence: Synthetic oligonucleotide"
uuaacuuucguauaguauac

SEQ ID NO: 3050 - RNA, 20 nt, Artificial Sequence
  source: /note="Description of Artificial Sequence: Synthetic oligonucleotide"
gaggaaucuaaacggauaag

SEQ ID NO: 3051 - RNA, 20 nt, Artificial Sequence
  source: /note="Description of Artificial Sequence: Synthetic oligonucleotide"
uuucuuuagaguaugaauaa

SEQ ID NO: 3052 - RNA, 20 nt, Artificial Sequence
  source: /note="Description of Artificial Sequence: Synthetic oligonucleotide"
aagucguauaaguuucucaa

SEQ ID NO: 3053 - RNA, 20 nt, Artificial Sequence
  source: /note="Description of Artificial Sequence: Synthetic oligonucleotide"
aaagucguauaaguuucuca

SEQ ID NO: 3054 - RNA, 20 nt, Artificial Sequence
  source: /note="Description of Artificial Sequence: Synthetic oligonucleotide"
aaauuucguauauuaaguca

SEQ ID NO: 3055 - RNA, 20 nt, Artificial Sequence
  source: /note="Description of Artificial Sequence: Synthetic oligonucleotide"
aaaauuucguauauuaaguc

SEQ ID NO: 3056 - RNA, 20 nt, Artificial Sequence
  source: /note="Description of Artificial Sequence: Synthetic oligonucleotide"
aggguuucacgguccuaaug

SEQ ID NO: 3057 - RNA, 20 nt, Artificial Sequence
  source: /note="Description of Artificial Sequence: Synthetic oligonucleotide"
ggaaccggaggguuucacgg

SEQ ID NO: 3058 - RNA, 20 nt, Artificial Sequence
  source: /note="Description of Artificial Sequence: Synthetic oligonucleotide"
uuugaagaccagagggcgga

SEQ ID NO: 3059 - RNA, 20 nt, Artificial Sequence
  source: /note="Description of Artificial Sequence: Synthetic oligonucleotide"
ggucugauuagaguuugaag

SEQ ID NO: 3060 - RNA, 20 nt, Artificial Sequence
  source: /note="Description of Artificial Sequence: Synthetic oligonucleotide"
guauccuucucaucuauaag

SEQ ID NO: 3061 - RNA, 20 nt, Artificial Sequence
  source: /note="Description of Artificial Sequence: Synthetic oligonucleotide"
ucuucccauaugagcucuaa

SEQ ID NO: 3062 - RNA, 20 nt, Artificial Sequence
  source: /note="Description of Artificial Sequence: Synthetic oligonucleotide"
aucuccugaacugaauggcu

SEQ ID NO: 3063 - RNA, 20 nt, Artificial Sequence
  source: /note="Description of Artificial Sequence: Synthetic oligonucleotide"
guuacaucuccugaacugaa

SEQ ID NO: 3064 - RNA, 20 nt, Artificial Sequence
  source: /note="Description of Artificial Sequence: Synthetic oligonucleotide"
agacauuccuuuuaacacuu

SEQ ID NO: 3065 - RNA, 20 nt, Artificial Sequence
  source: /note="Description of Artificial Sequence: Synthetic oligonucleotide"
cagacauuccuuuuaacacu

SEQ ID NO: 3066 - RNA, 20 nt, Artificial Sequence
  source: /note="Description of Artificial Sequence: Synthetic oligonucleotide"
agcguuucacgacccuaaug

SEQ ID NO: 3067 - RNA, 20 nt, Artificial Sequence
  source: /note="Description of Artificial Sequence: Synthetic oligonucleotide"
gaaggcggagcguuucacga

SEQ ID NO: 3068 - RNA, 20 nt, Artificial Sequence
  source: /note="Description of Artificial Sequence: Synthetic oligonucleotide"
ugaaggcggagcguuucacg

SEQ ID NO: 3069 - RNA, 20 nt, Artificial Sequence
  source: /note="Description of Artificial Sequence: Synthetic oligonucleotide"
ccccaaaacgguacaacggg

SEQ ID NO: 3070 - RNA, 20 nt, Artificial Sequence
  source: /note="Description of Artificial Sequence: Synthetic oligonucleotide"
cacguaaaaaacaucccuac

SEQ ID NO: 3071 - RNA, 20 nt, Artificial Sequence
  source: /note="Description of Artificial Sequence: Synthetic oligonucleotide"
acacguaaaaaacaucccua

SEQ ID NO: 3072 - RNA, 20 nt, Artificial Sequence
  source: /note="Description of Artificial Sequence: Synthetic oligonucleotide"
aacacguaaaaaacaucccu

SEQ ID NO: 3073 - RNA, 20 nt, Artificial Sequence
  source: /note="Description of Artificial Sequence: Synthetic oligonucleotide"
auuaaacacguaaaaaacau

SEQ ID NO: 3074 - RNA, 20 nt, Artificial Sequence
  source: /note="Description of Artificial Sequence: Synthetic oligonucleotide"
gauuaaacacguaaaaaaca

SEQ ID NO: 3075 - RNA, 20 nt, Artificial Sequence
  source: /note="Description of Artificial Sequence: Synthetic oligonucleotide"
guguucauggaccuugaugu

SEQ ID NO: 3076 - RNA, 20 nt, Artificial Sequence
  source: /note="Description of Artificial Sequence: Synthetic oligonucleotide"
gguguucauggaccuugaug

SEQ ID NO: 3077 - RNA, 20 nt, Artificial Sequence
  source: /note="Description of Artificial Sequence: Synthetic oligonucleotide"
cggagucgggguguucaugg

SEQ ID NO: 3078 - RNA, 20 nt, Artificial Sequence
  source: /note="Description of Artificial Sequence: Synthetic oligonucleotide"
gugacgucggaguugaaggg

SEQ ID NO: 3079 - RNA, 20 nt, Artificial Sequence
  source: /note="Description of Artificial Sequence: Synthetic oligonucleotide"
cuucacacccccgugguugu

SEQ ID NO: 3080 - RNA, 20 nt, Artificial Sequence
  source: /note="Description of Artificial Sequence: Synthetic oligonucleotide"
aguggguccgacuucacacc

SEQ ID NO: 3081 - RNA, 20 nt, Artificial Sequence
  source: /note="Description of Artificial Sequence: Synthetic oligonucleotide"
caguggguccgacuucacac

SEQ ID NO: 3082 - RNA, 20 nt, Artificial Sequence
  source: /note="Description of Artificial Sequence: Synthetic oligonucleotide"
acaguggguccgacuucaca

SEQ ID NO: 3083 - RNA, 20 nt, Artificial Sequence
  source: /note="Description of Artificial Sequence: Synthetic oligonucleotide"
aacaguggguccgacuucac

SEQ ID NO: 3084 - RNA, 20 nt, Artificial Sequence
  source: /note="Description of Artificial Sequence: Synthetic oligonucleotide"
ucccagaguaaaacaguggg

SEQ ID NO: 3085 - RNA, 20 nt, Artificial Sequence
  source: /note="Description of Artificial Sequence: Synthetic oligonucleotide"
uagaaaaaaaaacucucucu

SEQ ID NO: 3086 - RNA, 20 nt, Artificial Sequence
  source: /note="Description of Artificial Sequence: Synthetic oligonucleotide"
auagaaaaaaaaacucucuc

SEQ ID NO: 3087 - RNA, 20 nt, Artificial Sequence
  source: /note="Description of Artificial Sequence: Synthetic oligonucleotide"
aaaaucugaaacaugacaag

SEQ ID NO: 3088 - RNA, 20 nt, Artificial Sequence
  source: /note="Description of Artificial Sequence: Synthetic oligonucleotide"
augccacaguaucaguuaac

SEQ ID NO: 3089 - RNA, 20 nt, Artificial Sequence
  source: /note="Description of Artificial Sequence: Synthetic oligonucleotide"
cccuguuucucacuuugucc

SEQ ID NO: 3090 - RNA, 20 nt, Artificial Sequence
  source: /note="Description of Artificial Sequence: Synthetic oligonucleotide"
gcagccauguguagcaaaga

SEQ ID NO: 3091 - RNA, 20 nt, Artificial Sequence
  source: /note="Description of Artificial Sequence: Synthetic oligonucleotide"
gugguuuguagaaguucugc

SEQ ID NO: 3092 - RNA, 20 nt, Artificial Sequence
  source: /note="Description of Artificial Sequence: Synthetic oligonucleotide"
gcacucauuuuaccuguaag

SEQ ID NO: 3093 - RNA, 20 nt, Artificial Sequence
  source: /note="Description of Artificial Sequence: Synthetic oligonucleotide"
cuacaagucauaguuccaua

SEQ ID NO: 3094 - RNA, 20 nt, Artificial Sequence
  source: /note="Description of Artificial Sequence: Synthetic oligonucleotide"
acuacaagucauaguuccau

SEQ ID NO: 3095 - RNA, 20 nt, Artificial Sequence
  source: /note="Description of Artificial Sequence: Synthetic oligonucleotide"
cugguaucuagaauuacaua

SEQ ID NO: 3096 - RNA, 20 nt, Artificial Sequence
  source: /note="Description of Artificial Sequence: Synthetic oligonucleotide"
cauugcacaacaagaauguc

SEQ ID NO: 3097 - RNA, 20 nt, Artificial Sequence
  source: /note="Description of Artificial Sequence: Synthetic oligonucleotide"
cauucucaugagaauaaaaa

SEQ ID NO: 3098 - RNA, 20 nt, Artificial Sequence
  source: /note="Description of Artificial Sequence: Synthetic oligonucleotide"
gcauucucaugagaauaaaa

SEQ ID NO: 3099 - RNA, 20 nt, Artificial Sequence
  source: /note="Description of Artificial Sequence: Synthetic oligonucleotide"
cccaagguaugggauccaac

SEQ ID NO: 3100 - RNA, 20 nt, Artificial Sequence
  source: /note="Description of Artificial Sequence: Synthetic oligonucleotide"
cagucauggucccaagguau

SEQ ID NO: 3101 - RNA, 20 nt, Artificial Sequence
  source: /note="Description of Artificial Sequence: Synthetic oligonucleotide"
ucagucauggucccaaggua

SEQ ID NO: 3102 - RNA, 20 nt, Artificial Sequence
  source: /note="Description of Artificial Sequence: Synthetic oligonucleotide"
aguuaucagucaugguccca

SEQ ID NO: 3103 - RNA, 20 nt, Artificial Sequence
  source: /note="Description of Artificial Sequence: Synthetic oligonucleotide"
uccacuccaguuaucaguca

SEQ ID NO: 3104 - RNA, 20 nt, Artificial Sequence
  source: /note="Description of Artificial Sequence: Synthetic oligonucleotide"
agccaauauacuuccuuauu

SEQ ID NO: 3105 - RNA, 20 nt, Artificial Sequence
  source: /note="Description of Artificial Sequence: Synthetic oligonucleotide"
aagccaauauacuuccuuau

SEQ ID NO: 3106 - RNA, 20 nt, Artificial Sequence
  source: /note="Description of Artificial Sequence: Synthetic oligonucleotide"
cuaacaugagcaucuaucuu

SEQ ID NO: 3107 - RNA, 20 nt, Artificial Sequence
  source: /note="Description of Artificial Sequence: Synthetic oligonucleotide"
ucuaacaugagcaucuaucu

SEQ ID NO: 3108 - RNA, 20 nt, Artificial Sequence
  source: /note="Description of Artificial Sequence: Synthetic oligonucleotide"
cacuacaccaacuucuuaau

SEQ ID NO: 3109 - RNA, 20 nt, Artificial Sequence
  source: /note="Description of Artificial Sequence: Synthetic oligonucleotide"
ucacuacaccaacuucuuaa

SEQ ID NO: 3110 - RNA, 20 nt, Artificial Sequence
  source: /note="Description of Artificial Sequence: Synthetic oligonucleotide"
agcuagucauuucuccagua

SEQ ID NO: 3111 - RNA, 20 nt, Artificial Sequence
  source: /note="Description of Artificial Sequence: Synthetic oligonucleotide"
aaauuuauagucagcugagg

SEQ ID NO: 3112 - RNA, 20 nt, Artificial Sequence
  source: /note="Description of Artificial Sequence: Synthetic oligonucleotide"
caaaaauuuauagucagcug

SEQ ID NO: 3113 - RNA, 20 nt, Artificial Sequence
  source: /note="Description of Artificial Sequence: Synthetic oligonucleotide"
gaacaacuuuuuuaaaauua

SEQ ID NO: 3114 - RNA, 20 nt, Artificial Sequence
  source: /note="Description of Artificial Sequence: Synthetic oligonucleotide"
gagaacagauuuacauuuuu

SEQ ID NO: 3115 - RNA, 20 nt, Artificial Sequence
  source: /note="Description of Artificial Sequence: Synthetic oligonucleotide"
cauuuuucuucuuuugaaua

SEQ ID NO: 3116 - RNA, 20 nt, Artificial Sequence
  source: /note="Description of Artificial Sequence: Synthetic oligonucleotide"
gcauuucuaugccugaacau

SEQ ID NO: 3117 - RNA, 20 nt, Artificial Sequence
  source: /note="Description of Artificial Sequence: Synthetic oligonucleotide"
aaaaauaucaauacucugua

SEQ ID NO: 3118 - RNA, 20 nt, Artificial Sequence
  source: /note="Description of Artificial Sequence: Synthetic oligonucleotide"
gguuuuagcaauggcuaaug

SEQ ID NO: 3119 - RNA, 20 nt, Artificial Sequence
  source: /note="Description of Artificial Sequence: Synthetic oligonucleotide"
gguaaggcagguuuuagcaa

SEQ ID NO: 3120 - RNA, 20 nt, Artificial Sequence
  source: /note="Description of Artificial Sequence: Synthetic oligonucleotide"
aauaagugauuugguaaggc

SEQ ID NO: 3121 - RNA, 20 nt, Artificial Sequence
  source: /note="Description of Artificial Sequence: Synthetic oligonucleotide"
agaaaauaagugauuuggua

SEQ ID NO: 3122 - RNA, 20 nt, Artificial Sequence
  source: /note="Description of Artificial Sequence: Synthetic oligonucleotide"
caucaagaaaauaagugauu

SEQ ID NO: 3123 - RNA, 20 nt, Artificial Sequence
  source: /note="Description of Artificial Sequence: Synthetic oligonucleotide"
guucucauuaauguauaacc

SEQ ID NO: 3124 - RNA, 20 nt, Artificial Sequence
  source: /note="Description of Artificial Sequence: Synthetic oligonucleotide"
uaauaacccauuugagagau

SEQ ID NO: 3125 - RNA, 20 nt, Artificial Sequence
  source: /note="Description of Artificial Sequence: Synthetic oligonucleotide"
auaauaacccauuugagaga

SEQ ID NO: 3126 - RNA, 20 nt, Artificial Sequence
  source: /note="Description of Artificial Sequence: Synthetic oligonucleotide"
uuuuaugcaucaucuauuuc

SEQ ID NO: 3127 - RNA, 20 nt, Artificial Sequence
  source: /note="Description of Artificial Sequence: Synthetic oligonucleotide"
auauaccaugcuauguuauc

SEQ ID NO: 3128 - RNA, 20 nt, Artificial Sequence
  source: /note="Description of Artificial Sequence: Synthetic oligonucleotide"
agacagguaagaaaaacggg

SEQ ID NO: 3129 - RNA, 20 nt, Artificial Sequence
  source: /note="Description of Artificial Sequence: Synthetic oligonucleotide"
ugcagacagguaagaaaaac

SEQ ID NO: 3130 - RNA, 20 nt, Artificial Sequence
  source: /note="Description of Artificial Sequence: Synthetic oligonucleotide"
gugcagacagguaagaaaaa

SEQ ID NO: 3131 - RNA, 20 nt, Artificial Sequence
  source: /note="Description of Artificial Sequence: Synthetic oligonucleotide"
gugcccuucuuagugcagac

SEQ ID NO: 3132 - RNA, 20 nt, Artificial Sequence
  source: /note="Description of Artificial Sequence: Synthetic oligonucleotide"
uaauaauuaugguauuuaau

SEQ ID NO: 3133 - RNA, 20 nt, Artificial Sequence
  source: /note="Description of Artificial Sequence: Synthetic oligonucleotide"
cuaauaauuaugguauuuaa

SEQ ID NO: 3134 - RNA, 20 nt, Artificial Sequence
  source: /note="Description of Artificial Sequence: Synthetic oligonucleotide"
ggcagcacaacuaauaauua

SEQ ID NO: 3135 - RNA, 20 nt, Artificial Sequence
  source: /note="Description of Artificial Sequence: Synthetic oligonucleotide"
auucuggugcucuacuucag

SEQ ID NO: 3136 - RNA, 20 nt, Artificial Sequence
  source: /note="Description of Artificial Sequence: Synthetic oligonucleotide"
auuguauuacucucacauuc

SEQ ID NO: 3137 - RNA, 20 nt, Artificial Sequence
  source: /note="Description of Artificial Sequence: Synthetic oligonucleotide"
uuauggauagaaucugggug

SEQ ID NO: 3138 - RNA, 20 nt, Artificial Sequence
  source: /note="Description of Artificial Sequence: Synthetic oligonucleotide"
guauguuauggauagaaucu

SEQ ID NO: 3139 - RNA, 20 nt, Artificial Sequence
  source: /note="Description of Artificial Sequence: Synthetic oligonucleotide"
aguauguuauggauagaauc

SEQ ID NO: 3140 - RNA, 20 nt, Artificial Sequence
  source: /note="Description of Artificial Sequence: Synthetic oligonucleotide"
aagaccaggacaguauguua

SEQ ID NO: 3141 - RNA, 20 nt, Artificial Sequence
  source: /note="Description of Artificial Sequence: Synthetic oligonucleotide"
uuaaaaaaauuaauaagacc

SEQ ID NO: 3142 - RNA, 20 nt, Artificial Sequence
  source: /note="Description of Artificial Sequence: Synthetic oligonucleotide"
aaagugcuaaaagaacaaac

SEQ ID NO: 3143 - RNA, 20 nt, Artificial Sequence
  source: /note="Description of Artificial Sequence: Synthetic oligonucleotide"
aagagacuucaaacaaaagc

SEQ ID NO: 3144 - RNA, 20 nt, Artificial Sequence
  source: /note="Description of Artificial Sequence: Synthetic oligonucleotide"
ugagauaacuuuacagccaa

SEQ ID NO: 3145 - RNA, 20 nt, Artificial Sequence
  source: /note="Description of Artificial Sequence: Synthetic oligonucleotide"
aaucaucugaauuaauuaca

SEQ ID NO: 3146 - RNA, 20 nt, Artificial Sequence
  source: /note="Description of Artificial Sequence: Synthetic oligonucleotide"
uaaucaucugaauuaauuac

SEQ ID NO: 3147 - RNA, 20 nt, Artificial Sequence
  source: /note="Description of Artificial Sequence: Synthetic oligonucleotide"
ucuucuguuauaauguauau

SEQ ID NO: 3148 - RNA, 20 nt, Artificial Sequence
  source: /note="Description of Artificial Sequence: Synthetic oligonucleotide"
agacacuguauuuguagaaa

SEQ ID NO: 3149 - RNA, 20 nt, Artificial Sequence
  source: /note="Description of Artificial Sequence: Synthetic oligonucleotide"
uacauuugguacauuaaaau

SEQ ID NO: 3150 - RNA, 20 nt, Artificial Sequence
  source: /note="Description of Artificial Sequence: Synthetic oligonucleotide"
uucuuuucaucaguuacauu

SEQ ID NO: 3151 - RNA, 20 nt, Artificial Sequence
  source: /note="Description of Artificial Sequence: Synthetic oligonucleotide"
uuuugaaagguacccauuua

SEQ ID NO: 3152 - RNA, 20 nt, Artificial Sequence
  source: /note="Description of Artificial Sequence: Synthetic oligonucleotide"
uuuuuuccuucauuuuugaa

SEQ ID NO: 3153 - RNA, 20 nt, Artificial Sequence
  source: /note="Description of Artificial Sequence: Synthetic oligonucleotide"
acuaaaauaaauaauuuaua

SEQ ID NO: 3154 - RNA, 20 nt, Artificial Sequence
  source: /note="Description of Artificial Sequence: Synthetic oligonucleotide"
aagauaaaaucuauaaaaca

SEQ ID NO: 3155 - RNA, 20 nt, Artificial Sequence
  source: /note="Description of Artificial Sequence: Synthetic oligonucleotide"
aaccauuucaguggcuagau

SEQ ID NO: 3156 - RNA, 20 nt, Artificial Sequence
  source: /note="Description of Artificial Sequence: Synthetic oligonucleotide"
uggagaaaaaaccauuucag

SEQ ID NO: 3157 - RNA, 20 nt, Artificial Sequence
  source: /note="Description of Artificial Sequence: Synthetic oligonucleotide"
uguagauaauauaacuucac

SEQ ID NO: 3158 - RNA, 20 nt, Artificial Sequence
  source: /note="Description of Artificial Sequence: Synthetic oligonucleotide"
guuuuuccacaagcguaaug

SEQ ID NO: 3159 - RNA, 20 nt, Artificial Sequence
  source: /note="Description of Artificial Sequence: Synthetic oligonucleotide"
uuaaaucuuagccauuaaua

SEQ ID NO: 3160 - RNA, 20 nt, Artificial Sequence
  source: /note="Description of Artificial Sequence: Synthetic oligonucleotide"
uacggugacgugaggucgga

SEQ ID NO: 3161 - RNA, 20 nt, Artificial Sequence
  source: /note="Description of Artificial Sequence: Synthetic oligonucleotide"
guacggugacgugaggucgg

SEQ ID NO: 3162 - RNA, 20 nt, Artificial Sequence
  source: /note="Description of Artificial Sequence: Synthetic oligonucleotide"
gcgaacuugggucuuccucc

SEQ ID NO: 3163 - RNA, 20 nt, Artificial Sequence
  source: /note="Description of Artificial Sequence: Synthetic oligonucleotide"
uuagcgaacuugggucuucc

SEQ ID NO: 3164 - RNA, 20 nt, Artificial Sequence
  source: /note="Description of Artificial Sequence: Synthetic oligonucleotide"
cucuuagcgaacuugggucu

SEQ ID NO: 3165 - RNA, 20 nt, Artificial Sequence
  source: /note="Description of Artificial Sequence: Synthetic oligonucleotide"
cgaugagcccuccgacucug

SEQ ID NO: 3166 - RNA, 20 nt, Artificial Sequence
  source: /note="Description of Artificial Sequence: Synthetic oligonucleotide"
auauuagggucgaugagccc

SEQ ID NO: 3167 - RNA, 20 nt, Artificial Sequence
  source: /note="Description of Artificial Sequence: Synthetic oligonucleotide"
cggauauuagggucgaugag

SEQ ID NO: 3168 - RNA, 20 nt, Artificial Sequence
  source: /note="Description of Artificial Sequence: Synthetic oligonucleotide"
acggauauuagggucgauga

SEQ ID NO: 3169 - RNA, 20 nt, Artificial Sequence
  source: /note="Description of Artificial Sequence: Synthetic oligonucleotide"
uuaaucgguccguaccaccg

SEQ ID NO: 3170 - RNA, 20 nt, Artificial Sequence
  source: /note="Description of Artificial Sequence: Synthetic oligonucleotide"
guuuuuaaucgguccguacc

SEQ ID NO: 3171 - RNA, 20 nt, Artificial Sequence
  source: /note="Description of Artificial Sequence: Synthetic oligonucleotide"
uacguuuuuaaucgguccgu

SEQ ID NO: 3172 - RNA, 20 nt, Artificial Sequence
  source: /note="Description of Artificial Sequence: Synthetic oligonucleotide"
auuuuuacguuuuuaaucgg

SEQ ID NO: 3173 - RNA, 20 nt, Artificial Sequence
  source: /note="Description of Artificial Sequence: Synthetic oligonucleotide"
gcucuggucggaucggaugu

SEQ ID NO: 3174 - RNA, 20 nt, Artificial Sequence
  source: /note="Description of Artificial Sequence: Synthetic oligonucleotide"
ccccaccuagugaucuccag

SEQ ID NO: 3175 - RNA, 20 nt, Artificial Sequence
  source: /note="Description of Artificial Sequence: Synthetic oligonucleotide"
ucuucccccaccuagugauc

SEQ ID NO: 3176 - RNA, 20 nt, Artificial Sequence
  source: /note="Description of Artificial Sequence: Synthetic oligonucleotide"
gaaauccuucgucuuccccc

SEQ ID NO: 3177 - RNA, 20 nt, Artificial Sequence
  source: /note="Description of Artificial Sequence: Synthetic oligonucleotide"
cgugaaauccuucgucuucc

SEQ ID NO: 3178 - RNA, 20 nt, Artificial Sequence
  source: /note="Description of Artificial Sequence: Synthetic oligonucleotide"
ucgugaaauccuucgucuuc

SEQ ID NO: 3179 - RNA, 20 nt, Artificial Sequence
  source: /note="Description of Artificial Sequence: Synthetic oligonucleotide"
gucgugaaauccuucgucuu

SEQ ID NO: 3180 - RNA, 20 nt, Artificial Sequence
  source: /note="Description of Artificial Sequence: Synthetic oligonucleotide"
ggucgugaaauccuucgucu

SEQ ID NO: 3181 - RNA, 20 nt, Artificial Sequence
  source: /note="Description of Artificial Sequence: Synthetic oligonucleotide"
cggacauuagggucgugaaa

SEQ ID NO: 3182 - RNA, 20 nt, Artificial Sequence
  source: /note="Description of Artificial Sequence: Synthetic oligonucleotide"
aaauaaguuccgguccggcu

SEQ ID NO: 3183 - RNA, 20 nt, Artificial Sequence
  source: /note="Description of Artificial Sequence: Synthetic oligonucleotide"
uaacaguaaauaaguuccgg

SEQ ID NO: 3184 - RNA, 20 nt, Artificial Sequence
  source: /note="Description of Artificial Sequence: Synthetic oligonucleotide"
aguuguaacaguaaauaagu

SEQ ID NO: 3185 - RNA, 20 nt, Artificial Sequence
  source: /note="Description of Artificial Sequence: Synthetic oligonucleotide"
cccaugcucuugaaaaaugu

SEQ ID NO: 3186 - RNA, 20 nt, Artificial Sequence
  source: /note="Description of Artificial Sequence: Synthetic oligonucleotide"
cccaaaaaccccgaggauua

SEQ ID NO: 3187 - RNA, 20 nt, Artificial Sequence
  source: /note="Description of Artificial Sequence: Synthetic oligonucleotide"
auaguuucccaaaaaccccg

SEQ ID NO: 3188 - RNA, 20 nt, Artificial Sequence
  source: /note="Description of Artificial Sequence: Synthetic oligonucleotide"
uucauuauaucuuuuacaau

SEQ ID NO: 3189 - RNA, 20 nt, Artificial Sequence
  source: /note="Description of Artificial Sequence: Synthetic oligonucleotide"
auucauuauaucuuuuacaa

SEQ ID NO: 3190 - RNA, 20 nt, Artificial Sequence
  source: /note="Description of Artificial Sequence: Synthetic oligonucleotide"
uuuuaccucucuuccuaucu

SEQ ID NO: 3191 - RNA, 20 nt, Artificial Sequence
  source: /note="Description of Artificial Sequence: Synthetic oligonucleotide"
caauggcuuuccuuggguga

SEQ ID NO: 3192 - RNA, 20 nt, Artificial Sequence
  source: /note="Description of Artificial Sequence: Synthetic oligonucleotide"
aguauucaauggcuuuccuu

SEQ ID NO: 3193 - RNA, 20 nt, Artificial Sequence
  source: /note="Description of Artificial Sequence: Synthetic oligonucleotide"
caguauucaauggcuuuccu

SEQ ID NO: 3194 - RNA, 20 nt, Artificial Sequence
  source: /note="Description of Artificial Sequence: Synthetic oligonucleotide"
augacccauucaguauucaa

SEQ ID NO: 3195 - RNA, 20 nt, Artificial Sequence
  source: /note="Description of Artificial Sequence: Synthetic oligonucleotide"
accagagauauacacuaagu

SEQ ID NO: 3196 - RNA, 20 nt, Artificial Sequence
  source: /note="Description of Artificial Sequence: Synthetic oligonucleotide"
aguguaaacugagauauuau

SEQ ID NO: 3197 - RNA, 20 nt, Artificial Sequence
  source: /note="Description of Artificial Sequence: Synthetic oligonucleotide"
caguguaaacugagauauua

SEQ ID NO: 3198 - RNA, 20 nt, Artificial Sequence
  source: /note="Description of Artificial Sequence: Synthetic oligonucleotide"
uuucuacuuccucuauuugc

SEQ ID NO: 3199 - RNA, 20 nt, Artificial Sequence
  source: /note="Description of Artificial Sequence: Synthetic oligonucleotide"
ugcucuaccuaauucaauuu

SEQ ID NO: 3200 - RNA, 20 nt, Artificial Sequence
  source: /note="Description of Artificial Sequence: Synthetic oligonucleotide"
aaaaaaaaaaaccaaaaaag

SEQ ID NO: 3201 - RNA, 20 nt, Artificial Sequence
  source: /note="Description of Artificial Sequence: Synthetic oligonucleotide"
aaggaauuaucacuaacuaa

SEQ ID NO: 3202 - RNA, 20 nt, Artificial Sequence
  source: /note="Description of Artificial Sequence: Synthetic oligonucleotide"
caaggaauuaucacuaacua

SEQ ID NO: 3203 - RNA, 20 nt, Artificial Sequence
  source: /note="Description of Artificial Sequence: Synthetic oligonucleotide"
aaaugagcauacagauguca

SEQ ID NO: 3204 - RNA, 20 nt, Artificial Sequence
  source: /note="Description of Artificial Sequence: Synthetic oligonucleotide"
aagagaagccuacuauuuuu

SEQ ID NO: 3205 - RNA, 20 nt, Artificial Sequence
  source: /note="Description of Artificial Sequence: Synthetic oligonucleotide"
ugugaccgcguguaacugga

SEQ ID NO: 3206 - RNA, 20 nt, Artificial Sequence
  source: /note="Description of Artificial Sequence: Synthetic oligonucleotide"
uugaugugaccgcguguaac

SEQ ID NO: 3207 - RNA, 20 nt, Artificial Sequence
  source: /note="Description of Artificial Sequence: Synthetic oligonucleotide"
aaauacugcugccacgugca

SEQ ID NO: 3208 - RNA, 20 nt, Artificial Sequence
  source: /note="Description of Artificial Sequence: Synthetic oligonucleotide"
gagucucuggaauccuagga

SEQ ID NO: 3209 - RNA, 20 nt, Artificial Sequence
  source: /note="Description of Artificial Sequence: Synthetic oligonucleotide"
auaagagucucuggaauccu

SEQ ID NO: 3210 - RNA, 20 nt, Artificial Sequence
  source: /note="Description of Artificial Sequence: Synthetic oligonucleotide"
cacuguuacauaagagucuc

SEQ ID NO: 3211 - RNA, 20 nt, Artificial Sequence
  source: /note="Description of Artificial Sequence: Synthetic oligonucleotide"
cagagccagacaagggcucc

SEQ ID NO: 3212 - RNA, 20 nt, Artificial Sequence
  source: /note="Description of Artificial Sequence: Synthetic oligonucleotide"
acccuaucagagccagacaa

SEQ ID NO: 3213 - RNA, 20 nt, Artificial Sequence
  source: /note="Description of Artificial Sequence: Synthetic oligonucleotide"
gacccuaucagagccagaca

SEQ ID NO: 3214 - RNA, 20 nt, Artificial Sequence
  source: /note="Description of Artificial Sequence: Synthetic oligonucleotide"
gaccuaaacaccuugaucuu

SEQ ID NO: 3215 - RNA, 20 nt, Artificial Sequence
  source: /note="Description of Artificial Sequence: Synthetic oligonucleotide"
gguaggaaaaccaugcguua

SEQ ID NO: 3216 - RNA, 20 nt, Artificial Sequence
  source: /note="Description of Artificial Sequence: Synthetic oligonucleotide"
ugguaggaaaaccaugcguu

SEQ ID NO: 3217 - RNA, 20 nt, Artificial Sequence
  source: /note="Description of Artificial Sequence: Synthetic oligonucleotide"
acagcuuuugaggcuuuggu

SEQ ID NO: 3218 - RNA, 20 nt, Artificial Sequence
  source: /note="Description of Artificial Sequence: Synthetic oligonucleotide"
aggcacagcuuuugaggcuu

SEQ ID NO: 3219 - RNA, 20 nt, Artificial Sequence
  source: /note="Description of Artificial Sequence: Synthetic oligonucleotide"
guauuuaggcacagcuuuug

SEQ ID NO: 3220 - RNA, 20 nt, Artificial Sequence
  source: /note="Description of Artificial Sequence: Synthetic oligonucleotide"
aaaagauuaaucuuguauuu

SEQ ID NO: 3221 - RNA, 20 nt, Artificial Sequence
  source: /note="Description of Artificial Sequence: Synthetic oligonucleotide"
cgcggugacgugagguugga

SEQ ID NO: 3222 - RNA, 20 nt, Artificial Sequence
  source: /note="Description of Artificial Sequence: Synthetic oligonucleotide"
caacgucacucggcucuagc

SEQ ID NO: 3223 - RNA, 20 nt, Artificial Sequence
  source: /note="Description of Artificial Sequence: Synthetic oligonucleotide"
gcgaacuuggccacuccgcc

SEQ ID NO: 3224 - RNA, 20 nt, Artificial Sequence
  source: /note="Description of Artificial Sequence: Synthetic oligonucleotide"
uuagcgaacuuggccacucc

SEQ ID NO: 3225 - RNA, 20 nt, Artificial Sequence
  source: /note="Description of Artificial Sequence: Synthetic oligonucleotide"
cucuuagcgaacuuggccac

SEQ ID NO: 3226 - RNA, 20 nt, Artificial Sequence
  source: /note="Description of Artificial Sequence: Synthetic oligonucleotide"
ccgaccucuuagcgaacuug

SEQ ID NO: 3227 - RNA, 20 nt, Artificial Sequence
  source: /note="Description of Artificial Sequence: Synthetic oligonucleotide"
cgaugaacccacagacuccg

SEQ ID NO: 3228 - RNA, 20 nt, Artificial Sequence
  source: /note="Description of Artificial Sequence: Synthetic oligonucleotide"
gggucgaugaacccacagac

SEQ ID NO: 3229 - RNA, 20 nt, Artificial Sequence
  source: /note="Description of Artificial Sequence: Synthetic oligonucleotide"
cggauauuagggucgaugaa

SEQ ID NO: 3230 - RNA, 20 nt, Artificial Sequence
  source: /note="Description of Artificial Sequence: Synthetic oligonucleotide"
acggauauuagggucgauga

SEQ ID NO: 3231 - RNA, 20 nt, Artificial Sequence
  source: /note="Description of Artificial Sequence: Synthetic oligonucleotide"
uguuuuaaucggcccgcacc

SEQ ID NO: 3232 - RNA, 20 nt, Artificial Sequence
  source: /note="Description of Artificial Sequence: Synthetic oligonucleotide"
uuauguuuuaaucggcccgc

SEQ ID NO: 3233 - RNA, 20 nt, Artificial Sequence
  source: /note="Description of Artificial Sequence: Synthetic oligonucleotide"
gauuuuuauguuuuaaucgg

SEQ ID NO: 3234 - RNA, 20 nt, Artificial Sequence
  source: /note="Description of Artificial Sequence: Synthetic oligonucleotide"
ugauuuuuauguuuuaaucg

SEQ ID NO: 3235 - RNA, 20 nt, Artificial Sequence
  source: /note="Description of Artificial Sequence: Synthetic oligonucleotide"
guugugguccgacugguugu

SEQ ID NO: 3236 - RNA, 20 nt, Artificial Sequence
  source: /note="Description of Artificial Sequence: Synthetic oligonucleotide"
auucagcccucaaguugugg

SEQ ID NO: 3237 - RNA, 20 nt, Artificial Sequence
  source: /note="Description of Artificial Sequence: Synthetic oligonucleotide"
guucgccuaguggaauucag

SEQ ID NO: 3238 - RNA, 20 nt, Artificial Sequence
  source: /note="Description of Artificial Sequence: Synthetic oligonucleotide"
cguucgccuaguggaauuca

SEQ ID NO: 3239 - RNA, 20 nt, Artificial Sequence
  source: /note="Description of Artificial Sequence: Synthetic oligonucleotide"
gaaaccccccggcuucguuc

SEQ ID NO: 3240 - RNA, 20 nt, Artificial Sequence
  source: /note="Description of Artificial Sequence: Synthetic oligonucleotide"
acauuagggucgugaaaccc

SEQ ID NO: 3241 - RNA, 20 nt, Artificial Sequence
  source: /note="Description of Artificial Sequence: Synthetic oligonucleotide"
gacauuagggucgugaaacc

SEQ ID NO: 3242 - RNA, 20 nt, Artificial Sequence
  source: /note="Description of Artificial Sequence: Synthetic oligonucleotide"
ggacauuagggucgugaaac

SEQ ID NO: 3243 - RNA, 20 nt, Artificial Sequence
  source: /note="Description of Artificial Sequence: Synthetic oligonucleotide"
cggacauuagggucgugaaa

SEQ ID NO: 3244 - RNA, 20 nt, Artificial Sequence
  source: /note="Description of Artificial Sequence: Synthetic oligonucleotide"
ucggacauuagggucgugaa

SEQ ID NO: 3245 - RNA, 20 nt, Artificial Sequence
  source: /note="Description of Artificial Sequence: Synthetic oligonucleotide"
uuaaucuuacgacccgcgcc

SEQ ID NO: 3246 - RNA, 20 nt, Artificial Sequence
  source: /note="Description of Artificial Sequence: Synthetic oligonucleotide"
agauuaaucuuacgacccgc

SEQ ID NO: 3247 - RNA, 20 nt, Artificial Sequence
  source: /note="Description of Artificial Sequence: Synthetic oligonucleotide"
uaaaaagauuaaucuuacga

SEQ ID NO: 3248 - RNA, 20 nt, Artificial Sequence
  source: /note="Description of Artificial Sequence: Synthetic oligonucleotide"
auaaaaagauuaaucuuacg

SEQ ID NO: 3249 - RNA, 20 nt, Artificial Sequence
  source: /note="Description of Artificial Sequence: Synthetic oligonucleotide"
augacuaguuguuugcugca

SEQ ID NO: 3250 - RNA, 20 nt, Artificial Sequence
  source: /note="Description of Artificial Sequence: Synthetic oligonucleotide"
caugacuaguuguuugcugc

SEQ ID NO: 3251 - RNA, 20 nt, Artificial Sequence
  source: /note="Description of Artificial Sequence: Synthetic oligonucleotide"
cccaaaucacaaaaaugguu

SEQ ID NO: 3252 - RNA, 20 nt, Artificial Sequence
  source: /note="Description of Artificial Sequence: Synthetic oligonucleotide"
guuuccccaaaucacaaaaa

SEQ ID NO: 3253 - RNA, 20 nt, Artificial Sequence
  source: /note="Description of Artificial Sequence: Synthetic oligonucleotide"
auuuugugaggcugggaggc

SEQ ID NO: 3254 - RNA, 20 nt, Artificial Sequence
  source: /note="Description of Artificial Sequence: Synthetic oligonucleotide"
aggcauuuugugaggcuggg

SEQ ID NO: 3255 - RNA, 20 nt, Artificial Sequence
  source: /note="Description of Artificial Sequence: Synthetic oligonucleotide"
uaaaggcauuuugugaggcu

SEQ ID NO: 3256 - RNA, 20 nt, Artificial Sequence
  source: /note="Description of Artificial Sequence: Synthetic oligonucleotide"
uuaaaggcauuuugugaggc

SEQ ID NO: 3257 - RNA, 20 nt, Artificial Sequence
  source: /note="Description of Artificial Sequence: Synthetic oligonucleotide"
uuuuuuaaaggcauuuugug

SEQ ID NO: 3258 - RNA, 20 nt, Artificial Sequence
  source: /note="Description of Artificial Sequence: Synthetic oligonucleotide"
cggaagauguaauuuuuuaa

SEQ ID NO: 3259 - RNA, 20 nt, Artificial Sequence
  source: /note="Description of Artificial Sequence: Synthetic oligonucleotide"
uaauguccgcacucgguagg

SEQ ID NO: 3260 - RNA, 20 nt, Artificial Sequence
  source: /note="Description of Artificial Sequence: Synthetic oligonucleotide"
aggguuuuacggcccuaaug

SEQ ID NO: 3261 - RNA, 20 nt, Artificial Sequence
  source: /note="Description of Artificial Sequence: Synthetic oligonucleotide"
ggaaccggaggguuuuacgg

SEQ ID NO: 3262 - RNA, 20 nt, Artificial Sequence
  source: /note="Description of Artificial Sequence: Synthetic oligonucleotide"
cggaaccggaggguuuuacg

SEQ ID NO: 3263 - RNA, 20 nt, Artificial Sequence
  source: /note="Description of Artificial Sequence: Synthetic oligonucleotide"
gcuagagaacggugggcgga

SEQ ID NO: 3264 - RNA, 20 nt, Artificial Sequence
  source: /note="Description of Artificial Sequence: Synthetic oligonucleotide"
cccaaaaguggcacaaccgg

SEQ ID NO: 3265 - RNA, 20 nt, Artificial Sequence
  source: /note="Description of Artificial Sequence: Synthetic oligonucleotide"
cucugcccaaaaguggcaca

SEQ ID NO: 3266 - RNA, 20 nt, Artificial Sequence
  source: /note="Description of Artificial Sequence: Synthetic oligonucleotide"
aaacauaaaaaucgucucug

SEQ ID NO: 3267 - RNA, 20 nt, Artificial Sequence
  source: /note="Description of Artificial Sequence: Synthetic oligonucleotide"
aaaacauaaaaaucgucucu

SEQ ID NO: 3268 - RNA, 20 nt, Artificial Sequence
  source: /note="Description of Artificial Sequence: Synthetic oligonucleotide"
aggguucaucgacccuaaug

SEQ ID NO: 3269 - RNA, 20 nt, Artificial Sequence
  source: /note="Description of Artificial Sequence: Synthetic oligonucleotide"
ggugucagaggguucaucga

SEQ ID NO: 3270 - RNA, 20 nt, Artificial Sequence
  source: /note="Description of Artificial Sequence: Synthetic oligonucleotide"
cggugucagaggguucaucg

SEQ ID NO: 3271 - RNA, 20 nt, Artificial Sequence
  source: /note="Description of Artificial Sequence: Synthetic oligonucleotide"
ugacguuggaggcggagggc

SEQ ID NO: 3272 - RNA, 20 nt, Artificial Sequence
  source: /note="Description of Artificial Sequence: Synthetic oligonucleotide"
gugacguuggaggcggaggg

SEQ ID NO: 3273 - RNA, 20 nt, Artificial Sequence
  source: /note="Description of Artificial Sequence: Synthetic oligonucleotide"
agugacguuggaggcggagg

SEQ ID NO: 3274 - RNA, 20 nt, Artificial Sequence
  source: /note="Description of Artificial Sequence: Synthetic oligonucleotide"
ccucacgucaccgcgcuaga

SEQ ID NO: 3275 - RNA, 20 nt, Artificial Sequence
  source: /note="Description of Artificial Sequence: Synthetic oligonucleotide"
cagcgguccgaccucacguc

SEQ ID NO: 3276 - RNA, 20 nt, Artificial Sequence
  source: /note="Description of Artificial Sequence: Synthetic oligonucleotide"
cagagcaagacagcgguccg

SEQ ID NO: 3277 - RNA, 20 nt, Artificial Sequence
  source: /note="Description of Artificial Sequence: Synthetic oligonucleotide"
gccucagagcaagacagcgg

SEQ ID NO: 3278 - RNA, 20 nt, Artificial Sequence
  source: /note="Description of Artificial Sequence: Synthetic oligonucleotide"
gaaaaaaaaaaaaagacucu

SEQ ID NO: 3279 - RNA, 20 nt, Artificial Sequence
  source: /note="Description of Artificial Sequence: Synthetic oligonucleotide"
cuggucagaccguuuaguuu

SEQ ID NO: 3280 - RNA, 20 nt, Artificial Sequence
  source: /note="Description of Artificial Sequence: Synthetic oligonucleotide"
ucuggucagaccguuuaguu

SEQ ID NO: 3281 - RNA, 20 nt, Artificial Sequence
  source: /note="Description of Artificial Sequence: Synthetic oligonucleotide"
gaguuuucuugaguguuuuc

SEQ ID NO: 3282 - RNA, 20 nt, Artificial Sequence
  source: /note="Description of Artificial Sequence: Synthetic oligonucleotide"
gcagguauaaugguauacua

SEQ ID NO: 3283 - RNA, 20 nt, Artificial Sequence
  source: /note="Description of Artificial Sequence: Synthetic oligonucleotide"
aaggggagaggcagguauaa

SEQ ID NO: 3284 - RNA, 20 nt, Artificial Sequence
  source: /note="Description of Artificial Sequence: Synthetic oligonucleotide"
gauggggaaaggggagaggc

SEQ ID NO: 3285 - RNA, 20 nt, Artificial Sequence
  source: /note="Description of Artificial Sequence: Synthetic oligonucleotide"
agaggauggggaaaggggag

SEQ ID NO: 3286 - RNA, 20 nt, Artificial Sequence
  source: /note="Description of Artificial Sequence: Synthetic oligonucleotide"
uuuacagaggauggggaaag

SEQ ID NO: 3287 - RNA, 20 nt, Artificial Sequence
  source: /note="Description of Artificial Sequence: Synthetic oligonucleotide"
auuuacagaggauggggaaa

SEQ ID NO: 3288 - RNA, 20 nt, Artificial Sequence
  source: /note="Description of Artificial Sequence: Synthetic oligonucleotide"
aauuuacagaggauggggaa

SEQ ID NO: 3289 - RNA, 20 nt, Artificial Sequence
  source: /note="Description of Artificial Sequence: Synthetic oligonucleotide"
gagagaauuuacagaggaug

SEQ ID NO: 3290 - RNA, 20 nt, Artificial Sequence
  source: /note="Description of Artificial Sequence: Synthetic oligonucleotide"
ugagagaauuuacagaggau

SEQ ID NO: 3291 - RNA, 20 nt, Artificial Sequence
  source: /note="Description of Artificial Sequence: Synthetic oligonucleotide"
uugagagaauuuacagagga

SEQ ID NO: 3292 - RNA, 20 nt, Artificial Sequence
  source: /note="Description of Artificial Sequence: Synthetic oligonucleotide"
aagguugagagaauuuacag

SEQ ID NO: 3293 - RNA, 20 nt, Artificial Sequence
  source: /note="Description of Artificial Sequence: Synthetic oligonucleotide"
augaaauuaaaaaugagaga

SEQ ID NO: 3294 - RNA, 20 nt, Artificial Sequence
  source: /note="Description of Artificial Sequence: Synthetic oligonucleotide"
guuguuuuagcucuaggucu

SEQ ID NO: 3295 - RNA, 20 nt, Artificial Sequence
  source: /note="Description of Artificial Sequence: Synthetic oligonucleotide"
guuguuguuguuuuagcucu

SEQ ID NO: 3296 - RNA, 20 nt, Artificial Sequence
  source: /note="Description of Artificial Sequence: Synthetic oligonucleotide"
aaaaaucaauuugggauagg

SEQ ID NO: 3297 - RNA, 20 nt, Artificial Sequence
  source: /note="Description of Artificial Sequence: Synthetic oligonucleotide"
ucuaaaaaucaauuugggau

SEQ ID NO: 3298 - RNA, 20 nt, Artificial Sequence
  source: /note="Description of Artificial Sequence: Synthetic oligonucleotide"
aaagcucuaaaaaucaauuu

SEQ ID NO: 3299 - RNA, 20 nt, Artificial Sequence
  source: /note="Description of Artificial Sequence: Synthetic oligonucleotide"
aaaagcucuaaaaaucaauu

SEQ ID NO: 3300 - RNA, 20 nt, Artificial Sequence
  source: /note="Description of Artificial Sequence: Synthetic oligonucleotide"
auacauauaccaaauauacg

SEQ ID NO: 3301 - RNA, 20 nt, Artificial Sequence
  source: /note="Description of Artificial Sequence: Synthetic oligonucleotide"
aggcaagaaggcuucuauuu

SEQ ID NO: 3302 - RNA, 20 nt, Artificial Sequence
  source: /note="Description of Artificial Sequence: Synthetic oligonucleotide"
caauucuuuguuaggcaaga

SEQ ID NO: 3303 - RNA, 20 nt, Artificial Sequence
  source: /note="Description of Artificial Sequence: Synthetic oligonucleotide"
ucuaauuacaauucuuuguu

SEQ ID NO: 3304 - RNA, 20 nt, Artificial Sequence
  source: /note="Description of Artificial Sequence: Synthetic oligonucleotide"
gauuuuuccuaucuuuagaa

SEQ ID NO: 3305 - RNA, 20 nt, Artificial Sequence
  source: /note="Description of Artificial Sequence: Synthetic oligonucleotide"
uggugcuugguuuagcucuu

SEQ ID NO: 3306 - RNA, 20 nt, Artificial Sequence
  source: /note="Description of Artificial Sequence: Synthetic oligonucleotide"
uuggugcuugguuuagcucu

SEQ ID NO: 3307 - RNA, 20 nt, Artificial Sequence
  source: /note="Description of Artificial Sequence: Synthetic oligonucleotide"
caaaaaacagauuuggugcu

SEQ ID NO: 3308 - RNA, 20 nt, Artificial Sequence
  source: /note="Description of Artificial Sequence: Synthetic oligonucleotide"
aaacccccaaaaaacagauu

SEQ ID NO: 3309 - RNA, 20 nt, Artificial Sequence
  source: /note="Description of Artificial Sequence: Synthetic oligonucleotide"
ugaggucggacccgcugucu

SEQ ID NO: 3310 - RNA, 20 nt, Artificial Sequence
  source: /note="Description of Artificial Sequence: Synthetic oligonucleotide"
gugaggucggacccgcuguc

SEQ ID NO: 3311 - RNA, 20 nt, Artificial Sequence
  source: /note="Description of Artificial Sequence: Synthetic oligonucleotide"
cgaggcgaagugaggucgga

SEQ ID NO: 3312 - RNA, 20 nt, Artificial Sequence
  source: /note="Description of Artificial Sequence: Synthetic oligonucleotide"
gcgaggcgaagugaggucgg

SEQ ID NO: 3313 - RNA, 20 nt, Artificial Sequence
  source: /note="Description of Artificial Sequence: Synthetic oligonucleotide"
uuggguccuccgccuccaac

SEQ ID NO: 3314 - RNA, 20 nt, Artificial Sequence
  source: /note="Description of Artificial Sequence: Synthetic oligonucleotide"
acgaccuuggguccuccgcc

SEQ ID NO: 3315 - RNA, 20 nt, Artificial Sequence
  source: /note="Description of Artificial Sequence: Synthetic oligonucleotide"
uuaacgaccuuggguccucc

SEQ ID NO: 3316 - RNA, 20 nt, Artificial Sequence
  source: /note="Description of Artificial Sequence: Synthetic oligonucleotide"
cucuuaacgaccuugggucc

SEQ ID NO: 3317 - RNA, 20 nt, Artificial Sequence
  source: /note="Description of Artificial Sequence: Synthetic oligonucleotide"
cgucucuuaacgaccuuggg

SEQ ID NO: 3318 - RNA, 20 nt, Artificial Sequence
  source: /note="Description of Artificial Sequence: Synthetic oligonucleotide"
ucggacuccgucucuuaacg

SEQ ID NO: 3319 - RNA, 20 nt, Artificial Sequence
  source: /note="Description of Artificial Sequence: Synthetic oligonucleotide"
gggucgaugaggcuucggac

SEQ ID NO: 3320 - RNA, 20 nt, Artificial Sequence
  source: /note="Description of Artificial Sequence: Synthetic oligonucleotide"
guuuuuaaucggcccgcacc

SEQ ID NO: 3321 - RNA, 20 nt, Artificial Sequence
  source: /note="Description of Artificial Sequence: Synthetic oligonucleotide"
uauguuuuuaaucggcccgc

SEQ ID NO: 3322 - RNA, 20 nt, Artificial Sequence
  source: /note="Description of Artificial Sequence: Synthetic oligonucleotide"
auuuuuauguuuuuaaucgg

SEQ ID NO: 3323 - RNA, 20 nt, Artificial Sequence
  source: /note="Description of Artificial Sequence: Synthetic oligonucleotide"
gauuuuuauguuuuuaaucg

SEQ ID NO: 3324 - RNA, 20 nt, Artificial Sequence
  source: /note="Description of Artificial Sequence: Synthetic oligonucleotide"
guuuuggucggacugguucu

SEQ ID NO: 3325 - RNA, 20 nt, Artificial Sequence
  source: /note="Description of Artificial Sequence: Synthetic oligonucleotide"
ccgcucaccuagugguccag

SEQ ID NO: 3326 - RNA, 20 nt, Artificial Sequence
  source: /note="Description of Artificial Sequence: Synthetic oligonucleotide"
cgacuccgcucaccuagugg

SEQ ID NO: 3327 - RNA, 20 nt, Artificial Sequence
  source: /note="Description of Artificial Sequence: Synthetic oligonucleotide"
gaaacccuccgacuccgcuc

SEQ ID NO: 3328 - RNA, 20 nt, Artificial Sequence
  source: /note="Description of Artificial Sequence: Synthetic oligonucleotide"
gggucgugaaacccuccgac

SEQ ID NO: 3329 - RNA, 20 nt, Artificial Sequence
  source: /note="Description of Artificial Sequence: Synthetic oligonucleotide"
acauuagggucgugaaaccc

SEQ ID NO: 3330 - RNA, 20 nt, Artificial Sequence
  source: /note="Description of Artificial Sequence: Synthetic oligonucleotide"
uggacauuagggucgugaaa

SEQ ID NO: 3331 - RNA, 20 nt, Artificial Sequence
  source: /note="Description of Artificial Sequence: Synthetic oligonucleotide"
guggacauuagggucgugaa

SEQ ID NO: 3332 - RNA, 20 nt, Artificial Sequence
  source: /note="Description of Artificial Sequence: Synthetic oligonucleotide"
cuauaugugaauaauagauu

SEQ ID NO: 3333 - RNA, 20 nt, Artificial Sequence
  source: /note="Description of Artificial Sequence: Synthetic oligonucleotide"
gaacagcuuuagauguuaaa

SEQ ID NO: 3334 - RNA, 20 nt, Artificial Sequence
  source: /note="Description of Artificial Sequence: Synthetic oligonucleotide"
aguuaaauaagucacucuuu

SEQ ID NO: 3335 - RNA, 20 nt, Artificial Sequence
  source: /note="Description of Artificial Sequence: Synthetic oligonucleotide"
aauaucuuuucauauccaga

SEQ ID NO: 3336 - RNA, 20 nt, Artificial Sequence
  source: /note="Description of Artificial Sequence: Synthetic oligonucleotide"
agcuuuuacuauuuaggccg

SEQ ID NO: 3337 - RNA, 20 nt, Artificial Sequence
  source: /note="Description of Artificial Sequence: Synthetic oligonucleotide"
cacccaagcuuuuacuauuu

SEQ ID NO: 3338 - RNA, 20 nt, Artificial Sequence
  source: /note="Description of Artificial Sequence: Synthetic oligonucleotide"
guaauggcucugcucugugc

SEQ ID NO: 3339 - RNA, 20 nt, Artificial Sequence
  source: /note="Description of Artificial Sequence: Synthetic oligonucleotide"
agcucgagaguguucaguaa

SEQ ID NO: 3340 - RNA, 20 nt, Artificial Sequence
  source: /note="Description of Artificial Sequence: Synthetic oligonucleotide"
uuaauauucuaauauaagau

SEQ ID NO: 3341 - RNA, 20 nt, Artificial Sequence
  source: /note="Description of Artificial Sequence: Synthetic oligonucleotide"
aaacaaagguccgagaaaga

SEQ ID NO: 3342 - RNA, 20 nt, Artificial Sequence
  source: /note="Description of Artificial Sequence: Synthetic oligonucleotide"
gaaacaaagguccgagaaag

SEQ ID NO: 3343 - RNA, 20 nt, Artificial Sequence
  source: /note="Description of Artificial Sequence: Synthetic oligonucleotide"
uaugauuuacugugaaacaa

SEQ ID NO: 3344 - RNA, 20 nt, Artificial Sequence
  source: /note="Description of Artificial Sequence: Synthetic oligonucleotide"
aaaauuuccacauugcuccu

SEQ ID NO: 3345 - RNA, 20 nt, Artificial Sequence
  source: /note="Description of Artificial Sequence: Synthetic oligonucleotide"
uuuaaccauuucuaccaaag

SEQ ID NO: 3346 - RNA, 20 nt, Artificial Sequence
  source: /note="Description of Artificial Sequence: Synthetic oligonucleotide"
ugugcacuuucaacauauua

SEQ ID NO: 3347 - RNA, 20 nt, Artificial Sequence
  source: /note="Description of Artificial Sequence: Synthetic oligonucleotide"
cugugcacuuucaacauauu

SEQ ID NO: 3348 - RNA, 20 nt, Artificial Sequence
  source: /note="Description of Artificial Sequence: Synthetic oligonucleotide"
aguuuauacaaaagacccca

SEQ ID NO: 3349 - RNA, 20 nt, Artificial Sequence
  source: /note="Description of Artificial Sequence: Synthetic oligonucleotide"
gugccucagcugucuucuac

SEQ ID NO: 3350 - RNA, 20 nt, Artificial Sequence
  source: /note="Description of Artificial Sequence: Synthetic oligonucleotide"
guuuguuuuguguguguguu

SEQ ID NO: 3351 - RNA, 20 nt, Artificial Sequence
  source: /note="Description of Artificial Sequence: Synthetic oligonucleotide"
ggaaggcauuaggguaaccu

SEQ ID NO: 3352 - RNA, 20 nt, Artificial Sequence
  source: /note="Description of Artificial Sequence: Synthetic oligonucleotide"
gggaaggcauuaggguaacc

SEQ ID NO: 3353 - RNA, 20 nt, Artificial Sequence
  source: /note="Description of Artificial Sequence: Synthetic oligonucleotide"
gaccaugugggaaggcauua

SEQ ID NO: 3354 - RNA, 20 nt, Artificial Sequence
  source: /note="Description of Artificial Sequence: Synthetic oligonucleotide"
ugaccaugugggaaggcauu

SEQ ID NO: 3355 - RNA, 20 nt, Artificial Sequence
  source: /note="Description of Artificial Sequence: Synthetic oligonucleotide"
auguguuugaccauguggga

SEQ ID NO: 3356 - RNA, 20 nt, Artificial Sequence
  source: /note="Description of Artificial Sequence: Synthetic oligonucleotide"
cuccauguguuugaccaugu

SEQ ID NO: 3357 - RNA, 20 nt, Artificial Sequence
  source: /note="Description of Artificial Sequence: Synthetic oligonucleotide"
gcuccauguguuugaccaug

SEQ ID NO: 3358 - RNA, 20 nt, Artificial Sequence
  source: /note="Description of Artificial Sequence: Synthetic oligonucleotide"
aacugcaggcuucagaauuc

SEQ ID NO: 3359 - RNA, 20 nt, Artificial Sequence
  source: /note="Description of Artificial Sequence: Synthetic oligonucleotide"
ucccacugauaaacaacugc

SEQ ID NO: 3360 - RNA, 20 nt, Artificial Sequence
  source: /note="Description of Artificial Sequence: Synthetic oligonucleotide"
uguaucaguauucaugaucc

SEQ ID NO: 3361 - RNA, 20 nt, Artificial Sequence
  source: /note="Description of Artificial Sequence: Synthetic oligonucleotide"
accauguuuccccugcaguc

SEQ ID NO: 3362 - RNA, 20 nt, Artificial Sequence
  source: /note="Description of Artificial Sequence: Synthetic oligonucleotide"
ggcagggaaaagccuccuuu

SEQ ID NO: 3363 - RNA, 20 nt, Artificial Sequence
  source: /note="Description of Artificial Sequence: Synthetic oligonucleotide"
aaaauaaacaguguggggca

SEQ ID NO: 3364 - RNA, 20 nt, Artificial Sequence
  source: /note="Description of Artificial Sequence: Synthetic oligonucleotide"
uaaaauaaacaguguggggc

SEQ ID NO: 3365 - RNA, 20 nt, Artificial Sequence
  source: /note="Description of Artificial Sequence: Synthetic oligonucleotide"
aguuuaaaauaaacagugug

SEQ ID NO: 3366 - RNA, 20 nt, Artificial Sequence
  source: /note="Description of Artificial Sequence: Synthetic oligonucleotide"
uaguuuaaaauaaacagugu

SEQ ID NO: 3367 - RNA, 20 nt, Artificial Sequence
  source: /note="Description of Artificial Sequence: Synthetic oligonucleotide"
auaguuuaaaauaaacagug

SEQ ID NO: 3368 - RNA, 20 nt, Artificial Sequence
  source: /note="Description of Artificial Sequence: Synthetic oligonucleotide"
caaagugaaaagcuccuuuc

SEQ ID NO: 3369 - RNA, 20 nt, Artificial Sequence
  source: /note="Description of Artificial Sequence: Synthetic oligonucleotide"
aagugccuacuugcuuguca

SEQ ID NO: 3370 - RNA, 20 nt, Artificial Sequence
  source: /note="Description of Artificial Sequence: Synthetic oligonucleotide"
aaagugccuacuugcuuguc

SEQ ID NO: 3371 - RNA, 20 nt, Artificial Sequence
  source: /note="Description of Artificial Sequence: Synthetic oligonucleotide"
aaagagaguaacacuccuca

SEQ ID NO: 3372 - RNA, 20 nt, Artificial Sequence
  source: /note="Description of Artificial Sequence: Synthetic oligonucleotide"
gaaagagaguaacacuccuc

SEQ ID NO: 3373 - RNA, 20 nt, Artificial Sequence
  source: /note="Description of Artificial Sequence: Synthetic oligonucleotide"
uaaaagaguuugagucagcu

SEQ ID NO: 3374 - RNA, 20 nt, Artificial Sequence
  source: /note="Description of Artificial Sequence: Synthetic oligonucleotide"
ugcagcaacauuauuagaga

SEQ ID NO: 3375 - RNA, 20 nt, Artificial Sequence
  source: /note="Description of Artificial Sequence: Synthetic oligonucleotide"
ugcuccaacuguuucuauga

SEQ ID NO: 3376 - RNA, 20 nt, Artificial Sequence
  source: /note="Description of Artificial Sequence: Synthetic oligonucleotide"
auuucuauauguaauaggaa

SEQ ID NO: 3377 - RNA, 20 nt, Artificial Sequence
  source: /note="Description of Artificial Sequence: Synthetic oligonucleotide"
gaaguauuucuauauguaau

SEQ ID NO: 3378 - RNA, 20 nt, Artificial Sequence
  source: /note="Description of Artificial Sequence: Synthetic oligonucleotide"
ucuauacaaacagugauuuu

SEQ ID NO: 3379 - RNA, 20 nt, Artificial Sequence
  source: /note="Description of Artificial Sequence: Synthetic oligonucleotide"
uucuauacaaacagugauuu

SEQ ID NO: 3380 - RNA, 20 nt, Artificial Sequence
  source: /note="Description of Artificial Sequence: Synthetic oligonucleotide"
ccccguauuauugcagauau

SEQ ID NO: 3381 - RNA, 20 nt, Artificial Sequence
  source: /note="Description of Artificial Sequence: Synthetic oligonucleotide"
auuaaucuaucacacaaaag

SEQ ID NO: 3382 - RNA, 20 nt, Artificial Sequence
  source: /note="Description of Artificial Sequence: Synthetic oligonucleotide"
cauuaaucuaucacacaaaa

SEQ ID NO: 3383 - RNA, 20 nt, Artificial Sequence
  source: /note="Description of Artificial Sequence: Synthetic oligonucleotide"
ucauuaaucuaucacacaaa

SEQ ID NO: 3384 - RNA, 20 nt, Artificial Sequence
  source: /note="Description of Artificial Sequence: Synthetic oligonucleotide"
uccaugcuaagcacagcugc

SEQ ID NO: 3385 - RNA, 20 nt, Artificial Sequence
  source: /note="Description of Artificial Sequence: Synthetic oligonucleotide"
cuuuuuuuucucauccuuuu

SEQ ID NO: 3386 - RNA, 20 nt, Artificial Sequence
  source: /note="Description of Artificial Sequence: Synthetic oligonucleotide"
ucugauaauuuguuacaagu

SEQ ID NO: 3387 - RNA, 20 nt, Artificial Sequence
  source: /note="Description of Artificial Sequence: Synthetic oligonucleotide"
aaagaugaaaagcucaaaaa

SEQ ID NO: 3388 - RNA, 20 nt, Artificial Sequence
  source: /note="Description of Artificial Sequence: Synthetic oligonucleotide"
agaauuaaaucuauaauuca

SEQ ID NO: 3389 - RNA, 20 nt, Artificial Sequence
  source: /note="Description of Artificial Sequence: Synthetic oligonucleotide"
cagaauuaaaucuauaauuc

SEQ ID NO: 3390 - RNA, 20 nt, Artificial Sequence
  source: /note="Description of Artificial Sequence: Synthetic oligonucleotide"
gaaagugguggcaauccagg

SEQ ID NO: 3391 - RNA, 20 nt, Artificial Sequence
  source: /note="Description of Artificial Sequence: Synthetic oligonucleotide"
agugaaagugguggcaaucc

SEQ ID NO: 3392 - RNA, 20 nt, Artificial Sequence
  source: /note="Description of Artificial Sequence: Synthetic oligonucleotide"
aaauacuggagugaaagugg

SEQ ID NO: 3393 - RNA, 20 nt, Artificial Sequence
  source: /note="Description of Artificial Sequence: Synthetic oligonucleotide"
uugaaauacuggagugaaag

SEQ ID NO: 3394 - RNA, 20 nt, Artificial Sequence
  source: /note="Description of Artificial Sequence: Synthetic oligonucleotide"
ugaaguguuuauugaaauac

SEQ ID NO: 3395 - RNA, 20 nt, Artificial Sequence
  source: /note="Description of Artificial Sequence: Synthetic oligonucleotide"
uagacauuuacguuccuuac

SEQ ID NO: 3396 - RNA, 20 nt, Artificial Sequence
  source: /note="Description of Artificial Sequence: Synthetic oligonucleotide"
guagacauuuacguuccuua

SEQ ID NO: 3397 - RNA, 20 nt, Artificial Sequence
  source: /note="Description of Artificial Sequence: Synthetic oligonucleotide"
aguagacauuuacguuccuu

SEQ ID NO: 3398 - RNA, 20 nt, Artificial Sequence
  source: /note="Description of Artificial Sequence: Synthetic oligonucleotide"
aaaagaguagacauuuacgu

SEQ ID NO: 3399 - RNA, 20 nt, Artificial Sequence
  source: /note="Description of Artificial Sequence: Synthetic oligonucleotide"
aaucgaacaaugcgauaaac

SEQ ID NO: 3400 - RNA, 20 nt, Artificial Sequence
  source: /note="Description of Artificial Sequence: Synthetic oligonucleotide"
agaaaccuuucacgaaucgu

SEQ ID NO: 3401 - RNA, 20 nt, Artificial Sequence
  source: /note="Description of Artificial Sequence: Synthetic oligonucleotide"
guauucuuaaucuauuagaa

SEQ ID NO: 3402 - RNA, 20 nt, Artificial Sequence
  source: /note="Description of Artificial Sequence: Synthetic oligonucleotide"
caaagaaggaaucauuucac

SEQ ID NO: 3403 - RNA, 20 nt, Artificial Sequence
  source: /note="Description of Artificial Sequence: Synthetic oligonucleotide"
ucaauaaauugggguacaga

SEQ ID NO: 3404 - RNA, 20 nt, Artificial Sequence
  source: /note="Description of Artificial Sequence: Synthetic oligonucleotide"
aagauaauucaaaauuuaau

SEQ ID NO: 3405 - RNA, 20 nt, Artificial Sequence
  source: /note="Description of Artificial Sequence: Synthetic oligonucleotide"
aaagauaauucaaaauuuaa

SEQ ID NO: 3406 - RNA, 20 nt, Artificial Sequence
  source: /note="Description of Artificial Sequence: Synthetic oligonucleotide"
acaauggagauuugcaaaua

SEQ ID NO: 3407 - RNA, 20 nt, Artificial Sequence
  source: /note="Description of Artificial Sequence: Synthetic oligonucleotide"
gacaauggagauuugcaaau

SEQ ID NO: 3408 - RNA, 20 nt, Artificial Sequence
  source: /note="Description of Artificial Sequence: Synthetic oligonucleotide"
gauuacgaacaaagagacaa

SEQ ID NO: 3409 - RNA, 20 nt, Artificial Sequence
  source: /note="Description of Artificial Sequence: Synthetic oligonucleotide"
ccaaacaccagacugcuugu

SEQ ID NO: 3410 - RNA, 20 nt, Artificial Sequence
  source: /note="Description of Artificial Sequence: Synthetic oligonucleotide"
guuaauauggaguuguuucg

SEQ ID NO: 3411 - RNA, 20 nt, Artificial Sequence
  source: /note="Description of Artificial Sequence: Synthetic oligonucleotide"
gaauuuacacaugucaaaac

SEQ ID NO: 3412 - RNA, 20 nt, Artificial Sequence
  source: /note="Description of Artificial Sequence: Synthetic oligonucleotide"
uuuuuuacugacucuccacu

SEQ ID NO: 3413 - RNA, 20 nt, Artificial Sequence
  source: /note="Description of Artificial Sequence: Synthetic oligonucleotide"
uuuguguuuuuuacugacuc

SEQ ID NO: 3414 - RNA, 20 nt, Artificial Sequence
  source: /note="Description of Artificial Sequence: Synthetic oligonucleotide"
acugaugucaaucaugacau

SEQ ID NO: 3415 - RNA, 20 nt, Artificial Sequence
  source: /note="Description of Artificial Sequence: Synthetic oligonucleotide"
accucuagauuacaugucgu

SEQ ID NO: 3416 - RNA, 20 nt, Artificial Sequence
  source: /note="Description of Artificial Sequence: Synthetic oligonucleotide"
cuacuuauaaauuauguaag

SEQ ID NO: 3417 - RNA, 20 nt, Artificial Sequence
  source: /note="Description of Artificial Sequence: Synthetic oligonucleotide"
uccccuuuauccaaacaguu

SEQ ID NO: 3418 - RNA, 20 nt, Artificial Sequence
  source: /note="Description of Artificial Sequence: Synthetic oligonucleotide"
ccgacccaucauccccuuua

SEQ ID NO: 3419 - RNA, 20 nt, Artificial Sequence
  source: /note="Description of Artificial Sequence: Synthetic oligonucleotide"
acgguacccgacccaucauc

SEQ ID NO: 3420 - RNA, 20 nt, Artificial Sequence
  source: /note="Description of Artificial Sequence: Synthetic oligonucleotide"
aacgguacccgacccaucau

SEQ ID NO: 3421 - RNA, 20 nt, Artificial Sequence
  source: /note="Description of Artificial Sequence: Synthetic oligonucleotide"
caacgguacccgacccauca

SEQ ID NO: 3422 - RNA, 20 nt, Artificial Sequence
  source: /note="Description of Artificial Sequence: Synthetic oligonucleotide"
guaccaccaacgguacccga

SEQ ID NO: 3423 - RNA, 20 nt, Artificial Sequence
  source: /note="Description of Artificial Sequence: Synthetic oligonucleotide"
uguaccaccaacgguacccg

SEQ ID NO: 3424 - RNA, 20 nt, Artificial Sequence
  source: /note="Description of Artificial Sequence: Synthetic oligonucleotide"
ucauuguaccaccaacggua

SEQ ID NO: 3425 - RNA, 20 nt, Artificial Sequence
  source: /note="Description of Artificial Sequence: Synthetic oligonucleotide"
cucauuguaccaccaacggu

SEQ ID NO: 3426 - RNA, 20 nt, Artificial Sequence
  source: /note="Description of Artificial Sequence: Synthetic oligonucleotide"
uuugcgucucucauuguacc

SEQ ID NO: 3427 - RNA, 20 nt, Artificial Sequence
  source: /note="Description of Artificial Sequence: Synthetic oligonucleotide"
guauuugcgucucucauugu

SEQ ID NO: 3428 - RNA, 20 nt, Artificial Sequence
  source: /note="Description of Artificial Sequence: Synthetic oligonucleotide"
acguacuagagugaauauac

SEQ ID NO: 3429 - RNA, 20 nt, Artificial Sequence
  source: /note="Description of Artificial Sequence: Synthetic oligonucleotide"
ucgauuauuuuuccuuucag

SEQ ID NO: 3430 - RNA, 20 nt, Artificial Sequence
  source: /note="Description of Artificial Sequence: Synthetic oligonucleotide"
cuguaugugucgauuauuuu

SEQ ID NO: 3431 - RNA, 20 nt, Artificial Sequence
  source: /note="Description of Artificial Sequence: Synthetic oligonucleotide"
uucgucuaaguguuuacgau

SEQ ID NO: 3432 - RNA, 20 nt, Artificial Sequence
  source: /note="Description of Artificial Sequence: Synthetic oligonucleotide"
uaaucaacaagaguaaaaug

SEQ ID NO: 3433 - RNA, 20 nt, Artificial Sequence
  source: /note="Description of Artificial Sequence: Synthetic oligonucleotide"
uuaaaacgguucauuguacg

SEQ ID NO: 3434 - RNA, 20 nt, Artificial Sequence
  source: /note="Description of Artificial Sequence: Synthetic oligonucleotide"
uuccagaaggguaaagauga

SEQ ID NO: 3435 - RNA, 20 nt, Artificial Sequence
  source: /note="Description of Artificial Sequence: Synthetic oligonucleotide"
ugagccuguauauuccagaa

SEQ ID NO: 3436 - RNA, 20 nt, Artificial Sequence
  source: /note="Description of Artificial Sequence: Synthetic oligonucleotide"
augagccuguauauuccaga

SEQ ID NO: 3437 - RNA, 20 nt, Artificial Sequence
  source: /note="Description of Artificial Sequence: Synthetic oligonucleotide"
cgucuccgaccuucguagga

SEQ ID NO: 3438 - RNA, 20 nt, Artificial Sequence
  source: /note="Description of Artificial Sequence: Synthetic oligonucleotide"
ucgucuccgaccuucguagg

SEQ ID NO: 3439 - RNA, 20 nt, Artificial Sequence
  source: /note="Description of Artificial Sequence: Synthetic oligonucleotide"
guguggaaaacucgucuccg

SEQ ID NO: 3440 - RNA, 20 nt, Artificial Sequence
  source: /note="Description of Artificial Sequence: Synthetic oligonucleotide"
uuaaguguggaaaacucguc

SEQ ID NO: 3441 - RNA, 20 nt, Artificial Sequence
  source: /note="Description of Artificial Sequence: Synthetic oligonucleotide"
accgcggauaaguccguuga

SEQ ID NO: 3442 - RNA, 20 nt, Artificial Sequence
  source: /note="Description of Artificial Sequence: Synthetic oligonucleotide"
gaccgcggauaaguccguug

SEQ ID NO: 3443 - RNA, 20 nt, Artificial Sequence
  source: /note="Description of Artificial Sequence: Synthetic oligonucleotide"
cgguugagaccgcggauaag

SEQ ID NO: 3444 - RNA, 20 nt, Artificial Sequence
  source: /note="Description of Artificial Sequence: Synthetic oligonucleotide"
acucuuucgauacgguugag

SEQ ID NO: 3445 - RNA, 20 nt, Artificial Sequence
  source: /note="Description of Artificial Sequence: Synthetic oligonucleotide"
ugaacacguuagagggacag

SEQ ID NO: 3446 - RNA, 20 nt, Artificial Sequence
  source: /note="Description of Artificial Sequence: Synthetic oligonucleotide"
ggggaacucgguuagaaguc

SEQ ID NO: 3447 - RNA, 20 nt, Artificial Sequence
  source: /note="Description of Artificial Sequence: Synthetic oligonucleotide"
cuaacuuuguuauuuucccu

SEQ ID NO: 3448 - RNA, 20 nt, Artificial Sequence
  source: /note="Description of Artificial Sequence: Synthetic oligonucleotide"
agaacuaacuuuguuauuuu

SEQ ID NO: 3449 - RNA, 20 nt, Artificial Sequence
  source: /note="Description of Artificial Sequence: Synthetic oligonucleotide"
uagaacuaacuuuguuauuu

SEQ ID NO: 3450 - RNA, 20 nt, Artificial Sequence
  source: /note="Description of Artificial Sequence: Synthetic oligonucleotide"
uuuccuacuaguacuuuccu

SEQ ID NO: 3451 - RNA, 20 nt, Artificial Sequence
  source: /note="Description of Artificial Sequence: Synthetic oligonucleotide"
guuauuuccuacuaguacuu

SEQ ID NO: 3452 - RNA, 20 nt, Artificial Sequence
  source: /note="Description of Artificial Sequence: Synthetic oligonucleotide"
cauagauuauuucuguuauu

SEQ ID NO: 3453 - RNA, 20 nt, Artificial Sequence
  source: /note="Description of Artificial Sequence: Synthetic oligonucleotide"
cgauaguaaauuauaaagau

SEQ ID NO: 3454 - RNA, 20 nt, Artificial Sequence
  source: /note="Description of Artificial Sequence: Synthetic oligonucleotide"
cuuuuauacuauguuuuauc

SEQ ID NO: 3455 - RNA, 20 nt, Artificial Sequence
  source: /note="Description of Artificial Sequence: Synthetic oligonucleotide"
gauaguagauagaaauucgu

SEQ ID NO: 3456 - RNA, 20 nt, Artificial Sequence
  source: /note="Description of Artificial Sequence: Synthetic oligonucleotide"
guccagacucgguggugugg

SEQ ID NO: 3457 - RNA, 20 nt, Artificial Sequence
  source: /note="Description of Artificial Sequence: Synthetic oligonucleotide"
aggguuucacgaccuuaaug

SEQ ID NO: 3458 - RNA, 20 nt, Artificial Sequence
  source: /note="Description of Artificial Sequence: Synthetic oligonucleotide"
cggagccggaggguuucacg

SEQ ID NO: 3459 - RNA, 20 nt, Artificial Sequence
  source: /note="Description of Artificial Sequence: Synthetic oligonucleotide"
gaguccacuagacgggcgga

SEQ ID NO: 3460 - RNA, 20 nt, Artificial Sequence
  source: /note="Description of Artificial Sequence: Synthetic oligonucleotide"
ccaaaguuugaggacuggag

SEQ ID NO: 3461 - RNA, 20 nt, Artificial Sequence
  source: /note="Description of Artificial Sequence: Synthetic oligonucleotide"
aaagagaugcaaccggucca

SEQ ID NO: 3462 - RNA, 20 nt, Artificial Sequence
  source: /note="Description of Artificial Sequence: Synthetic oligonucleotide"
ccccaaagagaugcaaccgg

SEQ ID NO: 3463 - RNA, 20 nt, Artificial Sequence
  source: /note="Description of Artificial Sequence: Synthetic oligonucleotide"
gucugccccaaagagaugca

SEQ ID NO: 3464 - RNA, 20 nt, Artificial Sequence
  source: /note="Description of Artificial Sequence: Synthetic oligonucleotide"
acauaaaaaaccaugucugc

SEQ ID NO: 3465 - RNA, 20 nt, Artificial Sequence
  source: /note="Description of Artificial Sequence: Synthetic oligonucleotide"
aacauaaaaaaccaugucug

SEQ ID NO: 3466 - RNA, 20 nt, Artificial Sequence
  source: /note="Description of Artificial Sequence: Synthetic oligonucleotide"
aaacauaaaaaaccaugucu

SEQ ID NO: 3467 - RNA, 20 nt, Artificial Sequence
  source: /note="Description of Artificial Sequence: Synthetic oligonucleotide"
accgauuaaaaacauaaaaa

SEQ ID NO: 3468 - RNA, 20 nt, Artificial Sequence
  source: /note="Description of Artificial Sequence: Synthetic oligonucleotide"
guccgcgggugguggugcgg

SEQ ID NO: 3469 - RNA, 20 nt, Artificial Sequence
  source: /note="Description of Artificial Sequence: Synthetic oligonucleotide"
aggacucaccgaccuuaaug

SEQ ID NO: 3470 - RNA, 20 nt, Artificial Sequence
  source: /note="Description of Artificial Sequence: Synthetic oligonucleotide"
cggagucagaggacucaccg

SEQ ID NO: 3471 - RNA, 20 nt, Artificial Sequence
  source: /note="Description of Artificial Sequence: Synthetic oligonucleotide"
agcacggagucagaggacuc

SEQ ID NO: 3472 - RNA, 20 nt, Artificial Sequence
  source: /note="Description of Artificial Sequence: Synthetic oligonucleotide"
gugacguuggagacggagga

SEQ ID NO: 3473 - RNA, 20 nt, Artificial Sequence
  source: /note="Description of Artificial Sequence: Synthetic oligonucleotide"
agugacguuggagacggagg

SEQ ID NO: 3474 - RNA, 20 nt, Artificial Sequence
  source: /note="Description of Artificial Sequence: Synthetic oligonucleotide"
aguggguccgaccucacguu

SEQ ID NO: 3475 - RNA, 20 nt, Artificial Sequence
  source: /note="Description of Artificial Sequence: Synthetic oligonucleotide"
agagggagacaguggguccg

SEQ ID NO: 3476 - RNA, 20 nt, Artificial Sequence
  source: /note="Description of Artificial Sequence: Synthetic oligonucleotide"
cuucagagggagacaguggg

SEQ ID NO: 3477 - RNA, 20 nt, Artificial Sequence
  source: /note="Description of Artificial Sequence: Synthetic oligonucleotide"
uaaaaaauaaaaauaaaaaa

SEQ ID NO: 3478 - RNA, 20 nt, Artificial Sequence
  source: /note="Description of Artificial Sequence: Synthetic oligonucleotide"
auaaaaaauaaaaauaaaaa

SEQ ID NO: 3479 - RNA, 20 nt, Artificial Sequence
  source: /note="Description of Artificial Sequence: Synthetic oligonucleotide"
auuccuuaaaggugagagug

SEQ ID NO: 3480 - RNA, 20 nt, Artificial Sequence
  source: /note="Description of Artificial Sequence: Synthetic oligonucleotide"
aaaguacugugacgguacau

SEQ ID NO: 3481 - RNA, 20 nt, Artificial Sequence
  source: /note="Description of Artificial Sequence: Synthetic oligonucleotide"
gaguuuuuguagaaagugua

SEQ ID NO: 3482 - RNA, 20 nt, Artificial Sequence
  source: /note="Description of Artificial Sequence: Synthetic oligonucleotide"
ugaguuuuuguagaaagugu

SEQ ID NO: 3483 - RNA, 20 nt, Artificial Sequence
  source: /note="Description of Artificial Sequence: Synthetic oligonucleotide"
gcuugcgugauaauuguugu

SEQ ID NO: 3484 - RNA, 20 nt, Artificial Sequence
  source: /note="Description of Artificial Sequence: Synthetic oligonucleotide"
ugcuugcgugauaauuguug

SEQ ID NO: 3485 - RNA, 20 nt, Artificial Sequence
  source: /note="Description of Artificial Sequence: Synthetic oligonucleotide"
ucaucaguaaguguuauuga

SEQ ID NO: 3486 - RNA, 20 nt, Artificial Sequence
  source: /note="Description of Artificial Sequence: Synthetic oligonucleotide"
aucaucaguaaguguuauug

SEQ ID NO: 3487 - RNA, 20 nt, Artificial Sequence
  source: /note="Description of Artificial Sequence: Synthetic oligonucleotide"
agaguaucccaacuuauaca

SEQ ID NO: 3488 - RNA, 20 nt, Artificial Sequence
  source: /note="Description of Artificial Sequence: Synthetic oligonucleotide"
cccuaaaugcagacuuagaa

SEQ ID NO: 3489 - RNA, 20 nt, Artificial Sequence
  source: /note="Description of Artificial Sequence: Synthetic oligonucleotide"
uacauuuugaaaagucacug

SEQ ID NO: 3490 - RNA, 20 nt, Artificial Sequence
  source: /note="Description of Artificial Sequence: Synthetic oligonucleotide"
auuguggguaagaauaauaa

SEQ ID NO: 3491 - RNA, 20 nt, Artificial Sequence
  source: /note="Description of Artificial Sequence: Synthetic oligonucleotide"
uuaaagcaaugcauuauugu

SEQ ID NO: 3492 - RNA, 20 nt, Artificial Sequence
  source: /note="Description of Artificial Sequence: Synthetic oligonucleotide"
uuuaaagcaaugcauuauug

SEQ ID NO: 3493 - RNA, 20 nt, Artificial Sequence
  source: /note="Description of Artificial Sequence: Synthetic oligonucleotide"
ucaucucugagucuuuccau

SEQ ID NO: 3494 - RNA, 20 nt, Artificial Sequence
  source: /note="Description of Artificial Sequence: Synthetic oligonucleotide"
auguaucaucucugagucuu

SEQ ID NO: 3495 - RNA, 20 nt, Artificial Sequence
  source: /note="Description of Artificial Sequence: Synthetic oligonucleotide"
ccguccuuuucuuuucaucg

SEQ ID NO: 3496 - RNA, 20 nt, Artificial Sequence
  source: /note="Description of Artificial Sequence: Synthetic oligonucleotide"
auguccucaacugucuuccg

SEQ ID NO: 3497 - RNA, 20 nt, Artificial Sequence
  source: /note="Description of Artificial Sequence: Synthetic oligonucleotide"
ccuuauguccucaacugucu

SEQ ID NO: 3498 - RNA, 20 nt, Artificial Sequence
  source: /note="Description of Artificial Sequence: Synthetic oligonucleotide"
cuucauuacuauaccuuaug

SEQ ID NO: 3499 - RNA, 20 nt, Artificial Sequence
  source: /note="Description of Artificial Sequence: Synthetic oligonucleotide"
ucguuauucuucauuacuau

SEQ ID NO: 3500 - RNA, 20 nt, Artificial Sequence
  source: /note="Description of Artificial Sequence: Synthetic oligonucleotide"
uuaaaauaaauaauguuagu

SEQ ID NO: 3501 - RNA, 20 nt, Artificial Sequence
  source: /note="Description of Artificial Sequence: Synthetic oligonucleotide"
uguacaaguugguaugacga

SEQ ID NO: 3502 - RNA, 20 nt, Artificial Sequence
  source: /note="Description of Artificial Sequence: Synthetic oligonucleotide"
uucgauuuaaaaucacagug

SEQ ID NO: 3503 - RNA, 20 nt, Artificial Sequence
  source: /note="Description of Artificial Sequence: Synthetic oligonucleotide"
acuguuucuuaaaucguuuu

SEQ ID NO: 3504 - RNA, 20 nt, Artificial Sequence
  source: /note="Description of Artificial Sequence: Synthetic oligonucleotide"
aacuguuucuuaaaucguuu

SEQ ID NO: 3505 - RNA, 20 nt, Artificial Sequence
  source: /note="Description of Artificial Sequence: Synthetic oligonucleotide"
aaaaauguggcauaauuuug

SEQ ID NO: 3506 - RNA, 20 nt, Artificial Sequence
  source: /note="Description of Artificial Sequence: Synthetic oligonucleotide"
augugaaagaaacaaaaaug

SEQ ID NO: 3507 - RNA, 20 nt, Artificial Sequence
  source: /note="Description of Artificial Sequence: Synthetic oligonucleotide"
aagaaaaauugaaugcuuac

SEQ ID NO: 3508 - RNA, 20 nt, Artificial Sequence
  source: /note="Description of Artificial Sequence: Synthetic oligonucleotide"
aguguauuucauucaucaaa

SEQ ID NO: 3509 - RNA, 20 nt, Artificial Sequence
  source: /note="Description of Artificial Sequence: Synthetic oligonucleotide"
aagcaauaauagacauagcc

SEQ ID NO: 3510 - RNA, 20 nt, Artificial Sequence
  source: /note="Description of Artificial Sequence: Synthetic oligonucleotide"
uccuuuuuauauuccguaaa

SEQ ID NO: 3511 - RNA, 20 nt, Artificial Sequence
  source: /note="Description of Artificial Sequence: Synthetic oligonucleotide"
caugauauuccuuuuuauau

SEQ ID NO: 3512 - RNA, 20 nt, Artificial Sequence
  source: /note="Description of Artificial Sequence: Synthetic oligonucleotide"
auuaaauacuuacaugauau

SEQ ID NO: 3513 - RNA, 20 nt, Artificial Sequence
  source: /note="Description of Artificial Sequence: Synthetic oligonucleotide"
ucuuuuaaugaaacuuaaau

SEQ ID NO: 3514 - RNA, 20 nt, Artificial Sequence
  source: /note="Description of Artificial Sequence: Synthetic oligonucleotide"
guauucguuaggaucuacuu

SEQ ID NO: 3515 - RNA, 20 nt, Artificial Sequence
  source: /note="Description of Artificial Sequence: Synthetic oligonucleotide"
aguauucguuaggaucuacu

SEQ ID NO: 3516 - RNA, 20 nt, Artificial Sequence
  source: /note="Description of Artificial Sequence: Synthetic oligonucleotide"
auuuuuucugucuuagucug

SEQ ID NO: 3517 - RNA, 20 nt, Artificial Sequence
  source: /note="Description of Artificial Sequence: Synthetic oligonucleotide"
aggauuauuuguauacuuau

SEQ ID NO: 3518 - RNA, 20 nt, Artificial Sequence
  source: /note="Description of Artificial Sequence: Synthetic oligonucleotide"
uaggauuauuuguauacuua

SEQ ID NO: 3519 - RNA, 20 nt, Artificial Sequence
  source: /note="Description of Artificial Sequence: Synthetic oligonucleotide"
aaauugucucgguauagacc

SEQ ID NO: 3520 - RNA, 20 nt, Artificial Sequence
  source: /note="Description of Artificial Sequence: Synthetic oligonucleotide"
guaaaauugucucgguauag

SEQ ID NO: 3521 - RNA, 20 nt, Artificial Sequence
  source: /note="Description of Artificial Sequence: Synthetic oligonucleotide"
uucauggaauucgauuuauu

SEQ ID NO: 3522 - RNA, 20 nt, Artificial Sequence
  source: /note="Description of Artificial Sequence: Synthetic oligonucleotide"
ucuuuauuaguuuccauguu

SEQ ID NO: 3523 - RNA, 20 nt, Artificial Sequence
  source: /note="Description of Artificial Sequence: Synthetic oligonucleotide"
uucuuccuucuuuauuaguu

SEQ ID NO: 3524 - RNA, 20 nt, Artificial Sequence
  source: /note="Description of Artificial Sequence: Synthetic oligonucleotide"
uucuaucccacuuuuuuucu

SEQ ID NO: 3525 - RNA, 20 nt, Artificial Sequence
  source: /note="Description of Artificial Sequence: Synthetic oligonucleotide"
uguacucaaaguauuucuau

SEQ ID NO: 3526 - RNA, 20 nt, Artificial Sequence
  source: /note="Description of Artificial Sequence: Synthetic oligonucleotide"
uuguacucaaaguauuucua

SEQ ID NO: 3527 - RNA, 20 nt, Artificial Sequence
  source: /note="Description of Artificial Sequence: Synthetic oligonucleotide"
uugucuacuuuuuauacacu

SEQ ID NO: 3528 - RNA, 20 nt, Artificial Sequence
  source: /note="Description of Artificial Sequence: Synthetic oligonucleotide"
ucuuaucuuuuaccugaaga

SEQ ID NO: 3529 - RNA, 20 nt, Artificial Sequence
  source: /note="Description of Artificial Sequence: Synthetic oligonucleotide"
uaguuagucucuuaucuuuu

SEQ ID NO: 3530 - RNA, 20 nt, Artificial Sequence
  source: /note="Description of Artificial Sequence: Synthetic oligonucleotide"
uaugauuugagccacgauua

SEQ ID NO: 3531 - RNA, 20 nt, Artificial Sequence
  source: /note="Description of Artificial Sequence: Synthetic oligonucleotide"
uauuguuuuuagauauaguu

SEQ ID NO: 3532 - RNA, 20 nt, Artificial Sequence
  source: /note="Description of Artificial Sequence: Synthetic oligonucleotide"
agcacuguuauuuuuaaaag

SEQ ID NO: 3533 - RNA, 20 nt, Artificial Sequence
  source: /note="Description of Artificial Sequence: Synthetic oligonucleotide"
uagcacuguuauuuuuaaaa

SEQ ID NO: 3534 - RNA, 20 nt, Artificial Sequence
  source: /note="Description of Artificial Sequence: Synthetic oligonucleotide"
cuagcacuguuauuuuuaaa

SEQ ID NO: 3535 - RNA, 20 nt, Artificial Sequence
  source: /note="Description of Artificial Sequence: Synthetic oligonucleotide"
uacuaaagcauuauuauuga

SEQ ID NO: 3536 - RNA, 20 nt, Artificial Sequence
  source: /note="Description of Artificial Sequence: Synthetic oligonucleotide"
auacuaaagcauuauuauug

SEQ ID NO: 3537 - RNA, 20 nt, Artificial Sequence
  source: /note="Description of Artificial Sequence: Synthetic oligonucleotide"
cacagucacugacuaugccu

SEQ ID NO: 3538 - RNA, 20 nt, Artificial Sequence
  source: /note="Description of Artificial Sequence: Synthetic oligonucleotide"
gcacagucacugacuaugcc

SEQ ID NO: 3539 - RNA, 20 nt, Artificial Sequence
  source: /note="Description of Artificial Sequence: Synthetic oligonucleotide"
caggaugaacugcuacugcu

SEQ ID NO: 3540 - RNA, 20 nt, Artificial Sequence
  source: /note="Description of Artificial Sequence: Synthetic oligonucleotide"
guuacaccuuagaucuguac

SEQ ID NO: 3541 - RNA, 20 nt, Artificial Sequence
  source: /note="Description of Artificial Sequence: Synthetic oligonucleotide"
gacaaccaaagaaucuccaa

SEQ ID NO: 3542 - RNA, 20 nt, Artificial Sequence
  source: /note="Description of Artificial Sequence: Synthetic oligonucleotide"
agacaaccaaagaaucucca

SEQ ID NO: 3543 - RNA, 20 nt, Artificial Sequence
  source: /note="Description of Artificial Sequence: Synthetic oligonucleotide"
cuguuauugaacagcaagau

SEQ ID NO: 3544 - RNA, 20 nt, Artificial Sequence
  source: /note="Description of Artificial Sequence: Synthetic oligonucleotide"
uuuaaagacuguuaagcagu

SEQ ID NO: 3545 - RNA, 20 nt, Artificial Sequence
  source: /note="Description of Artificial Sequence: Synthetic oligonucleotide"
uuuuaaagacuguuaagcag

SEQ ID NO: 3546 - RNA, 20 nt, Artificial Sequence
  source: /note="Description of Artificial Sequence: Synthetic oligonucleotide"
aggcaagauuacguccuuac

SEQ ID NO: 3547 - RNA, 20 nt, Artificial Sequence
  source: /note="Description of Artificial Sequence: Synthetic oligonucleotide"
uaggcaagauuacguccuua

SEQ ID NO: 3548 - RNA, 20 nt, Artificial Sequence
  source: /note="Description of Artificial Sequence: Synthetic oligonucleotide"
uuccuucauuccuuaaagcu

SEQ ID NO: 3549 - RNA, 20 nt, Artificial Sequence
  source: /note="Description of Artificial Sequence: Synthetic oligonucleotide"
cucaguugucuuguacaacc

SEQ ID NO: 3550 - RNA, 20 nt, Artificial Sequence
  source: /note="Description of Artificial Sequence: Synthetic oligonucleotide"
caucucaguugucuuguaca

SEQ ID NO: 3551 - RNA, 20 nt, Artificial Sequence
  source: /note="Description of Artificial Sequence: Synthetic oligonucleotide"
ucuaggacuuauaugaaaug

SEQ ID NO: 3552 - RNA, 20 nt, Artificial Sequence
  source: /note="Description of Artificial Sequence: Synthetic oligonucleotide"
ccucuaccuuuaaccacuuu

SEQ ID NO: 3553 - RNA, 20 nt, Artificial Sequence
  source: /note="Description of Artificial Sequence: Synthetic oligonucleotide"
caaacuuaccucuaccuuua

SEQ ID NO: 3554 - RNA, 20 nt, Artificial Sequence
  source: /note="Description of Artificial Sequence: Synthetic oligonucleotide"
cuuccaccaaacuuaccucu

SEQ ID NO: 3555 - RNA, 20 nt, Artificial Sequence
  source: /note="Description of Artificial Sequence: Synthetic oligonucleotide"
uguguacuuccaccaaacuu

SEQ ID NO: 3556 - RNA, 20 nt, Artificial Sequence
  source: /note="Description of Artificial Sequence: Synthetic oligonucleotide"
aaguuucauuguguacuucc

SEQ ID NO: 3557 - RNA, 20 nt, Artificial Sequence
  source: /note="Description of Artificial Sequence: Synthetic oligonucleotide"
gaaaaguuucauuguguacu

SEQ ID NO: 3558 - RNA, 20 nt, Artificial Sequence
  source: /note="Description of Artificial Sequence: Synthetic oligonucleotide"
uuugucccuuuggguacugu

SEQ ID NO: 3559 - RNA, 20 nt, Artificial Sequence
  source: /note="Description of Artificial Sequence: Synthetic oligonucleotide"
cuuugucccuuuggguacug

SEQ ID NO: 3560 - RNA, 20 nt, Artificial Sequence
  source: /note="Description of Artificial Sequence: Synthetic oligonucleotide"
ccccucguuucgaucuuugu

SEQ ID NO: 3561 - RNA, 20 nt, Artificial Sequence
  source: /note="Description of Artificial Sequence: Synthetic oligonucleotide"
cccccucguuucgaucuuug

SEQ ID NO: 3562 - RNA, 20 nt, Artificial Sequence
  source: /note="Description of Artificial Sequence: Synthetic oligonucleotide"
gggugccacuccauucuucc

SEQ ID NO: 3563 - RNA, 20 nt, Artificial Sequence
  source: /note="Description of Artificial Sequence: Synthetic oligonucleotide"
ugggugccacuccauucuuc

SEQ ID NO: 3564 - RNA, 20 nt, Artificial Sequence
  source: /note="Description of Artificial Sequence: Synthetic oligonucleotide"
uugggugccacuccauucuu

SEQ ID NO: 3565 - RNA, 20 nt, Artificial Sequence
  source: /note="Description of Artificial Sequence: Synthetic oligonucleotide"
uuugggugccacuccauucu

SEQ ID NO: 3566 - RNA, 20 nt, Artificial Sequence
  source: /note="Description of Artificial Sequence: Synthetic oligonucleotide"
aacccauuuuugggugccac

SEQ ID NO: 3567 - RNA, 20 nt, Artificial Sequence
  source: /note="Description of Artificial Sequence: Synthetic oligonucleotide"
aaacaaacccauuuuugggu

SEQ ID NO: 3568 - RNA, 20 nt, Artificial Sequence
  source: /note="Description of Artificial Sequence: Synthetic oligonucleotide"
cuagugaacuuaaaaacaaa

SEQ ID NO: 3569 - RNA, 20 nt, Artificial Sequence
  source: /note="Description of Artificial Sequence: Synthetic oligonucleotide"
acuagugaacuuaaaaacaa

SEQ ID NO: 3570 - RNA, 20 nt, Artificial Sequence
  source: /note="Description of Artificial Sequence: Synthetic oligonucleotide"
uuaccaaaauucgucuccuc

SEQ ID NO: 3571 - RNA, 20 nt, Artificial Sequence
  source: /note="Description of Artificial Sequence: Synthetic oligonucleotide"
gguaauuaccaaaauucguc

SEQ ID NO: 3572 - RNA, 20 nt, Artificial Sequence
  source: /note="Description of Artificial Sequence: Synthetic oligonucleotide"
cacuuugucucuggguaauu

SEQ ID NO: 3573 - RNA, 20 nt, Artificial Sequence
  source: /note="Description of Artificial Sequence: Synthetic oligonucleotide"
cacccaguacuuuucccgaa

SEQ ID NO: 3574 - RNA, 20 nt, Artificial Sequence
  source: /note="Description of Artificial Sequence: Synthetic oligonucleotide"
ccugaccacccaguacuuuu

SEQ ID NO: 3575 - RNA, 20 nt, Artificial Sequence
  source: /note="Description of Artificial Sequence: Synthetic oligonucleotide"
uccugaccacccaguacuuu

SEQ ID NO: 3576 - RNA, 20 nt, Artificial Sequence
  source: /note="Description of Artificial Sequence: Synthetic oligonucleotide"
guuaagugaacuccugacca

SEQ ID NO: 3577 - RNA, 20 nt, Artificial Sequence
  source: /note="Description of Artificial Sequence: Synthetic oligonucleotide"
gguuaagugaacuccugacc

SEQ ID NO: 3578 - RNA, 20 nt, Artificial Sequence
  source: /note="Description of Artificial Sequence: Synthetic oligonucleotide"
gucgguuaagugaacuccug

SEQ ID NO: 3579 - RNA, 20 nt, Artificial Sequence
  source: /note="Description of Artificial Sequence: Synthetic oligonucleotide"
uuaucgucgguuaagugaac

SEQ ID NO: 3580 - RNA, 20 nt, Artificial Sequence
  source: /note="Description of Artificial Sequence: Synthetic oligonucleotide"
cccucuuaucaccguucuuu

SEQ ID NO: 3581 - RNA, 20 nt, Artificial Sequence
  source: /note="Description of Artificial Sequence: Synthetic oligonucleotide"
uuaucuuacucccucuuauc

SEQ ID NO: 3582 - RNA, 20 nt, Artificial Sequence
  source: /note="Description of Artificial Sequence: Synthetic oligonucleotide"
uccuuuaaucuuaucuuacu

SEQ ID NO: 3583 - RNA, 20 nt, Artificial Sequence
  source: /note="Description of Artificial Sequence: Synthetic oligonucleotide"
uuccuuuaaucuuaucuuac

SEQ ID NO: 3584 - RNA, 20 nt, Artificial Sequence
  source: /note="Description of Artificial Sequence: Synthetic oligonucleotide"
gguccugucguucuuuuggu

SEQ ID NO: 3585 - RNA, 20 nt, Artificial Sequence
  source: /note="Description of Artificial Sequence: Synthetic oligonucleotide"
uccuacgagaagaacaacgg

SEQ ID NO: 3586 - RNA, 20 nt, Artificial Sequence
  source: /note="Description of Artificial Sequence: Synthetic oligonucleotide"
acguuuccggaccuccuuuu

SEQ ID NO: 3587 - RNA, 20 nt, Artificial Sequence
  source: /note="Description of Artificial Sequence: Synthetic oligonucleotide"
gucguucacguuuccggacc

SEQ ID NO: 3588 - RNA, 20 nt, Artificial Sequence
  source: /note="Description of Artificial Sequence: Synthetic oligonucleotide"
cuugucguucacguuuccgg

SEQ ID NO: 3589 - RNA, 20 nt, Artificial Sequence
  source: /note="Description of Artificial Sequence: Synthetic oligonucleotide"
ucucccuugucguucacguu

SEQ ID NO: 3590 - RNA, 20 nt, Artificial Sequence
  source: /note="Description of Artificial Sequence: Synthetic oligonucleotide"
ccuucccacgagguccuucu

SEQ ID NO: 3591 - RNA, 20 nt, Artificial Sequence
  source: /note="Description of Artificial Sequence: Synthetic oligonucleotide"
uccuucccacgagguccuuc

SEQ ID NO: 3592 - RNA, 20 nt, Artificial Sequence
  source: /note="Description of Artificial Sequence: Synthetic oligonucleotide"
gagacuuccuucccacgagg

SEQ ID NO: 3593 - RNA, 20 nt, Artificial Sequence
  source: /note="Description of Artificial Sequence: Synthetic oligonucleotide"
ggacaccgagagacuuccuu

SEQ ID NO: 3594 - RNA, 20 nt, Artificial Sequence
  source: /note="Description of Artificial Sequence: Synthetic oligonucleotide"
uggacaccgagagacuuccu

SEQ ID NO: 3595 - RNA, 20 nt, Artificial Sequence
  source: /note="Description of Artificial Sequence: Synthetic oligonucleotide"
guuauggacaccgagagacu

SEQ ID NO: 3596 - RNA, 20 nt, Artificial Sequence
  source: /note="Description of Artificial Sequence: Synthetic oligonucleotide"
uuucuaucuuuguuauggac

SEQ ID NO: 3597 - RNA, 20 nt, Artificial Sequence
  source: /note="Description of Artificial Sequence: Synthetic oligonucleotide"
ugugaguuccucucuaaucu

SEQ ID NO: 3598 - RNA, 20 nt, Artificial Sequence
  source: /note="Description of Artificial Sequence: Synthetic oligonucleotide"
gagacuuuuucauugugagu

SEQ ID NO: 3599 - RNA, 20 nt, Artificial Sequence
  source: /note="Description of Artificial Sequence: Synthetic oligonucleotide"
ucugaaucuaucuuaccaau

SEQ ID NO: 3600 - RNA, 20 nt, Artificial Sequence
  source: /note="Description of Artificial Sequence: Synthetic oligonucleotide"
uucugaaucuaucuuaccaa

SEQ ID NO: 3601 - RNA, 20 nt, Artificial Sequence
  source: /note="Description of Artificial Sequence: Synthetic oligonucleotide"
cagaguucugaaucuaucuu

SEQ ID NO: 3602 - RNA, 20 nt, Artificial Sequence
  source: /note="Description of Artificial Sequence: Synthetic oligonucleotide"
aaaagagagaaaauaaagca

SEQ ID NO: 3603 - RNA, 20 nt, Artificial Sequence
  source: /note="Description of Artificial Sequence: Synthetic oligonucleotide"
ggacaagggguuauuggaua

SEQ ID NO: 3604 - RNA, 20 nt, Artificial Sequence
  source: /note="Description of Artificial Sequence: Synthetic oligonucleotide"
uggacaagggguuauuggau

SEQ ID NO: 3605 - RNA, 20 nt, Artificial Sequence
  source: /note="Description of Artificial Sequence: Synthetic oligonucleotide"
cacauaugacgagcccacua

SEQ ID NO: 3606 - RNA, 20 nt, Artificial Sequence
  source: /note="Description of Artificial Sequence: Synthetic oligonucleotide"
cccacuucacauaugacgag

SEQ ID NO: 3607 - RNA, 20 nt, Artificial Sequence
  source: /note="Description of Artificial Sequence: Synthetic oligonucleotide"
ucccacuucacauaugacga

SEQ ID NO: 3608 - RNA, 20 nt, Artificial Sequence
  source: /note="Description of Artificial Sequence: Synthetic oligonucleotide"
ccuuauuuucugaugcuuau

SEQ ID NO: 3609 - RNA, 20 nt, Artificial Sequence
  source: /note="Description of Artificial Sequence: Synthetic oligonucleotide"
uccuuauuuucugaugcuua

SEQ ID NO: 3610 - RNA, 20 nt, Artificial Sequence
  source: /note="Description of Artificial Sequence: Synthetic oligonucleotide"
uuuucccacccuucccccac

SEQ ID NO: 3611 - RNA, 20 nt, Artificial Sequence
  source: /note="Description of Artificial Sequence: Synthetic oligonucleotide"
uccccuuuucccacccuucc

SEQ ID NO: 3612 - RNA, 20 nt, Artificial Sequence
  source: /note="Description of Artificial Sequence: Synthetic oligonucleotide"
guccccuuuucccacccuuc

SEQ ID NO: 3613 - RNA, 20 nt, Artificial Sequence
  source: /note="Description of Artificial Sequence: Synthetic oligonucleotide"
aguccccuuuucccacccuu

SEQ ID NO: 3614 - RNA, 20 nt, Artificial Sequence
  source: /note="Description of Artificial Sequence: Synthetic oligonucleotide"
gaguccccuuuucccacccu

SEQ ID NO: 3615 - RNA, 20 nt, Artificial Sequence
  source: /note="Description of Artificial Sequence: Synthetic oligonucleotide"
cccugaguccccuuuuccca

SEQ ID NO: 3616 - RNA, 20 nt, Artificial Sequence
  source: /note="Description of Artificial Sequence: Synthetic oligonucleotide"
ucccugaguccccuuuuccc

SEQ ID NO: 3617 - RNA, 20 nt, Artificial Sequence
  source: /note="Description of Artificial Sequence: Synthetic oligonucleotide"
agaucccugaguccccuuuu

SEQ ID NO: 3618 - RNA, 20 nt, Artificial Sequence
  source: /note="Description of Artificial Sequence: Synthetic oligonucleotide"
gagaucccugaguccccuuu

SEQ ID NO: 3619 - RNA, 20 nt, Artificial Sequence
  source: /note="Description of Artificial Sequence: Synthetic oligonucleotide"
uuaccugagaucccugaguc

SEQ ID NO: 3620 - RNA, 20 nt, Artificial Sequence
  source: /note="Description of Artificial Sequence: Synthetic oligonucleotide"
guuaccugagaucccugagu

SEQ ID NO: 3621 - RNA, 20 nt, Artificial Sequence
  source: /note="Description of Artificial Sequence: Synthetic oligonucleotide"
uguuaccugagaucccugag

SEQ ID NO: 3622 - RNA, 20 nt, Artificial Sequence
  source: /note="Description of Artificial Sequence: Synthetic oligonucleotide"
cuuacuguguuaccugagau

SEQ ID NO: 3623 - RNA, 20 nt, Artificial Sequence
  source: /note="Description of Artificial Sequence: Synthetic oligonucleotide"
ucuuacuguguuaccugaga

SEQ ID NO: 3624 - RNA, 20 nt, Artificial Sequence
  source: /note="Description of Artificial Sequence: Synthetic oligonucleotide"
uuccguauucuuacuguguu

SEQ ID NO: 3625 - RNA, 20 nt, Artificial Sequence
  source: /note="Description of Artificial Sequence: Synthetic oligonucleotide"
cgaugcgauacuccuacguu

SEQ ID NO: 3626 - RNA, 20 nt, Artificial Sequence
  source: /note="Description of Artificial Sequence: Synthetic oligonucleotide"
auucacccucgaugcgauac

SEQ ID NO: 3627 - RNA, 20 nt, Artificial Sequence
  source: /note="Description of Artificial Sequence: Synthetic oligonucleotide"
uauacaagagugaguauuca

SEQ ID NO: 3628 - RNA, 20 nt, Artificial Sequence
  source: /note="Description of Artificial Sequence: Synthetic oligonucleotide"
guauacaagagugaguauuc

SEQ ID NO: 3629 - RNA, 20 nt, Artificial Sequence
  source: /note="Description of Artificial Sequence: Synthetic oligonucleotide"
auucacuucauugagucccu

SEQ ID NO: 3630 - RNA, 20 nt, Artificial Sequence
  source: /note="Description of Artificial Sequence: Synthetic oligonucleotide"
uaagauucacuucauugagu

SEQ ID NO: 3631 - RNA, 20 nt, Artificial Sequence
  source: /note="Description of Artificial Sequence: Synthetic oligonucleotide"
auaagauucacuucauugag

SEQ ID NO: 3632 - RNA, 20 nt, Artificial Sequence
  source: /note="Description of Artificial Sequence: Synthetic oligonucleotide"
acgucacuggaccuauucug

SEQ ID NO: 3633 - RNA, 20 nt, Artificial Sequence
  source: /note="Description of Artificial Sequence: Synthetic oligonucleotide"
auuaccguaaacgucacugg

SEQ ID NO: 3634 - RNA, 20 nt, Artificial Sequence
  source: /note="Description of Artificial Sequence: Synthetic oligonucleotide"
guauuuuuccuuacuuaauu

SEQ ID NO: 3635 - RNA, 20 nt, Artificial Sequence
  source: /note="Description of Artificial Sequence: Synthetic oligonucleotide"
uuaugaugagucgguauuuu

SEQ ID NO: 3636 - RNA, 20 nt, Artificial Sequence
  source: /note="Description of Artificial Sequence: Synthetic oligonucleotide"
ugacaccauauaaauauucu

SEQ ID NO: 3637 - RNA, 20 nt, Artificial Sequence
  source: /note="Description of Artificial Sequence: Synthetic oligonucleotide"
cacucaucaauuucuuugac

SEQ ID NO: 3638 - RNA, 20 nt, Artificial Sequence
  source: /note="Description of Artificial Sequence: Synthetic oligonucleotide"
guuggguuuacgagcaguua

SEQ ID NO: 3639 - RNA, 20 nt, Artificial Sequence
  source: /note="Description of Artificial Sequence: Synthetic oligonucleotide"
uuaaacguuaacguuuuuac

SEQ ID NO: 3640 - RNA, 20 nt, Artificial Sequence
  source: /note="Description of Artificial Sequence: Synthetic oligonucleotide"
ugaugacccauagauggguc

SEQ ID NO: 3641 - RNA, 20 nt, Artificial Sequence
  source: /note="Description of Artificial Sequence: Synthetic oligonucleotide"
cuaggucguuagggugauga

SEQ ID NO: 3642 - RNA, 20 nt, Artificial Sequence
  source: /note="Description of Artificial Sequence: Synthetic oligonucleotide"
acuaggucguuagggugaug

SEQ ID NO: 3643 - RNA, 20 nt, Artificial Sequence
  source: /note="Description of Artificial Sequence: Synthetic oligonucleotide"
ucggugauaccuuuugucac

SEQ ID NO: 3644 - RNA, 20 nt, Artificial Sequence
  source: /note="Description of Artificial Sequence: Synthetic oligonucleotide"
cauuugaucaugucggugau

SEQ ID NO: 3645 - RNA, 20 nt, Artificial Sequence
  source: /note="Description of Artificial Sequence: Synthetic oligonucleotide"
uugugaagaugugacgacca

SEQ ID NO: 3646 - RNA, 20 nt, Artificial Sequence
  source: /note="Description of Artificial Sequence: Synthetic oligonucleotide"
cuugugaagaugugacgacc

SEQ ID NO: 3647 - RNA, 20 nt, Artificial Sequence
  source: /note="Description of Artificial Sequence: Synthetic oligonucleotide"
ucucuugugaagaugugacg

SEQ ID NO: 3648 - RNA, 20 nt, Artificial Sequence
  source: /note="Description of Artificial Sequence: Synthetic oligonucleotide"
ucaucugcaaccguaccuau

SEQ ID NO: 3649 - RNA, 20 nt, Artificial Sequence
  source: /note="Description of Artificial Sequence: Synthetic oligonucleotide"
uuuuuaucaucugcaaccgu

SEQ ID NO: 3650 - RNA, 20 nt, Artificial Sequence
  source: /note="Description of Artificial Sequence: Synthetic oligonucleotide"
uuaguuuuuuaucaucugca

SEQ ID NO: 3651 - RNA, 20 nt, Artificial Sequence
  source: /note="Description of Artificial Sequence: Synthetic oligonucleotide"
uaugaaaugaggacguucuu

SEQ ID NO: 3652 - RNA, 20 nt, Artificial Sequence
  source: /note="Description of Artificial Sequence: Synthetic oligonucleotide"
aaguuauagugauuacuagu

SEQ ID NO: 3653 - RNA, 20 nt, Artificial Sequence
  source: /note="Description of Artificial Sequence: Synthetic oligonucleotide"
caaguuauagugauuacuag

SEQ ID NO: 3654 - RNA, 20 nt, Artificial Sequence
  source: /note="Description of Artificial Sequence: Synthetic oligonucleotide"
aggauaguuuuucacccgau

SEQ ID NO: 3655 - RNA, 20 nt, Artificial Sequence
  source: /note="Description of Artificial Sequence: Synthetic oligonucleotide"
uuuguuaggauaguuuuuca

SEQ ID NO: 3656 - RNA, 20 nt, Artificial Sequence
  source: /note="Description of Artificial Sequence: Synthetic oligonucleotide"
guuuguuaggauaguuuuuc

SEQ ID NO: 3657 - RNA, 20 nt, Artificial Sequence
  source: /note="Description of Artificial Sequence: Synthetic oligonucleotide"
ccuugagguuguuuaaucgu

SEQ ID NO: 3658 - RNA, 20 nt, Artificial Sequence
  source: /note="Description of Artificial Sequence: Synthetic oligonucleotide"
ugauuauagaucuuagaugu

SEQ ID NO: 3659 - RNA, 20 nt, Artificial Sequence
  source: /note="Description of Artificial Sequence: Synthetic oligonucleotide"
uguuagauacguaggccguu

SEQ ID NO: 3660 - RNA, 20 nt, Artificial Sequence
  source: /note="Description of Artificial Sequence: Synthetic oligonucleotide"
uagaaguguuagauacguag

SEQ ID NO: 3661 - RNA, 20 nt, Artificial Sequence
  source: /note="Description of Artificial Sequence: Synthetic oligonucleotide"
uuugucuguugggugucuca

SEQ ID NO: 3662 - RNA, 20 nt, Artificial Sequence
  source: /note="Description of Artificial Sequence: Synthetic oligonucleotide"
auuugucuguugggugucuc

SEQ ID NO: 3663 - RNA, 20 nt, Artificial Sequence
  source: /note="Description of Artificial Sequence: Synthetic oligonucleotide"
uucucggagacgugucguua

SEQ ID NO: 3664 - RNA, 20 nt, Artificial Sequence
  source: /note="Description of Artificial Sequence: Synthetic oligonucleotide"
guuguuuuuguuucuauuua

SEQ ID NO: 3665 - RNA, 20 nt, Artificial Sequence
  source: /note="Description of Artificial Sequence: Synthetic oligonucleotide"
ugggaagaucuguaaccgaa

SEQ ID NO: 3666 - RNA, 20 nt, Artificial Sequence
  source: /note="Description of Artificial Sequence: Synthetic oligonucleotide"
ucuuuuugggaagaucugua

SEQ ID NO: 3667 - RNA, 20 nt, Artificial Sequence
  source: /note="Description of Artificial Sequence: Synthetic oligonucleotide"
uauauuuuuaguugaguucu

SEQ ID NO: 3668 - RNA, 20 nt, Artificial Sequence
  source: /note="Description of Artificial Sequence: Synthetic oligonucleotide"
uguuuaccacgacccuaucg

SEQ ID NO: 3669 - RNA, 20 nt, Artificial Sequence
  source: /note="Description of Artificial Sequence: Synthetic oligonucleotide"
ggauaaguuguuuaccacga

SEQ ID NO: 3670 - RNA, 20 nt, Artificial Sequence
  source: /note="Description of Artificial Sequence: Synthetic oligonucleotide"
gggauaaguuguuuaccacg

SEQ ID NO: 3671 - RNA, 20 nt, Artificial Sequence
  source: /note="Description of Artificial Sequence: Synthetic oligonucleotide"
uccugugggauaaguuguuu

SEQ ID NO: 3672 - RNA, 20 nt, Artificial Sequence
  source: /note="Description of Artificial Sequence: Synthetic oligonucleotide"
uuuguauuuaaucauccauu

SEQ ID NO: 3673 - RNA, 20 nt, Artificial Sequence
  source: /note="Description of Artificial Sequence: Synthetic oligonucleotide"
uuuguuuuuguauuuaauca

SEQ ID NO: 3674 - RNA, 20 nt, Artificial Sequence
  source: /note="Description of Artificial Sequence: Synthetic oligonucleotide"
auccaugucucugguuaccc

SEQ ID NO: 3675 - RNA, 20 nt, Artificial Sequence
  source: /note="Description of Artificial Sequence: Synthetic oligonucleotide"
uauccaugucucugguuacc

SEQ ID NO: 3676 - RNA, 20 nt, Artificial Sequence
  source: /note="Description of Artificial Sequence: Synthetic oligonucleotide"
uuauccaugucucugguuac

SEQ ID NO: 3677 - RNA, 20 nt, Artificial Sequence
  source: /note="Description of Artificial Sequence: Synthetic oligonucleotide"
uuuauccaugucucugguua

SEQ ID NO: 3678 - RNA, 20 nt, Artificial Sequence
  source: /note="Description of Artificial Sequence: Synthetic oligonucleotide"
uuuuauccaugucucugguu

SEQ ID NO: 3679 - RNA, 20 nt, Artificial Sequence
  source: /note="Description of Artificial Sequence: Synthetic oligonucleotide"
guaccaugaccauauuuuua

SEQ ID NO: 3680 - RNA, 20 nt, Artificial Sequence
  source: /note="Description of Artificial Sequence: Synthetic oligonucleotide"
ugugguuuugucguaccaug

SEQ ID NO: 3681 - RNA, 20 nt, Artificial Sequence
  source: /note="Description of Artificial Sequence: Synthetic oligonucleotide"
gguaucugugguuuugucgu

SEQ ID NO: 3682 - RNA, 20 nt, Artificial Sequence
  source: /note="Description of Artificial Sequence: Synthetic oligonucleotide"
aauggacugaaauaugaucu

SEQ ID NO: 3683 - RNA, 20 nt, Artificial Sequence
  source: /note="Description of Artificial Sequence: Synthetic oligonucleotide"
gauucguguuucuuguuuaa

SEQ ID NO: 3684 - RNA, 20 nt, Artificial Sequence
  source: /note="Description of Artificial Sequence: Synthetic oligonucleotide"
ugauucguguuucuuguuua

SEQ ID NO: 3685 - RNA, 20 nt, Artificial Sequence
  source: /note="Description of Artificial Sequence: Synthetic oligonucleotide"
gguaguaagaagugucuuaa

SEQ ID NO: 3686 - RNA, 20 nt, Artificial Sequence
  source: /note="Description of Artificial Sequence: Synthetic oligonucleotide"
aagcagaaacacuuugccaa

SEQ ID NO: 3687 - RNA, 20 nt, Artificial Sequence
  source: /note="Description of Artificial Sequence: Synthetic oligonucleotide"
aaagcagaaacacuuugcca

SEQ ID NO: 3688 - RNA, 20 nt, Artificial Sequence
  source: /note="Description of Artificial Sequence: Synthetic oligonucleotide"
gaguaucuugaguguagaug

SEQ ID NO: 3689 - RNA, 20 nt, Artificial Sequence
  source: /note="Description of Artificial Sequence: Synthetic oligonucleotide"
ugguacacgaucggugacaa

SEQ ID NO: 3690 - RNA, 20 nt, Artificial Sequence
  source: /note="Description of Artificial Sequence: Synthetic oligonucleotide"
ggagucggaagucucaucga

SEQ ID NO: 3691 - RNA, 20 nt, Artificial Sequence
  source: /note="Description of Artificial Sequence: Synthetic oligonucleotide"
cggagucggaagucucaucg

SEQ ID NO: 3692 - RNA, 20 nt, Artificial Sequence
  source: /note="Description of Artificial Sequence: Synthetic oligonucleotide"
ugggguuugaaaacucugag

SEQ ID NO: 3693 - RNA, 20 nt, Artificial Sequence
  source: /note="Description of Artificial Sequence: Synthetic oligonucleotide"
uguuacgucgucgauaagug

SEQ ID NO: 3694 - RNA, 20 nt, Artificial Sequence
  source: /note="Description of Artificial Sequence: Synthetic oligonucleotide"
cccaagagugacacaacugg

SEQ ID NO: 3695 - RNA, 20 nt, Artificial Sequence
  source: /note="Description of Artificial Sequence: Synthetic oligonucleotide"
ugccaaaaaaaauuucucua

SEQ ID NO: 3696 - RNA, 20 nt, Artificial Sequence
  source: /note="Description of Artificial Sequence: Synthetic oligonucleotide"
uugccaaaaaaaauuucucu

SEQ ID NO: 3697 - RNA, 20 nt, Artificial Sequence
  source: /note="Description of Artificial Sequence: Synthetic oligonucleotide"
cagcagagaaaagacaacac

SEQ ID NO: 3698 - RNA, 20 nt, Artificial Sequence
  source: /note="Description of Artificial Sequence: Synthetic oligonucleotide"
ucuaucuucaauuuccaaug

SEQ ID NO: 3699 - RNA, 20 nt, Artificial Sequence
  source: /note="Description of Artificial Sequence: Synthetic oligonucleotide"
uuucaccuauaaauaaucaa

SEQ ID NO: 3700 - RNA, 20 nt, Artificial Sequence
  source: /note="Description of Artificial Sequence: Synthetic oligonucleotide"
auugucucagcuauuccuca

SEQ ID NO: 3701 - RNA, 20 nt, Artificial Sequence
  source: /note="Description of Artificial Sequence: Synthetic oligonucleotide"
uccucggcuccagaagcucc

SEQ ID NO: 3702 - RNA, 20 nt, Artificial Sequence
  source: /note="Description of Artificial Sequence: Synthetic oligonucleotide"
uuuagugaccaauguuuccu

SEQ ID NO: 3703 - RNA, 20 nt, Artificial Sequence
  source: /note="Description of Artificial Sequence: Synthetic oligonucleotide"
aguacaguugccaauauaaa

SEQ ID NO: 3704 - RNA, 20 nt, Artificial Sequence
  source: /note="Description of Artificial Sequence: Synthetic oligonucleotide"
uguaauugaaacacuagcau

SEQ ID NO: 3705 - RNA, 20 nt, Artificial Sequence
  source: /note="Description of Artificial Sequence: Synthetic oligonucleotide"
cacaucauguuuauauuuug

SEQ ID NO: 3706 - RNA, 20 nt, Artificial Sequence
  source: /note="Description of Artificial Sequence: Synthetic oligonucleotide"
ggcagugcucaucuugcagg

SEQ ID NO: 3707 - RNA, 20 nt, Artificial Sequence
  source: /note="Description of Artificial Sequence: Synthetic oligonucleotide"
acaggcagugcucaucuugc

SEQ ID NO: 3708 - RNA, 20 nt, Artificial Sequence
  source: /note="Description of Artificial Sequence: Synthetic oligonucleotide"
ggaagcagaaggaagaacac

SEQ ID NO: 3709 - RNA, 20 nt, Artificial Sequence
  source: /note="Description of Artificial Sequence: Synthetic oligonucleotide"
gcugaaauaaaggaagcaga

SEQ ID NO: 3710 - RNA, 20 nt, Artificial Sequence
  source: /note="Description of Artificial Sequence: Synthetic oligonucleotide"
uagacacacagcugaaauaa

SEQ ID NO: 3711 - RNA, 20 nt, Artificial Sequence
  source: /note="Description of Artificial Sequence: Synthetic oligonucleotide"
guguagaaggaggaggaagu

SEQ ID NO: 3712 - RNA, 20 nt, Artificial Sequence
  source: /note="Description of Artificial Sequence: Synthetic oligonucleotide"
ucuccuaguguagaaggagg

SEQ ID NO: 3713 - RNA, 20 nt, Artificial Sequence
  source: /note="Description of Artificial Sequence: Synthetic oligonucleotide"
auuucuccuaguguagaagg

SEQ ID NO: 3714 - RNA, 20 nt, Artificial Sequence
  source: /note="Description of Artificial Sequence: Synthetic oligonucleotide"
gcaauuucuccuaguguaga

SEQ ID NO: 3715 - RNA, 20 nt, Artificial Sequence
  source: /note="Description of Artificial Sequence: Synthetic oligonucleotide"
auagcagauguuaaagauau

SEQ ID NO: 3716 - RNA, 20 nt, Artificial Sequence
  source: /note="Description of Artificial Sequence: Synthetic oligonucleotide"
uuaaaaaaaaagaaugaaga

SEQ ID NO: 3717 - RNA, 20 nt, Artificial Sequence
  source: /note="Description of Artificial Sequence: Synthetic oligonucleotide"
uuugagccagcaauaacagc

SEQ ID NO: 3718 - RNA, 20 nt, Artificial Sequence
  source: /note="Description of Artificial Sequence: Synthetic oligonucleotide"
aaauaacacugaaaugcucc

SEQ ID NO: 3719 - RNA, 20 nt, Artificial Sequence
  source: /note="Description of Artificial Sequence: Synthetic oligonucleotide"
gucuuuaccuugaggguagu

SEQ ID NO: 3720 - RNA, 20 nt, Artificial Sequence
  source: /note="Description of Artificial Sequence: Synthetic oligonucleotide"
gugaaacuuauuuugucuuu

SEQ ID NO: 3721 - RNA, 20 nt, Artificial Sequence
  source: /note="Description of Artificial Sequence: Synthetic oligonucleotide"
gguccgugacacgaucugug

SEQ ID NO: 3722 - RNA, 20 nt, Artificial Sequence
  source: /note="Description of Artificial Sequence: Synthetic oligonucleotide"
aauauccgaauauuacacgg

SEQ ID NO: 3723 - RNA, 20 nt, Artificial Sequence
  source: /note="Description of Artificial Sequence: Synthetic oligonucleotide"
uaggugaucuauuuguaaua

SEQ ID NO: 3724 - RNA, 20 nt, Artificial Sequence
  source: /note="Description of Artificial Sequence: Synthetic oligonucleotide"
ugauaauucuuuaauaguau

SEQ ID NO: 3725 - RNA, 20 nt, Artificial Sequence
  source: /note="Description of Artificial Sequence: Synthetic oligonucleotide"
ugcacuucauuuccuuagca

SEQ ID NO: 3726 - RNA, 20 nt, Artificial Sequence
  source: /note="Description of Artificial Sequence: Synthetic oligonucleotide"
uucagaaaguucucuauacu

SEQ ID NO: 3727 - RNA, 20 nt, Artificial Sequence
  source: /note="Description of Artificial Sequence: Synthetic oligonucleotide"
auggccuguguuaucuuauu

SEQ ID NO: 3728 - RNA, 20 nt, Artificial Sequence
  source: /note="Description of Artificial Sequence: Synthetic oligonucleotide"
auuuuuuaaagaacaaaaga

SEQ ID NO: 3729 - RNA, 20 nt, Artificial Sequence
  source: /note="Description of Artificial Sequence: Synthetic oligonucleotide"
aucucaguaaguuacacuac

SEQ ID NO: 3730 - RNA, 20 nt, Artificial Sequence
  source: /note="Description of Artificial Sequence: Synthetic oligonucleotide"
uagcaucaauacagaauuua

SEQ ID NO: 3731 - RNA, 20 nt, Artificial Sequence
  source: /note="Description of Artificial Sequence: Synthetic oligonucleotide"
guagcucaagaguugcaucu

SEQ ID NO: 3732 - RNA, 20 nt, Artificial Sequence
  source: /note="Description of Artificial Sequence: Synthetic oligonucleotide"
gaccagcauccuuuaucaag

SEQ ID NO: 3733 - RNA, 20 nt, Artificial Sequence
  source: /note="Description of Artificial Sequence: Synthetic oligonucleotide"
caaacauuacacuggcagca

SEQ ID NO: 3734 - RNA, 20 nt, Artificial Sequence
  source: /note="Description of Artificial Sequence: Synthetic oligonucleotide"
gcaaacauuacacuggcagc

SEQ ID NO: 3735 - RNA, 20 nt, Artificial Sequence
  source: /note="Description of Artificial Sequence: Synthetic oligonucleotide"
uaaaugagcaaacauuacac

SEQ ID NO: 3736 - RNA, 20 nt, Artificial Sequence
  source: /note="Description of Artificial Sequence: Synthetic oligonucleotide"
uucaccuucuucaccauccc

SEQ ID NO: 3737 - RNA, 20 nt, Artificial Sequence
  source: /note="Description of Artificial Sequence: Synthetic oligonucleotide"
agagaauagucuguuucugu

SEQ ID NO: 3738 - RNA, 20 nt, Artificial Sequence
  source: /note="Description of Artificial Sequence: Synthetic oligonucleotide"
ugaaaaugaauaaugcaauc

SEQ ID NO: 3739 - RNA, 20 nt, Artificial Sequence
  source: /note="Description of Artificial Sequence: Synthetic oligonucleotide"
cuuccaaagcagauaaaggc

SEQ ID NO: 3740 - RNA, 20 nt, Artificial Sequence
  source: /note="Description of Artificial Sequence: Synthetic oligonucleotide"
uaggcuuccaaagcagauaa

SEQ ID NO: 3741 - RNA, 20 nt, Artificial Sequence
  source: /note="Description of Artificial Sequence: Synthetic oligonucleotide"
aucuuggaagauuaggaaau

SEQ ID NO: 3742 - RNA, 20 nt, Artificial Sequence
  source: /note="Description of Artificial Sequence: Synthetic oligonucleotide"
augauaaaucuuggaagauu

SEQ ID NO: 3743 - RNA, 20 nt, Artificial Sequence
  source: /note="Description of Artificial Sequence: Synthetic oligonucleotide"
augaaggugaugauaaaucu

SEQ ID NO: 3744 - RNA, 20 nt, Artificial Sequence
  source: /note="Description of Artificial Sequence: Synthetic oligonucleotide"
ugcaugcuauggacauauga

SEQ ID NO: 3745 - RNA, 20 nt, Artificial Sequence
  source: /note="Description of Artificial Sequence: Synthetic oligonucleotide"
ugucugagaaaugcaugcua

SEQ ID NO: 3746 - RNA, 20 nt, Artificial Sequence
  source: /note="Description of Artificial Sequence: Synthetic oligonucleotide"
caguaccacaugaaaaacca

SEQ ID NO: 3747 - RNA, 20 nt, Artificial Sequence
  source: /note="Description of Artificial Sequence: Synthetic oligonucleotide"
aaauaucuacuucuuuguca

SEQ ID NO: 3748 - RNA, 20 nt, Artificial Sequence
  source: /note="Description of Artificial Sequence: Synthetic oligonucleotide"
cacagaaugaauagaacggg

SEQ ID NO: 3749 - RNA, 20 nt, Artificial Sequence
  source: /note="Description of Artificial Sequence: Synthetic oligonucleotide"
cccaguugacuauuuauuua

SEQ ID NO: 3750 - RNA, 20 nt, Artificial Sequence
  source: /note="Description of Artificial Sequence: Synthetic oligonucleotide"
aauuggagguacaauaaguu

SEQ ID NO: 3751 - RNA, 20 nt, Artificial Sequence
  source: /note="Description of Artificial Sequence: Synthetic oligonucleotide"
gaauuggagguacaauaagu

SEQ ID NO: 3752 - RNA, 20 nt, Artificial Sequence
  source: /note="Description of Artificial Sequence: Synthetic oligonucleotide"
aaaaacugucacguccccca

SEQ ID NO: 3753 - RNA, 20 nt, Artificial Sequence
  source: /note="Description of Artificial Sequence: Synthetic oligonucleotide"
accuaaaaacugucacgucc

SEQ ID NO: 3754 - RNA, 20 nt, Artificial Sequence
  source: /note="Description of Artificial Sequence: Synthetic oligonucleotide"
caccuaaaaacugucacguc

SEQ ID NO: 3755 - RNA, 20 nt, Artificial Sequence
  source: /note="Description of Artificial Sequence: Synthetic oligonucleotide"
acaccuaaaaacugucacgu

SEQ ID NO: 3756 - RNA, 20 nt, Artificial Sequence
  source: /note="Description of Artificial Sequence: Synthetic oligonucleotide"
uacaccuaaaaacugucacg

SEQ ID NO: 3757 - RNA, 20 nt, Artificial Sequence
  source: /note="Description of Artificial Sequence: Synthetic oligonucleotide"
ccccucaguuuuuaauguac

SEQ ID NO: 3758 - RNA, 20 nt, Artificial Sequence
  source: /note="Description of Artificial Sequence: Synthetic oligonucleotide"
auaaucaucaauucaaaaac

SEQ ID NO: 3759 - RNA, 20 nt, Artificial Sequence
  source: /note="Description of Artificial Sequence: Synthetic oligonucleotide"
gauaaucaucaauucaaaaa

SEQ ID NO: 3760 - RNA, 20 nt, Artificial Sequence
  source: /note="Description of Artificial Sequence: Synthetic oligonucleotide"
cgauaaucaucaauucaaaa

SEQ ID NO: 3761 - RNA, 20 nt, Artificial Sequence
  source: /note="Description of Artificial Sequence: Synthetic oligonucleotide"
gucccggaggucuguugucg

SEQ ID NO: 3762 - RNA, 20 nt, Artificial Sequence
  source: /note="Description of Artificial Sequence: Synthetic oligonucleotide"
uugacacacacaauagucgu

SEQ ID NO: 3763 - RNA, 20 nt, Artificial Sequence
  source: /note="Description of Artificial Sequence: Synthetic oligonucleotide"
guugacacacacaauagucg

SEQ ID NO: 3764 - RNA, 20 nt, Artificial Sequence
  source: /note="Description of Artificial Sequence: Synthetic oligonucleotide"
ugaguuccacuucuguuguu

SEQ ID NO: 3765 - RNA, 20 nt, Artificial Sequence
  source: /note="Description of Artificial Sequence: Synthetic oligonucleotide"
ggagaagaagucguaugagu

SEQ ID NO: 3766 - RNA, 20 nt, Artificial Sequence
  source: /note="Description of Artificial Sequence: Synthetic oligonucleotide"
agaaggugaagacggugggg

SEQ ID NO: 3767 - RNA, 20 nt, Artificial Sequence
  source: /note="Description of Artificial Sequence: Synthetic oligonucleotide"
uuuauguccaaacuugacgu

SEQ ID NO: 3768 - RNA, 20 nt, Artificial Sequence
  source: /note="Description of Artificial Sequence: Synthetic oligonucleotide"
uacccaacuggaauuuuaug

SEQ ID NO: 3769 - RNA, 20 nt, Artificial Sequence
  source: /note="Description of Artificial Sequence: Synthetic oligonucleotide"
uucauugaaaaaaauuaaca

SEQ ID NO: 3770 - RNA, 20 nt, Artificial Sequence
  source: /note="Description of Artificial Sequence: Synthetic oligonucleotide"
uaaacauacaggcauuugaa

SEQ ID NO: 3771 - RNA, 20 nt, Artificial Sequence
  source: /note="Description of Artificial Sequence: Synthetic oligonucleotide"
aauguuucucauaaacauac

SEQ ID NO: 3772 - RNA, 20 nt, Artificial Sequence
  source: /note="Description of Artificial Sequence: Synthetic oligonucleotide"
gaguagcagcauagccaacu

SEQ ID NO: 3773 - RNA, 20 nt, Artificial Sequence
  source: /note="Description of Artificial Sequence: Synthetic oligonucleotide"
cuaaagggauauuuaaaauu

SEQ ID NO: 3774 - RNA, 20 nt, Artificial Sequence
  source: /note="Description of Artificial Sequence: Synthetic oligonucleotide"
cauauuuucuauucucuaaa

SEQ ID NO: 3775 - RNA, 20 nt, Artificial Sequence
  source: /note="Description of Artificial Sequence: Synthetic oligonucleotide"
ucauauuuucuauucucuaa

SEQ ID NO: 3776 - RNA, 20 nt, Artificial Sequence
  source: /note="Description of Artificial Sequence: Synthetic oligonucleotide"
agaaaauuuauauuguugag

SEQ ID NO: 3777 - RNA, 20 nt, Artificial Sequence
  source: /note="Description of Artificial Sequence: Synthetic oligonucleotide"
aaacuuuuuauccuuugugu

SEQ ID NO: 3778 - RNA, 20 nt, Artificial Sequence
  source: /note="Description of Artificial Sequence: Synthetic oligonucleotide"
uccucuuagaaacuaaggau

SEQ ID NO: 3779 - RNA, 20 nt, Artificial Sequence
  source: /note="Description of Artificial Sequence: Synthetic oligonucleotide"
cauuuuccucuuagaaacua

SEQ ID NO: 3780 - RNA, 20 nt, Artificial Sequence
  source: /note="Description of Artificial Sequence: Synthetic oligonucleotide"
gguaacuggcacacagcaga

SEQ ID NO: 3781 - RNA, 20 nt, Artificial Sequence
  source: /note="Description of Artificial Sequence: Synthetic oligonucleotide"
gaacuuaucguuuugguaac

SEQ ID NO: 3782 - RNA, 20 nt, Artificial Sequence
  source: /note="Description of Artificial Sequence: Synthetic oligonucleotide"
ugaguuggaacuuaucguuu

SEQ ID NO: 3783 - RNA, 20 nt, Artificial Sequence
  source: /note="Description of Artificial Sequence: Synthetic oligonucleotide"
uguggguuggaagauugagu

SEQ ID NO: 3784 - RNA, 20 nt, Artificial Sequence
  source: /note="Description of Artificial Sequence: Synthetic oligonucleotide"
aggguuucacggcccuagug

SEQ ID NO: 3785 - RNA, 20 nt, Artificial Sequence
  source: /note="Description of Artificial Sequence: Synthetic oligonucleotide"
ggagccggaggguuucacgg

SEQ ID NO: 3786 - RNA, 20 nt, Artificial Sequence
  source: /note="Description of Artificial Sequence: Synthetic oligonucleotide"
uggagccggaggguuucacg

SEQ ID NO: 3787 - RNA, 20 nt, Artificial Sequence
  source: /note="Description of Artificial Sequence: Synthetic oligonucleotide"
ucgagcacuagacgggugga

SEQ ID NO: 3788 - RNA, 20 nt, Artificial Sequence
  source: /note="Description of Artificial Sequence: Synthetic oligonucleotide"
aaagugguauaaccgguccg

SEQ ID NO: 3789 - RNA, 20 nt, Artificial Sequence
  source: /note="Description of Artificial Sequence: Synthetic oligonucleotide"
cccaaaagugguauaaccgg

SEQ ID NO: 3790 - RNA, 20 nt, Artificial Sequence
  source: /note="Description of Artificial Sequence: Synthetic oligonucleotide"
cucugcccaaaagugguaua

SEQ ID NO: 3791 - RNA, 20 nt, Artificial Sequence
  source: /note="Description of Artificial Sequence: Synthetic oligonucleotide"
aaacauaaaaaucaucucug

SEQ ID NO: 3792 - RNA, 20 nt, Artificial Sequence
  source: /note="Description of Artificial Sequence: Synthetic oligonucleotide"
aaaacauaaaaaucaucucu

SEQ ID NO: 3793 - RNA, 20 nt, Artificial Sequence
  source: /note="Description of Artificial Sequence: Synthetic oligonucleotide"
gcccucguguggugguacgg

SEQ ID NO: 3794 - RNA, 20 nt, Artificial Sequence
  source: /note="Description of Artificial Sequence: Synthetic oligonucleotide"
ugcccucguguggugguacg

SEQ ID NO: 3795 - RNA, 20 nt, Artificial Sequence
  source: /note="Description of Artificial Sequence: Synthetic oligonucleotide"
aggguucaucgacccugaug

SEQ ID NO: 3796 - RNA, 20 nt, Artificial Sequence
  source: /note="Description of Artificial Sequence: Synthetic oligonucleotide"
gaggguucaucgacccugau

SEQ ID NO: 3797 - RNA, 20 nt, Artificial Sequence
  source: /note="Description of Artificial Sequence: Synthetic oligonucleotide"
ggagucggaggguucaucga

SEQ ID NO: 3798 - RNA, 20 nt, Artificial Sequence
  source: /note="Description of Artificial Sequence: Synthetic oligonucleotide"
cggagucggaggguucaucg

SEQ ID NO: 3799 - RNA, 20 nt, Artificial Sequence
  source: /note="Description of Artificial Sequence: Synthetic oligonucleotide"
gugacguuggagguggagga

SEQ ID NO: 3800 - RNA, 20 nt, Artificial Sequence
  source: /note="Description of Artificial Sequence: Synthetic oligonucleotide"
agugacguuggagguggagg

SEQ ID NO: 3801 - RNA, 20 nt, Artificial Sequence
  source: /note="Description of Artificial Sequence: Synthetic oligonucleotide"
ccucacgucaccacguuaga

SEQ ID NO: 3802 - RNA, 20 nt, Artificial Sequence
  source: /note="Description of Artificial Sequence: Synthetic oligonucleotide"
aacggguccgaccucacguc

SEQ ID NO: 3803 - RNA, 20 nt, Artificial Sequence
  source: /note="Description of Artificial Sequence: Synthetic oligonucleotide"
agagggagaaaacggguccg

SEQ ID NO: 3804 - RNA, 20 nt, Artificial Sequence
  source: /note="Description of Artificial Sequence: Synthetic oligonucleotide"
ucucagagggagaaaacggg

SEQ ID NO: 3805 - RNA, 20 nt, Artificial Sequence
  source: /note="Description of Artificial Sequence: Synthetic oligonucleotide"
uauuugaauaaauggguucc

SEQ ID NO: 3806 - RNA, 20 nt, Artificial Sequence
  source: /note="Description of Artificial Sequence: Synthetic oligonucleotide"
uaauaaauauuugaauaaau

SEQ ID NO: 3807 - RNA, 20 nt, Artificial Sequence
  source: /note="Description of Artificial Sequence: Synthetic oligonucleotide"
guaauaaauauuugaauaaa

SEQ ID NO: 3808 - RNA, 20 nt, Artificial Sequence
  source: /note="Description of Artificial Sequence: Synthetic oligonucleotide"
uuauaugucacuuuguuaac

SEQ ID NO: 3809 - RNA, 20 nt, Artificial Sequence
  source: /note="Description of Artificial Sequence: Synthetic oligonucleotide"
uacaucauuuuugcaugcau

SEQ ID NO: 3810 - RNA, 20 nt, Artificial Sequence
  source: /note="Description of Artificial Sequence: Synthetic oligonucleotide"
auacaucauuuuugcaugca

SEQ ID NO: 3811 - RNA, 20 nt, Artificial Sequence
  source: /note="Description of Artificial Sequence: Synthetic oligonucleotide"
uauguugauagggacagcua

SEQ ID NO: 3812 - RNA, 20 nt, Artificial Sequence
  source: /note="Description of Artificial Sequence: Synthetic oligonucleotide"
uguuaauauauauguugaua

SEQ ID NO: 3813 - RNA, 20 nt, Artificial Sequence
  source: /note="Description of Artificial Sequence: Synthetic oligonucleotide"
uuguuaauauauauguugau

SEQ ID NO: 3814 - RNA, 20 nt, Artificial Sequence
  source: /note="Description of Artificial Sequence: Synthetic oligonucleotide"
auagaacaaauugaggcuuu

SEQ ID NO: 3815 - RNA, 20 nt, Artificial Sequence
  source: /note="Description of Artificial Sequence: Synthetic oligonucleotide"
uauagaacaaauugaggcuu

SEQ ID NO: 3816 - RNA, 20 nt, Artificial Sequence
  source: /note="Description of Artificial Sequence: Synthetic oligonucleotide"
uauagcuauagaacaaauug

SEQ ID NO: 3817 - RNA, 20 nt, Artificial Sequence
  source: /note="Description of Artificial Sequence: Synthetic oligonucleotide"
gaucuaucaaauuaagggau

SEQ ID NO: 3818 - RNA, 20 nt, Artificial Sequence
  source: /note="Description of Artificial Sequence: Synthetic oligonucleotide"
uuuaagaucuaucaaauuaa

SEQ ID NO: 3819 - RNA, 20 nt, Artificial Sequence
  source: /note="Description of Artificial Sequence: Synthetic oligonucleotide"
uuuuaagaucuaucaaauua

SEQ ID NO: 3820 - RNA, 20 nt, Artificial Sequence
  source: /note="Description of Artificial Sequence: Synthetic oligonucleotide"
cauagucuacuucucaaaaa

SEQ ID NO: 3821 - RNA, 20 nt, Artificial Sequence
  source: /note="Description of Artificial Sequence: Synthetic oligonucleotide"
ucauagucuacuucucaaaa

SEQ ID NO: 3822 - RNA, 20 nt, Artificial Sequence
  source: /note="Description of Artificial Sequence: Synthetic oligonucleotide"
uaaaucuuaggaaauacuag

SEQ ID NO: 3823 - RNA, 20 nt, Artificial Sequence
  source: /note="Description of Artificial Sequence: Synthetic oligonucleotide"
uucuauuccaaauaaaucuu

SEQ ID NO: 3824 - RNA, 20 nt, Artificial Sequence
  source: /note="Description of Artificial Sequence: Synthetic oligonucleotide"
aagagauuauaaacuacguc

SEQ ID NO: 3825 - RNA, 20 nt, Artificial Sequence
  source: /note="Description of Artificial Sequence: Synthetic oligonucleotide"
ggguguuuuuaaaaggaaca

SEQ ID NO: 3826 - RNA, 20 nt, Artificial Sequence
  source: /note="Description of Artificial Sequence: Synthetic oligonucleotide"
guacaaaaggauggaccgug

SEQ ID NO: 3827 - RNA, 20 nt, Artificial Sequence
  source: /note="Description of Artificial Sequence: Synthetic oligonucleotide"
ugucaaguacaaaaggaugg

SEQ ID NO: 3828 - RNA, 20 nt, Artificial Sequence
  source: /note="Description of Artificial Sequence: Synthetic oligonucleotide"
gaaggcauucacucaggagg

SEQ ID NO: 3829 - RNA, 20 nt, Artificial Sequence
  source: /note="Description of Artificial Sequence: Synthetic oligonucleotide"
ccaauuugaguguuuucaug

SEQ ID NO: 3830 - RNA, 20 nt, Artificial Sequence
  source: /note="Description of Artificial Sequence: Synthetic oligonucleotide"
cagugacacuugugaggacc

SEQ ID NO: 3831 - RNA, 20 nt, Artificial Sequence
  source: /note="Description of Artificial Sequence: Synthetic oligonucleotide"
caucagugacacuugugagg

SEQ ID NO: 3832 - RNA, 20 nt, Artificial Sequence
  source: /note="Description of Artificial Sequence: Synthetic oligonucleotide"
aaggaaaagaagaggggaau

SEQ ID NO: 3833 - RNA, 20 nt, Artificial Sequence
  source: /note="Description of Artificial Sequence: Synthetic oligonucleotide"
caaggaaaagaagaggggaa

SEQ ID NO: 3834 - RNA, 20 nt, Artificial Sequence
  source: /note="Description of Artificial Sequence: Synthetic oligonucleotide"
acgagacuguauaaaguucu

SEQ ID NO: 3835 - RNA, 20 nt, Artificial Sequence
  source: /note="Description of Artificial Sequence: Synthetic oligonucleotide"
uuuaucaaagugaacucucg

SEQ ID NO: 3836 - RNA, 20 nt, Artificial Sequence
  source: /note="Description of Artificial Sequence: Synthetic oligonucleotide"
uuaggguuuucaaauccgag

SEQ ID NO: 3837 - RNA, 20 nt, Artificial Sequence
  source: /note="Description of Artificial Sequence: Synthetic oligonucleotide"
aauauuuuaggguuuucaaa

SEQ ID NO: 3838 - RNA, 20 nt, Artificial Sequence
  source: /note="Description of Artificial Sequence: Synthetic oligonucleotide"
cauaaagggaagggaaaccc

SEQ ID NO: 3839 - RNA, 20 nt, Artificial Sequence
  source: /note="Description of Artificial Sequence: Synthetic oligonucleotide"
auccauaaagggaagggaaa

SEQ ID NO: 3840 - RNA, 20 nt, Artificial Sequence
  source: /note="Description of Artificial Sequence: Synthetic oligonucleotide"
aauccauaaagggaagggaa

SEQ ID NO: 3841 - RNA, 20 nt, Artificial Sequence
  source: /note="Description of Artificial Sequence: Synthetic oligonucleotide"
cgauuuucccccgacuugaa

SEQ ID NO: 3842 - RNA, 20 nt, Artificial Sequence
  source: /note="Description of Artificial Sequence: Synthetic oligonucleotide"
gauacaccuuucgauuuucc

SEQ ID NO: 3843 - RNA, 20 nt, Artificial Sequence
  source: /note="Description of Artificial Sequence: Synthetic oligonucleotide"
ggauacaccuuucgauuuuc

SEQ ID NO: 3844 - RNA, 20 nt, Artificial Sequence
  source: /note="Description of Artificial Sequence: Synthetic oligonucleotide"
gggauacaccuuucgauuuu

SEQ ID NO: 3845 - RNA, 20 nt, Artificial Sequence
  source: /note="Description of Artificial Sequence: Synthetic oligonucleotide"
agggauacaccuuucgauuu

SEQ ID NO: 3846 - RNA, 20 nt, Artificial Sequence
  source: /note="Description of Artificial Sequence: Synthetic oligonucleotide"
auauaaaaggaaagggauac

SEQ ID NO: 3847 - RNA, 20 nt, Artificial Sequence
  source: /note="Description of Artificial Sequence: Synthetic oligonucleotide"
cgggggauugcaccuguccu

SEQ ID NO: 3848 - RNA, 20 nt, Artificial Sequence
  source: /note="Description of Artificial Sequence: Synthetic oligonucleotide"
gauccgggggauugcaccug

SEQ ID NO: 3849 - RNA, 20 nt, Artificial Sequence
  source: /note="Description of Artificial Sequence: Synthetic oligonucleotide"
aaggggauccgggggauugc

SEQ ID NO: 3850 - RNA, 20 nt, Artificial Sequence
  source: /note="Description of Artificial Sequence: Synthetic oligonucleotide"
ggucaaaagagucaagggga

SEQ ID NO: 3851 - RNA, 20 nt, Artificial Sequence
  source: /note="Description of Artificial Sequence: Synthetic oligonucleotide"
gaaaccacuuugacaugggu

SEQ ID NO: 3852 - RNA, 20 nt, Artificial Sequence
  source: /note="Description of Artificial Sequence: Synthetic oligonucleotide"
auauuaaaccagagggagaa

SEQ ID NO: 3853 - RNA, 20 nt, Artificial Sequence
  source: /note="Description of Artificial Sequence: Synthetic oligonucleotide"
guaagacaucggaauauuaa

SEQ ID NO: 3854 - RNA, 20 nt, Artificial Sequence
  source: /note="Description of Artificial Sequence: Synthetic oligonucleotide"
uaucauuuuccacacccuuu

SEQ ID NO: 3855 - RNA, 20 nt, Artificial Sequence
  source: /note="Description of Artificial Sequence: Synthetic oligonucleotide"
cuaucauuuuccacacccuu

SEQ ID NO: 3856 - RNA, 20 nt, Artificial Sequence
  source: /note="Description of Artificial Sequence: Synthetic oligonucleotide"
uuauacuaucauuuuccaca

SEQ ID NO: 3857 - RNA, 20 nt, Artificial Sequence
  source: /note="Description of Artificial Sequence: Synthetic oligonucleotide"
auuauacuaucauuuuccac

SEQ ID NO: 3858 - RNA, 20 nt, Artificial Sequence
  source: /note="Description of Artificial Sequence: Synthetic oligonucleotide"
aaaucauuauacuaucauuu

SEQ ID NO: 3859 - RNA, 20 nt, Artificial Sequence
  source: /note="Description of Artificial Sequence: Synthetic oligonucleotide"
auuuucuuugacgacguuua

SEQ ID NO: 3860 - RNA, 20 nt, Artificial Sequence
  source: /note="Description of Artificial Sequence: Synthetic oligonucleotide"
aucguacggaauauuaaaaa

SEQ ID NO: 3861 - RNA, 20 nt, Artificial Sequence
  source: /note="Description of Artificial Sequence: Synthetic oligonucleotide"
uaucaaaaaauauuucaaag

SEQ ID NO: 3862 - RNA, 20 nt, Artificial Sequence
  source: /note="Description of Artificial Sequence: Synthetic oligonucleotide"
acuaugaaccguaaagagaa

SEQ ID NO: 3863 - RNA, 20 nt, Artificial Sequence
  source: /note="Description of Artificial Sequence: Synthetic oligonucleotide"
acaugugauacgaacuauga

SEQ ID NO: 3864 - RNA, 20 nt, Artificial Sequence
  source: /note="Description of Artificial Sequence: Synthetic oligonucleotide"
uugaaguuucuaaaaaagga

SEQ ID NO: 3865 - RNA, 20 nt, Artificial Sequence
  source: /note="Description of Artificial Sequence: Synthetic oligonucleotide"
accacagacuguaauuaacc

SEQ ID NO: 3866 - RNA, 20 nt, Artificial Sequence
  source: /note="Description of Artificial Sequence: Synthetic oligonucleotide"
aaccacagacuguaauuaac

SEQ ID NO: 3867 - RNA, 20 nt, Artificial Sequence
  source: /note="Description of Artificial Sequence: Synthetic oligonucleotide"
aaaccacagacuguaauuaa

SEQ ID NO: 3868 - RNA, 20 nt, Artificial Sequence
  source: /note="Description of Artificial Sequence: Synthetic oligonucleotide"
caaaccacagacuguaauua

SEQ ID NO: 3869 - RNA, 20 nt, Artificial Sequence
  source: /note="Description of Artificial Sequence: Synthetic oligonucleotide"
ucgagagaccucuucaucaa

SEQ ID NO: 3870 - RNA, 20 nt, Artificial Sequence
  source: /note="Description of Artificial Sequence: Synthetic oligonucleotide"
aaccacaagaaacucgagag

SEQ ID NO: 3871 - RNA, 20 nt, Artificial Sequence
  source: /note="Description of Artificial Sequence: Synthetic oligonucleotide"
aaacccuguaaauaggacga

SEQ ID NO: 3872 - RNA, 20 nt, Artificial Sequence
  source: /note="Description of Artificial Sequence: Synthetic oligonucleotide"
uauacggguacucaucaaaa

SEQ ID NO: 3873 - RNA, 20 nt, Artificial Sequence
  source: /note="Description of Artificial Sequence: Synthetic oligonucleotide"
uuauacggguacucaucaaa

SEQ ID NO: 3874 - RNA, 20 nt, Artificial Sequence
  source: /note="Description of Artificial Sequence: Synthetic oligonucleotide"
gauauccacaaaaaaggaag

SEQ ID NO: 3875 - RNA, 20 nt, Artificial Sequence
  source: /note="Description of Artificial Sequence: Synthetic oligonucleotide"
auaauaaaaacgaggagaua

SEQ ID NO: 3876 - RNA, 20 nt, Artificial Sequence
  source: /note="Description of Artificial Sequence: Synthetic oligonucleotide"
agaauaaacauaccaaauac

SEQ ID NO: 3877 - RNA, 20 nt, Artificial Sequence
  source: /note="Description of Artificial Sequence: Synthetic oligonucleotide"
ugagaugagagaauaaacau

SEQ ID NO: 3878 - RNA, 20 nt, Artificial Sequence
  source: /note="Description of Artificial Sequence: Synthetic oligonucleotide"
ccaggucuuagcaugugacg

SEQ ID NO: 3879 - RNA, 20 nt, Artificial Sequence
  source: /note="Description of Artificial Sequence: Synthetic oligonucleotide"
aagacuuccuguuaaaacgu

SEQ ID NO: 3880 - RNA, 20 nt, Artificial Sequence
  source: /note="Description of Artificial Sequence: Synthetic oligonucleotide"
gaaauaaagaauugaagacu

SEQ ID NO: 3881 - RNA, 20 nt, Artificial Sequence
  source: /note="Description of Artificial Sequence: Synthetic oligonucleotide"
aaaaacguucccaccaggug

SEQ ID NO: 3882 - RNA, 20 nt, Artificial Sequence
  source: /note="Description of Artificial Sequence: Synthetic oligonucleotide"
aauuuguaaaaaacguuccc

SEQ ID NO: 3883 - RNA, 20 nt, Artificial Sequence
  source: /note="Description of Artificial Sequence: Synthetic oligonucleotide"
ugaaauuuguaaaaaacguu

SEQ ID NO: 3884 - RNA, 20 nt, Artificial Sequence
  source: /note="Description of Artificial Sequence: Synthetic oligonucleotide"
uugaaauuuguaaaaaacgu

SEQ ID NO: 3885 - RNA, 20 nt, Artificial Sequence
  source: /note="Description of Artificial Sequence: Synthetic oligonucleotide"
gauuaaaauaaaaggaauac

SEQ ID NO: 3886 - RNA, 20 nt, Artificial Sequence
  source: /note="Description of Artificial Sequence: Synthetic oligonucleotide"
cauaaaagaaauaguucaac

SEQ ID NO: 3887 - RNA, 20 nt, Artificial Sequence
  source: /note="Description of Artificial Sequence: Synthetic oligonucleotide"
acauaaaagaaauaguucaa

SEQ ID NO: 3888 - RNA, 20 nt, Artificial Sequence
  source: /note="Description of Artificial Sequence: Synthetic oligonucleotide"
cacauaaaagaaauaguuca

SEQ ID NO: 3889 - RNA, 20 nt, Artificial Sequence
  source: /note="Description of Artificial Sequence: Synthetic oligonucleotide"
aauucauacuacauuugaca

SEQ ID NO: 3890 - RNA, 20 nt, Artificial Sequence
  source: /note="Description of Artificial Sequence: Synthetic oligonucleotide"
cagaacaagaacuagaaucg

SEQ ID NO: 3891 - RNA, 20 nt, Artificial Sequence
  source: /note="Description of Artificial Sequence: Synthetic oligonucleotide"
cauccuuuguuucaccauuc

SEQ ID NO: 3892 - RNA, 20 nt, Artificial Sequence
  source: /note="Description of Artificial Sequence: Synthetic oligonucleotide"
ugaaggucauccuuuguuuc

SEQ ID NO: 3893 - RNA, 20 nt, Artificial Sequence
  source: /note="Description of Artificial Sequence: Synthetic oligonucleotide"
guaauccaucgugaagguca

SEQ ID NO: 3894 - RNA, 20 nt, Artificial Sequence
  source: /note="Description of Artificial Sequence: Synthetic oligonucleotide"
aaggaaacagaauaacguaa

SEQ ID NO: 3895 - RNA, 20 nt, Artificial Sequence
  source: /note="Description of Artificial Sequence: Synthetic oligonucleotide"
cugucaaacuaaagaaggag

SEQ ID NO: 3896 - RNA, 20 nt, Artificial Sequence
  source: /note="Description of Artificial Sequence: Synthetic oligonucleotide"
aaaagaaaaaagacuaggaa

SEQ ID NO: 3897 - RNA, 20 nt, Artificial Sequence
  source: /note="Description of Artificial Sequence: Synthetic oligonucleotide"
gaccauauguccuuucacua

SEQ ID NO: 3898 - RNA, 20 nt, Artificial Sequence
  source: /note="Description of Artificial Sequence: Synthetic oligonucleotide"
gaacaaauaacgaccauaug

SEQ ID NO: 3899 - RNA, 20 nt, Artificial Sequence
  source: /note="Description of Artificial Sequence: Synthetic oligonucleotide"
uuuaaugugaacaaauaacg

SEQ ID NO: 3900 - RNA, 20 nt, Artificial Sequence
  source: /note="Description of Artificial Sequence: Synthetic oligonucleotide"
agaaccccacgauuacauuu

SEQ ID NO: 3901 - RNA, 20 nt, Artificial Sequence
  source: /note="Description of Artificial Sequence: Synthetic oligonucleotide"
guuuucauaaaguaaagaac

SEQ ID NO: 3902 - RNA, 20 nt, Artificial Sequence
  source: /note="Description of Artificial Sequence: Synthetic oligonucleotide"
uguuuucauaaaguaaagaa

SEQ ID NO: 3903 - RNA, 20 nt, Artificial Sequence
  source: /note="Description of Artificial Sequence: Synthetic oligonucleotide"
auguuuucauaaaguaaaga

SEQ ID NO: 3904 - RNA, 20 nt, Artificial Sequence
  source: /note="Description of Artificial Sequence: Synthetic oligonucleotide"
gagaaguaauaaaucaagug

SEQ ID NO: 3905 - RNA, 20 nt, Artificial Sequence
  source: /note="Description of Artificial Sequence: Synthetic oligonucleotide"
gacuuagauaucuaguucaa

SEQ ID NO: 3906 - RNA, 20 nt, Artificial Sequence
  source: /note="Description of Artificial Sequence: Synthetic oligonucleotide"
ugacuuagauaucuaguuca

SEQ ID NO: 3907 - RNA, 20 nt, Artificial Sequence
  source: /note="Description of Artificial Sequence: Synthetic oligonucleotide"
auagcacgacacaaaaaauu

SEQ ID NO: 3908 - RNA, 20 nt, Artificial Sequence
  source: /note="Description of Artificial Sequence: Synthetic oligonucleotide"
caagaggaguuuaugacuca

SEQ ID NO: 3909 - RNA, 20 nt, Artificial Sequence
  source: /note="Description of Artificial Sequence: Synthetic oligonucleotide"
aauaucauucgaaauuucgg

SEQ ID NO: 3910 - RNA, 20 nt, Artificial Sequence
  source: /note="Description of Artificial Sequence: Synthetic oligonucleotide"
ccgagaaauaagauaaggua

SEQ ID NO: 3911 - RNA, 20 nt, Artificial Sequence
  source: /note="Description of Artificial Sequence: Synthetic oligonucleotide"
uauaaauguacccaaacaaa

SEQ ID NO: 3912 - RNA, 20 nt, Artificial Sequence
  source: /note="Description of Artificial Sequence: Synthetic oligonucleotide"
auauaaauguacccaaacaa

SEQ ID NO: 3913 - RNA, 20 nt, Artificial Sequence
  source: /note="Description of Artificial Sequence: Synthetic oligonucleotide"
aguaaacuaauauaaaugua

SEQ ID NO: 3914 - RNA, 20 nt, Artificial Sequence
  source: /note="Description of Artificial Sequence: Synthetic oligonucleotide"
uaguaaacuaauauaaaugu

SEQ ID NO: 3915 - RNA, 20 nt, Artificial Sequence
  source: /note="Description of Artificial Sequence: Synthetic oligonucleotide"
uagacacaaaugugaguuaa

SEQ ID NO: 3916 - RNA, 20 nt, Artificial Sequence
  source: /note="Description of Artificial Sequence: Synthetic oligonucleotide"
aaguucaauuaaaaacguuu

SEQ ID NO: 3917 - RNA, 20 nt, Artificial Sequence
  source: /note="Description of Artificial Sequence: Synthetic oligonucleotide"
uaaguucaauuaaaaacguu

SEQ ID NO: 3918 - RNA, 20 nt, Artificial Sequence
  source: /note="Description of Artificial Sequence: Synthetic oligonucleotide"
aucaagacguaaaauguaaa

SEQ ID NO: 3919 - RNA, 20 nt, Artificial Sequence
  source: /note="Description of Artificial Sequence: Synthetic oligonucleotide"
aaaaaggacacaauagaaga

SEQ ID NO: 3920 - RNA, 20 nt, Artificial Sequence
  source: /note="Description of Artificial Sequence: Synthetic oligonucleotide"
uaaaaaggacacaauagaag

SEQ ID NO: 3921 - RNA, 20 nt, Artificial Sequence
  source: /note="Description of Artificial Sequence: Synthetic oligonucleotide"
gacgguaugguuucaguaga

SEQ ID NO: 3922 - RNA, 20 nt, Artificial Sequence
  source: /note="Description of Artificial Sequence: Synthetic oligonucleotide"
aggaaguacauagcacggaa

SEQ ID NO: 3923 - RNA, 20 nt, Artificial Sequence
  source: /note="Description of Artificial Sequence: Synthetic oligonucleotide"
cguuuauuaaaaagguagac

SEQ ID NO: 3924 - RNA, 20 nt, Artificial Sequence
  source: /note="Description of Artificial Sequence: Synthetic oligonucleotide"
gaaaccacucaacagacaag

SEQ ID NO: 3925 - RNA, 20 nt, Artificial Sequence
  source: /note="Description of Artificial Sequence: Synthetic oligonucleotide"
acugugaacacauagaagaa

SEQ ID NO: 3926 - RNA, 20 nt, Artificial Sequence
  source: /note="Description of Artificial Sequence: Synthetic oligonucleotide"
gguaagauuguccauacauc

SEQ ID NO: 3927 - RNA, 20 nt, Artificial Sequence
  source: /note="Description of Artificial Sequence: Synthetic oligonucleotide"
gacugaagucgguaagauug

SEQ ID NO: 3928 - RNA, 20 nt, Artificial Sequence
  source: /note="Description of Artificial Sequence: Synthetic oligonucleotide"
agguguaagaguggucguga

SEQ ID NO: 3929 - RNA, 20 nt, Artificial Sequence
  source: /note="Description of Artificial Sequence: Synthetic oligonucleotide"
aagaauggucguuacuuacu

SEQ ID NO: 3930 - RNA, 20 nt, Artificial Sequence
  source: /note="Description of Artificial Sequence: Synthetic oligonucleotide"
cgcgauaacgacuuaguaua

SEQ ID NO: 3931 - RNA, 20 nt, Artificial Sequence
  source: /note="Description of Artificial Sequence: Synthetic oligonucleotide"
ucgcgauaacgacuuaguau

SEQ ID NO: 3932 - RNA, 20 nt, Artificial Sequence
  source: /note="Description of Artificial Sequence: Synthetic oligonucleotide"
uucaaaaguucagguauggu

SEQ ID NO: 3933 - RNA, 20 nt, Artificial Sequence
  source: /note="Description of Artificial Sequence: Synthetic oligonucleotide"
cacucgaugacacgggccgg

SEQ ID NO: 3934 - RNA, 20 nt, Artificial Sequence
  source: /note="Description of Artificial Sequence: Synthetic oligonucleotide"
guccgcacucgaugacacgg

SEQ ID NO: 3935 - RNA, 20 nt, Artificial Sequence
  source: /note="Description of Artificial Sequence: Synthetic oligonucleotide"
aggguuucacgacguuaaug

SEQ ID NO: 3936 - RNA, 20 nt, Artificial Sequence
  source: /note="Description of Artificial Sequence: Synthetic oligonucleotide"
gaguuuacuagguggacgga

SEQ ID NO: 3937 - RNA, 20 nt, Artificial Sequence
  source: /note="Description of Artificial Sequence: Synthetic oligonucleotide"
ggaguuuacuagguggacgg

SEQ ID NO: 3938 - RNA, 20 nt, Artificial Sequence
  source: /note="Description of Artificial Sequence: Synthetic oligonucleotide"
ugguacccuaaagugguccg

SEQ ID NO: 3939 - RNA, 20 nt, Artificial Sequence
  source: /note="Description of Artificial Sequence: Synthetic oligonucleotide"
aaagugguacccuaaagugg

SEQ ID NO: 3940 - RNA, 20 nt, Artificial Sequence
  source: /note="Description of Artificial Sequence: Synthetic oligonucleotide"
aucucgaccccaaaguggua

SEQ ID NO: 3941 - RNA, 20 nt, Artificial Sequence
  source: /note="Description of Artificial Sequence: Synthetic oligonucleotide"
caucucgaccccaaaguggu

SEQ ID NO: 3942 - RNA, 20 nt, Artificial Sequence
  source: /note="Description of Artificial Sequence: Synthetic oligonucleotide"
aacauagaaaucaucucgac

SEQ ID NO: 3943 - RNA, 20 nt, Artificial Sequence
  source: /note="Description of Artificial Sequence: Synthetic oligonucleotide"
aaacauagaaaucaucucga

SEQ ID NO: 3944 - RNA, 20 nt, Artificial Sequence
  source: /note="Description of Artificial Sequence: Synthetic oligonucleotide"
aaaacauagaaaucaucucg

SEQ ID NO: 3945 - RNA, 20 nt, Artificial Sequence
  source: /note="Description of Artificial Sequence: Synthetic oligonucleotide"
agggaucaucgacucuaaug

SEQ ID NO: 3946 - RNA, 20 nt, Artificial Sequence
  source: /note="Description of Artificial Sequence: Synthetic oligonucleotide"
gugacguuggaggcggagga

SEQ ID NO: 3947 - RNA, 20 nt, Artificial Sequence
  source: /note="Description of Artificial Sequence: Synthetic oligonucleotide"
agugacguuggaggcggagg

SEQ ID NO: 3948 - RNA, 20 nt, Artificial Sequence
  source: /note="Description of Artificial Sequence: Synthetic oligonucleotide"
agugaguccgaccucacguu

SEQ ID NO: 3949 - RNA, 20 nt, Artificial Sequence
  source: /note="Description of Artificial Sequence: Synthetic oligonucleotide"
aaaacgagacagugaguccg

SEQ ID NO: 3950 - RNA, 20 nt, Artificial Sequence
  source: /note="Description of Artificial Sequence: Synthetic oligonucleotide"
ccucaaaacgagacagugag

SEQ ID NO: 3951 - RNA, 20 nt, Artificial Sequence
  source: /note="Description of Artificial Sequence: Synthetic oligonucleotide"
aaaacgaaaaaaaaaacucu

SEQ ID NO: 3952 - RNA, 20 nt, Artificial Sequence
  source: /note="Description of Artificial Sequence: Synthetic oligonucleotide"
uuacacacguccaaaaauac

SEQ ID NO: 3953 - RNA, 20 nt, Artificial Sequence
  source: /note="Description of Artificial Sequence: Synthetic oligonucleotide"
ucgacaauuuguuacacacg

SEQ ID NO: 3954 - RNA, 20 nt, Artificial Sequence
  source: /note="Description of Artificial Sequence: Synthetic oligonucleotide"
agaacuaacguggguucaaa

SEQ ID NO: 3955 - RNA, 20 nt, Artificial Sequence
  source: /note="Description of Artificial Sequence: Synthetic oligonucleotide"
aaauaggugaguuuauaauu

SEQ ID NO: 3956 - RNA, 20 nt, Artificial Sequence
  source: /note="Description of Artificial Sequence: Synthetic oligonucleotide"
gacuuauuauaagaauguag

SEQ ID NO: 3957 - RNA, 20 nt, Artificial Sequence
  source: /note="Description of Artificial Sequence: Synthetic oligonucleotide"
guaugucauaaaucggaaaa

SEQ ID NO: 3958 - RNA, 20 nt, Artificial Sequence
  source: /note="Description of Artificial Sequence: Synthetic oligonucleotide"
aaaggccuuacaguauauca

SEQ ID NO: 3959 - RNA, 20 nt, Artificial Sequence
  source: /note="Description of Artificial Sequence: Synthetic oligonucleotide"
gagguauuaaaaccgaaaag

SEQ ID NO: 3960 - RNA, 20 nt, Artificial Sequence
  source: /note="Description of Artificial Sequence: Synthetic oligonucleotide"
aaaaugacagagguauuaaa

SEQ ID NO: 3961 - RNA, 20 nt, Artificial Sequence
  source: /note="Description of Artificial Sequence: Synthetic oligonucleotide"
acggauauguaaggagggag

SEQ ID NO: 3962 - RNA, 20 nt, Artificial Sequence
  source: /note="Description of Artificial Sequence: Synthetic oligonucleotide"
accuguuuacauauuacugu

SEQ ID NO: 3963 - RNA, 20 nt, Artificial Sequence
  source: /note="Description of Artificial Sequence: Synthetic oligonucleotide"
caccaauguaggaugcacaa

SEQ ID NO: 3964 - RNA, 20 nt, Artificial Sequence
  source: /note="Description of Artificial Sequence: Synthetic oligonucleotide"
uguaaucccaagugauaacc

SEQ ID NO: 3965 - RNA, 20 nt, Artificial Sequence
  source: /note="Description of Artificial Sequence: Synthetic oligonucleotide"
aaauguaaucccaagugaua

SEQ ID NO: 3966 - RNA, 20 nt, Artificial Sequence
  source: /note="Description of Artificial Sequence: Synthetic oligonucleotide"
uuugggguaucaaauguaau

SEQ ID NO: 3967 - RNA, 20 nt, Artificial Sequence
  source: /note="Description of Artificial Sequence: Synthetic oligonucleotide"
guuugggguaucaaauguaa

SEQ ID NO: 3968 - RNA, 20 nt, Artificial Sequence
  source: /note="Description of Artificial Sequence: Synthetic oligonucleotide"
uaguuguaggguauggucuc

SEQ ID NO: 3969 - RNA, 20 nt, Artificial Sequence
  source: /note="Description of Artificial Sequence: Synthetic oligonucleotide"
aauaauaugaaauucaaaau

SEQ ID NO: 3970 - RNA, 20 nt, Artificial Sequence
  source: /note="Description of Artificial Sequence: Synthetic oligonucleotide"
uaauaauaugaaauucaaaa

SEQ ID NO: 3971 - RNA, 20 nt, Artificial Sequence
  source: /note="Description of Artificial Sequence: Synthetic oligonucleotide"
aaauauuuaaugagucagag

SEQ ID NO: 3972 - RNA, 20 nt, Artificial Sequence
  source: /note="Description of Artificial Sequence: Synthetic oligonucleotide"
gacuaccaaaauauucacaa

SEQ ID NO: 3973 - RNA, 20 nt, Artificial Sequence
  source: /note="Description of Artificial Sequence: Synthetic oligonucleotide"
acucaagaguacucuagacu

SEQ ID NO: 3974 - RNA, 20 nt, Artificial Sequence
  source: /note="Description of Artificial Sequence: Synthetic oligonucleotide"
ggguacgacaagaguaguau

SEQ ID NO: 3975 - RNA, 20 nt, Artificial Sequence
  source: /note="Description of Artificial Sequence: Synthetic oligonucleotide"
gggguacgacaagaguagua

SEQ ID NO: 3976 - RNA, 20 nt, Artificial Sequence
  source: /note="Description of Artificial Sequence: Synthetic oligonucleotide"
accuucauuaaccuaguacc

SEQ ID NO: 3977 - RNA, 20 nt, Artificial Sequence
  source: /note="Description of Artificial Sequence: Synthetic oligonucleotide"
caccuucauuaaccuaguac

SEQ ID NO: 3978 - RNA, 20 nt, Artificial Sequence
  source: /note="Description of Artificial Sequence: Synthetic oligonucleotide"
ccaccuucauuaaccuagua

SEQ ID NO: 3979 - RNA, 20 nt, Artificial Sequence
  source: /note="Description of Artificial Sequence: Synthetic oligonucleotide"
uccaccuucauuaaccuagu

SEQ ID NO: 3980 - RNA, 20 nt, Artificial Sequence
  source: /note="Description of Artificial Sequence: Synthetic oligonucleotide"
ucucugguccaccuucauua

SEQ ID NO: 3981 - RNA, 20 nt, Artificial Sequence
  source: /note="Description of Artificial Sequence: Synthetic oligonucleotide"
cacaguuccgucucuggucc

SEQ ID NO: 3982 - RNA, 20 nt, Artificial Sequence
  source: /note="Description of Artificial Sequence: Synthetic oligonucleotide"
guacacaguuccgucucugg

SEQ ID NO: 3983 - RNA, 20 nt, Artificial Sequence
  source: /note="Description of Artificial Sequence: Synthetic oligonucleotide"
agguauuauggguacacagu

SEQ ID NO: 3984 - RNA, 20 nt, Artificial Sequence
  source: /note="Description of Artificial Sequence: Synthetic oligonucleotide"
guuuuaucacacuauaccaa

SEQ ID NO: 3985 - RNA, 20 nt, Artificial Sequence
  source: /note="Description of Artificial Sequence: Synthetic oligonucleotide"
acauaguuuuaucacacuau

SEQ ID NO: 3986 - RNA, 20 nt, Artificial Sequence
  source: /note="Description of Artificial Sequence: Synthetic oligonucleotide"
aaccagaaauuggaaaaugg

SEQ ID NO: 3987 - RNA, 20 nt, Artificial Sequence
  source: /note="Description of Artificial Sequence: Synthetic oligonucleotide"
ccuaaccagaaauuggaaaa

SEQ ID NO: 3988 - RNA, 20 nt, Artificial Sequence
  source: /note="Description of Artificial Sequence: Synthetic oligonucleotide"
uauuuuuccuaaccagaaau

SEQ ID NO: 3989 - RNA, 20 nt, Artificial Sequence
  source: /note="Description of Artificial Sequence: Synthetic oligonucleotide"
agguugugggucaauuaagg

SEQ ID NO: 3990 - RNA, 20 nt, Artificial Sequence
  source: /note="Description of Artificial Sequence: Synthetic oligonucleotide"
acaagguugugggucaauua

SEQ ID NO: 3991 - RNA, 20 nt, Artificial Sequence
  source: /note="Description of Artificial Sequence: Synthetic oligonucleotide"
uucauugcaaacaagguugu

SEQ ID NO: 3992 - RNA, 20 nt, Artificial Sequence
  source: /note="Description of Artificial Sequence: Synthetic oligonucleotide"
cuucauugcaaacaagguug

SEQ ID NO: 3993 - RNA, 20 nt, Artificial Sequence
  source: /note="Description of Artificial Sequence: Synthetic oligonucleotide"
uugauucuucauugcaaaca

SEQ ID NO: 3994 - RNA, 20 nt, Artificial Sequence
  source: /note="Description of Artificial Sequence: Synthetic oligonucleotide"
auuaugcccauggacacuca

SEQ ID NO: 3995 - RNA, 20 nt, Artificial Sequence
  source: /note="Description of Artificial Sequence: Synthetic oligonucleotide"
aggcaacugaauuaugccca

SEQ ID NO: 3996 - RNA, 20 nt, Artificial Sequence
  source: /note="Description of Artificial Sequence: Synthetic oligonucleotide"
guaucauuggcauugaauga

SEQ ID NO: 3997 - RNA, 20 nt, Artificial Sequence
  source: /note="Description of Artificial Sequence: Synthetic oligonucleotide"
uguaggcuuugcaguaucau

SEQ ID NO: 3998 - RNA, 20 nt, Artificial Sequence
  source: /note="Description of Artificial Sequence: Synthetic oligonucleotide"
gguacaugaauuugccuugu

SEQ ID NO: 3999 - RNA, 20 nt, Artificial Sequence
  source: /note="Description of Artificial Sequence: Synthetic oligonucleotide"
aaaggauggagucugucugu

SEQ ID NO: 4000 - RNA, 20 nt, Artificial Sequence
  source: /note="Description of Artificial Sequence: Synthetic oligonucleotide"
gaauaguuugagaaaaagga

SEQ ID NO: 4001 - RNA, 20 nt, Artificial Sequence
  source: /note="Description of Artificial Sequence: Synthetic oligonucleotide"
ucuugaauaguuugagaaaa

SEQ ID NO: 4002 - RNA, 20 nt, Artificial Sequence
  source: /note="Description of Artificial Sequence: Synthetic oligonucleotide"
uuucauuuuuugaggauaga

SEQ ID NO: 4003 - RNA, 20 nt, Artificial Sequence
  source: /note="Description of Artificial Sequence: Synthetic oligonucleotide"
aggauauuuuucauuuuuug

SEQ ID NO: 4004 - RNA, 20 nt, Artificial Sequence
  source: /note="Description of Artificial Sequence: Synthetic oligonucleotide"
cacucauuucccaaaugaag

SEQ ID NO: 4005 - RNA, 20 nt, Artificial Sequence
  source: /note="Description of Artificial Sequence: Synthetic oligonucleotide"
auuaucagaaagcaggucag

SEQ ID NO: 4006 - RNA, 20 nt, Artificial Sequence
  source: /note="Description of Artificial Sequence: Synthetic oligonucleotide"
gucaugcauuaucagaaagc

SEQ ID NO: 4007 - RNA, 20 nt, Artificial Sequence
  source: /note="Description of Artificial Sequence: Synthetic oligonucleotide"
auacgguccagucccaugug

SEQ ID NO: 4008 - RNA, 20 nt, Artificial Sequence
  source: /note="Description of Artificial Sequence: Synthetic oligonucleotide"
aucaccaaauacgguccagu

SEQ ID NO: 4009 - RNA, 20 nt, Artificial Sequence
  source: /note="Description of Artificial Sequence: Synthetic oligonucleotide"
gaucaccaaauacgguccag

SEQ ID NO: 4010 - RNA, 20 nt, Artificial Sequence
  source: /note="Description of Artificial Sequence: Synthetic oligonucleotide"
uaugagaucaccaaauacgg

SEQ ID NO: 4011 - RNA, 20 nt, Artificial Sequence
  source: /note="Description of Artificial Sequence: Synthetic oligonucleotide"
cuuuacugaauuaugagauc

SEQ ID NO: 4012 - RNA, 20 nt, Artificial Sequence
  source: /note="Description of Artificial Sequence: Synthetic oligonucleotide"
ugacaucuaucagaagguca

SEQ ID NO: 4013 - RNA, 20 nt, Artificial Sequence
  source: /note="Description of Artificial Sequence: Synthetic oligonucleotide"
gugacaucuaucagaagguc

SEQ ID NO: 4014 - RNA, 20 nt, Artificial Sequence
  source: /note="Description of Artificial Sequence: Synthetic oligonucleotide"
uaggaaugcagcugcuuuag

SEQ ID NO: 4015 - RNA, 20 nt, Artificial Sequence
  source: /note="Description of Artificial Sequence: Synthetic oligonucleotide"
aaacuuaaucaugccucacu

SEQ ID NO: 4016 - RNA, 20 nt, Artificial Sequence
  source: /note="Description of Artificial Sequence: Synthetic oligonucleotide"
auacuccagaaccuaauagu

SEQ ID NO: 4017 - RNA, 20 nt, Artificial Sequence
  source: /note="Description of Artificial Sequence: Synthetic oligonucleotide"
aauacuccagaaccuaauag

SEQ ID NO: 4018 - RNA, 20 nt, Artificial Sequence
  source: /note="Description of Artificial Sequence: Synthetic oligonucleotide"
gcuagaaaaacuuuccucuu

SEQ ID NO: 4019 - RNA, 20 nt, Artificial Sequence
  source: /note="Description of Artificial Sequence: Synthetic oligonucleotide"
ugcuagaaaaacuuuccucu

SEQ ID NO: 4020 - RNA, 20 nt, Artificial Sequence
  source: /note="Description of Artificial Sequence: Synthetic oligonucleotide"
acaaaugaacaacccuuagu

SEQ ID NO: 4021 - RNA, 20 nt, Artificial Sequence
  source: /note="Description of Artificial Sequence: Synthetic oligonucleotide"
gaaaaaaaacagugaaagaa

SEQ ID NO: 4022 - RNA, 20 nt, Artificial Sequence
  source: /note="Description of Artificial Sequence: Synthetic oligonucleotide"
agaaaaaaaacagugaaaga

SEQ ID NO: 4023 - RNA, 20 nt, Artificial Sequence
  source: /note="Description of Artificial Sequence: Synthetic oligonucleotide"
caacagccagcugaccagaa

SEQ ID NO: 4024 - RNA, 20 nt, Artificial Sequence
  source: /note="Description of Artificial Sequence: Synthetic oligonucleotide"
gaaagugucauuucuaugau

SEQ ID NO: 4025 - RNA, 20 nt, Artificial Sequence
  source: /note="Description of Artificial Sequence: Synthetic oligonucleotide"
augagaaacaaagugaaggc

SEQ ID NO: 4026 - RNA, 20 nt, Artificial Sequence
  source: /note="Description of Artificial Sequence: Synthetic oligonucleotide"
uuggaugagaaacaaaguga

SEQ ID NO: 4027 - RNA, 20 nt, Artificial Sequence
  source: /note="Description of Artificial Sequence: Synthetic oligonucleotide"
gaaaguuuugucauugauuu

SEQ ID NO: 4028 - RNA, 20 nt, Artificial Sequence
  source: /note="Description of Artificial Sequence: Synthetic oligonucleotide"
ccaaguugacucagguucau

SEQ ID NO: 4029 - RNA, 20 nt, Artificial Sequence
  source: /note="Description of Artificial Sequence: Synthetic oligonucleotide"
ccuuuaugccaaguugacuc

SEQ ID NO: 4030 - RNA, 20 nt, Artificial Sequence
  source: /note="Description of Artificial Sequence: Synthetic oligonucleotide"
ucacugagcaaaguggaguu

SEQ ID NO: 4031 - RNA, 20 nt, Artificial Sequence
  source: /note="Description of Artificial Sequence: Synthetic oligonucleotide"
aauguuaucacugagcaaag

SEQ ID NO: 4032 - RNA, 20 nt, Artificial Sequence
  source: /note="Description of Artificial Sequence: Synthetic oligonucleotide"
ugaggaaguauuuuuagacu

SEQ ID NO: 4033 - RNA, 20 nt, Artificial Sequence
  source: /note="Description of Artificial Sequence: Synthetic oligonucleotide"
gacugagauuuuggaauaug

SEQ ID NO: 4034 - RNA, 20 nt, Artificial Sequence
  source: /note="Description of Artificial Sequence: Synthetic oligonucleotide"
uguauuaaugacugagauuu

SEQ ID NO: 4035 - RNA, 20 nt, Artificial Sequence
  source: /note="Description of Artificial Sequence: Synthetic oligonucleotide"
cuacaacagccgagaagcac

SEQ ID NO: 4036 - RNA, 20 nt, Artificial Sequence
  source: /note="Description of Artificial Sequence: Synthetic oligonucleotide"
auaaacauaauuuugcuucc

SEQ ID NO: 4037 - RNA, 20 nt, Artificial Sequence
  source: /note="Description of Artificial Sequence: Synthetic oligonucleotide"
agaauauuuacguuuuagaa

SEQ ID NO: 4038 - RNA, 20 nt, Artificial Sequence
  source: /note="Description of Artificial Sequence: Synthetic oligonucleotide"
guuugugaccauggagauca

SEQ ID NO: 4039 - RNA, 20 nt, Artificial Sequence
  source: /note="Description of Artificial Sequence: Synthetic oligonucleotide"
ugaaauacuguuugugacca

SEQ ID NO: 4040 - RNA, 20 nt, Artificial Sequence
  source: /note="Description of Artificial Sequence: Synthetic oligonucleotide"
uuuuuuuuuuuuugauaaaa

SEQ ID NO: 4041 - RNA, 20 nt, Artificial Sequence
  source: /note="Description of Artificial Sequence: Synthetic oligonucleotide"
cacgaagacguagggucgga

SEQ ID NO: 4042 - RNA, 20 nt, Artificial Sequence
  source: /note="Description of Artificial Sequence: Synthetic oligonucleotide"
gcacgaagacguagggucgg

SEQ ID NO: 4043 - RNA, 20 nt, Artificial Sequence
  source: /note="Description of Artificial Sequence: Synthetic oligonucleotide"
uccuccaccuccaacgucac

SEQ ID NO: 4044 - RNA, 20 nt, Artificial Sequence
  source: /note="Description of Artificial Sequence: Synthetic oligonucleotide"
gcgaacuugaguccuccacc

SEQ ID NO: 4045 - RNA, 20 nt, Artificial Sequence
  source: /note="Description of Artificial Sequence: Synthetic oligonucleotide"
uuagcgaacuugaguccucc

SEQ ID NO: 4046 - RNA, 20 nt, Artificial Sequence
  source: /note="Description of Artificial Sequence: Synthetic oligonucleotide"
cucuuagcgaacuugagucc

SEQ ID NO: 4047 - RNA, 20 nt, Artificial Sequence
  source: /note="Description of Artificial Sequence: Synthetic oligonucleotide"
guccucuuagcgaacuugag

SEQ ID NO: 4048 - RNA, 20 nt, Artificial Sequence
  source: /note="Description of Artificial Sequence: Synthetic oligonucleotide"
cgaugggccguccgacuccg

SEQ ID NO: 4049 - RNA, 20 nt, Artificial Sequence
  source: /note="Description of Artificial Sequence: Synthetic oligonucleotide"
agaucgaugggccguccgac

SEQ ID NO: 4050 - RNA, 20 nt, Artificial Sequence
  source: /note="Description of Artificial Sequence: Synthetic oligonucleotide"
acauuaagaucgaugggccg

SEQ ID NO: 4051 - RNA, 20 nt, Artificial Sequence
  source: /note="Description of Artificial Sequence: Synthetic oligonucleotide"
acggacauuaagaucgaugg

SEQ ID NO: 4052 - RNA, 20 nt, Artificial Sequence
  source: /note="Description of Artificial Sequence: Synthetic oligonucleotide"
ugucuuaaucgguccacacc

SEQ ID NO: 4053 - RNA, 20 nt, Artificial Sequence
  source: /note="Description of Artificial Sequence: Synthetic oligonucleotide"
uuaugucuuaaucgguccac

SEQ ID NO: 4054 - RNA, 20 nt, Artificial Sequence
  source: /note="Description of Artificial Sequence: Synthetic oligonucleotide"
gauuuuuaugucuuaaucgg

SEQ ID NO: 4055 - RNA, 20 nt, Artificial Sequence
  source: /note="Description of Artificial Sequence: Synthetic oligonucleotide"
aguccucaaguucuggucag

SEQ ID NO: 4056 - RNA, 20 nt, Artificial Sequence
  source: /note="Description of Artificial Sequence: Synthetic oligonucleotide"
acccaccuaguggacuccag

SEQ ID NO: 4057 - RNA, 20 nt, Artificial Sequence
  source: /note="Description of Artificial Sequence: Synthetic oligonucleotide"
acgccacccaccuaguggac

SEQ ID NO: 4058 - RNA, 20 nt, Artificial Sequence
  source: /note="Description of Artificial Sequence: Synthetic oligonucleotide"
gaaacccuccgacgccaccc

SEQ ID NO: 4059 - RNA, 20 nt, Artificial Sequence
  source: /note="Description of Artificial Sequence: Synthetic oligonucleotide"
cgugaaacccuccgacgcca

SEQ ID NO: 4060 - RNA, 20 nt, Artificial Sequence
  source: /note="Description of Artificial Sequence: Synthetic oligonucleotide"
ucgugaaacccuccgacgcc

SEQ ID NO: 4061 - RNA, 20 nt, Artificial Sequence
  source: /note="Description of Artificial Sequence: Synthetic oligonucleotide"
aggucgugaaacccuccgac

SEQ ID NO: 4062 - RNA, 20 nt, Artificial Sequence
  source: /note="Description of Artificial Sequence: Synthetic oligonucleotide"
acauuaaggucgugaaaccc

SEQ ID NO: 4063 - RNA, 20 nt, Artificial Sequence
  source: /note="Description of Artificial Sequence: Synthetic oligonucleotide"
cggacauuaaggucgugaaa

SEQ ID NO: 4064 - RNA, 20 nt, Artificial Sequence
  source: /note="Description of Artificial Sequence: Synthetic oligonucleotide"
gcggacauuaaggucgugaa

SEQ ID NO: 4065 - RNA, 20 nt, Artificial Sequence
  source: /note="Description of Artificial Sequence: Synthetic oligonucleotide"
gaguuaaaagaaagauaaaa

SEQ ID NO: 4066 - RNA, 20 nt, Artificial Sequence
  source: /note="Description of Artificial Sequence: Synthetic oligonucleotide"
ugaguuaaaagaaagauaaa

SEQ ID NO: 4067 - RNA, 20 nt, Artificial Sequence
  source: /note="Description of Artificial Sequence: Synthetic oligonucleotide"
cacauggagggauauauuug

SEQ ID NO: 4068 - RNA, 20 nt, Artificial Sequence
  source: /note="Description of Artificial Sequence: Synthetic oligonucleotide"
ggaaggcaacuucacaugga

SEQ ID NO: 4069 - RNA, 20 nt, Artificial Sequence
  source: /note="Description of Artificial Sequence: Synthetic oligonucleotide"
gggaaggcaacuucacaugg

SEQ ID NO: 4070 - RNA, 20 nt, Artificial Sequence
  source: /note="Description of Artificial Sequence: Synthetic oligonucleotide"
uuagggaaggcaacuucaca

SEQ ID NO: 4071 - RNA, 20 nt, Artificial Sequence
  source: /note="Description of Artificial Sequence: Synthetic oligonucleotide"
ggacaguacauaauuaggga

SEQ ID NO: 4072 - RNA, 20 nt, Artificial Sequence
  source: /note="Description of Artificial Sequence: Synthetic oligonucleotide"
acuaggacaguacauaauua

SEQ ID NO: 4073 - RNA, 20 nt, Artificial Sequence
  source: /note="Description of Artificial Sequence: Synthetic oligonucleotide"
aacuaggacaguacauaauu

SEQ ID NO: 4074 - RNA, 20 nt, Artificial Sequence
  source: /note="Description of Artificial Sequence: Synthetic oligonucleotide"
caaggaaugaagauuaaacu

SEQ ID NO: 4075 - RNA, 20 nt, Artificial Sequence
  source: /note="Description of Artificial Sequence: Synthetic oligonucleotide"
ugguuuuauagaggcaaaca

SEQ ID NO: 4076 - RNA, 20 nt, Artificial Sequence
  source: /note="Description of Artificial Sequence: Synthetic oligonucleotide"
uuuuaaacuugguuuuauag

SEQ ID NO: 4077 - RNA, 20 nt, Artificial Sequence
  source: /note="Description of Artificial Sequence: Synthetic oligonucleotide"
ucagagacuauuuuuaaacu

SEQ ID NO: 4078 - RNA, 20 nt, Artificial Sequence
  source: /note="Description of Artificial Sequence: Synthetic oligonucleotide"
uaguagaaacuuuguuacaa

SEQ ID NO: 4079 - RNA, 20 nt, Artificial Sequence
  source: /note="Description of Artificial Sequence: Synthetic oligonucleotide"
auauagaucguagcugagaa

SEQ ID NO: 4080 - RNA, 20 nt, Artificial Sequence
  source: /note="Description of Artificial Sequence: Synthetic oligonucleotide"
uauaacaaaagacauggcca

SEQ ID NO: 4081 - RNA, 20 nt, Artificial Sequence
  source: /note="Description of Artificial Sequence: Synthetic oligonucleotide"
uguguguauaacaaaagaca

SEQ ID NO: 4082 - RNA, 20 nt, Artificial Sequence
  source: /note="Description of Artificial Sequence: Synthetic oligonucleotide"
aaaagcauauugugacuaaa

SEQ ID NO: 4083 - RNA, 20 nt, Artificial Sequence
  source: /note="Description of Artificial Sequence: Synthetic oligonucleotide"
aucaagaaauucccaggaaa

SEQ ID NO: 4084 - RNA, 20 nt, Artificial Sequence
  source: /note="Description of Artificial Sequence: Synthetic oligonucleotide"
aaaaucaucaagaaauuccc

SEQ ID NO: 4085 - RNA, 20 nt, Artificial Sequence
  source: /note="Description of Artificial Sequence: Synthetic oligonucleotide"
gaaaagcacuauuucugcag

SEQ ID NO: 4086 - RNA, 20 nt, Artificial Sequence
  source: /note="Description of Artificial Sequence: Synthetic oligonucleotide"
uaucaccagcucuucuaaga

SEQ ID NO: 4087 - RNA, 20 nt, Artificial Sequence
  source: /note="Description of Artificial Sequence: Synthetic oligonucleotide"
aaccaagauaaaagaagagu

SEQ ID NO: 4088 - RNA, 20 nt, Artificial Sequence
  source: /note="Description of Artificial Sequence: Synthetic oligonucleotide"
uugauuguccuguguuaaaa

SEQ ID NO: 4089 - RNA, 20 nt, Artificial Sequence
  source: /note="Description of Artificial Sequence: Synthetic oligonucleotide"
guugauuguccuguguuaaa

SEQ ID NO: 4090 - RNA, 20 nt, Artificial Sequence
  source: /note="Description of Artificial Sequence: Synthetic oligonucleotide"
uaucugaaucuaaagaaaga

SEQ ID NO: 4091 - RNA, 20 nt, Artificial Sequence
  source: /note="Description of Artificial Sequence: Synthetic oligonucleotide"
ggggcagggguuacagaugu

SEQ ID NO: 4092 - RNA, 20 nt, Artificial Sequence
  source: /note="Description of Artificial Sequence: Synthetic oligonucleotide"
guaaaaaauauuuggggcag

SEQ ID NO: 4093 - RNA, 20 nt, Artificial Sequence
  source: /note="Description of Artificial Sequence: Synthetic oligonucleotide"
aguaaaaaauauuuggggca

SEQ ID NO: 4094 - RNA, 20 nt, Artificial Sequence
  source: /note="Description of Artificial Sequence: Synthetic oligonucleotide"
aaguaaaaaauauuuggggc

SEQ ID NO: 4095 - RNA, 20 nt, Artificial Sequence
  source: /note="Description of Artificial Sequence: Synthetic oligonucleotide"
gcauaaguaaaaaauauuug

SEQ ID NO: 4096 - RNA, 20 nt, Artificial Sequence
  source: /note="Description of Artificial Sequence: Synthetic oligonucleotide"
agcauaaguaaaaaauauuu

SEQ ID NO: 4097 - RNA, 20 nt, Artificial Sequence
  source: /note="Description of Artificial Sequence: Synthetic oligonucleotide"
uagcauaaguaaaaaauauu

SEQ ID NO: 4098 - RNA, 20 nt, Artificial Sequence
  source: /note="Description of Artificial Sequence: Synthetic oligonucleotide"
caucuucgauuuccuagaag

SEQ ID NO: 4099 - RNA, 20 nt, Artificial Sequence
  source: /note="Description of Artificial Sequence: Synthetic oligonucleotide"
acaucuucgauuuccuagaa

SEQ ID NO: 4100 - RNA, 20 nt, Artificial Sequence
  source: /note="Description of Artificial Sequence: Synthetic oligonucleotide"
cacaucuucgauuuccuaga

SEQ ID NO: 4101 - RNA, 20 nt, Artificial Sequence
  source: /note="Description of Artificial Sequence: Synthetic oligonucleotide"
aacucauuaucacauuaaac

SEQ ID NO: 4102 - RNA, 20 nt, Artificial Sequence
  source: /note="Description of Artificial Sequence: Synthetic oligonucleotide"
caaucauacuuaagguugga

SEQ ID NO: 4103 - RNA, 20 nt, Artificial Sequence
  source: /note="Description of Artificial Sequence: Synthetic oligonucleotide"
ucaaucauacuuaagguugg

SEQ ID NO: 4104 - RNA, 20 nt, Artificial Sequence
  source: /note="Description of Artificial Sequence: Synthetic oligonucleotide"
aauucaaucauacuuaaggu

SEQ ID NO: 4105 - RNA, 20 nt, Artificial Sequence
  source: /note="Description of Artificial Sequence: Synthetic oligonucleotide"
uauaaauucaaucauacuua

SEQ ID NO: 4106 - RNA, 20 nt, Artificial Sequence
  source: /note="Description of Artificial Sequence: Synthetic oligonucleotide"
uauauaaaaaugaaaguaug

SEQ ID NO: 4107 - RNA, 20 nt, Artificial Sequence
  source: /note="Description of Artificial Sequence: Synthetic oligonucleotide"
uagccagagaacaaaugaua

SEQ ID NO: 4108 - RNA, 20 nt, Artificial Sequence
  source: /note="Description of Artificial Sequence: Synthetic oligonucleotide"
guagccagagaacaaaugau

SEQ ID NO: 4109 - RNA, 20 nt, Artificial Sequence
  source: /note="Description of Artificial Sequence: Synthetic oligonucleotide"
aaaaauguaacuauuaacuu

SEQ ID NO: 4110 - RNA, 20 nt, Artificial Sequence
  source: /note="Description of Artificial Sequence: Synthetic oligonucleotide"
ugcaaauuaccauuugucac

SEQ ID NO: 4111 - RNA, 20 nt, Artificial Sequence
  source: /note="Description of Artificial Sequence: Synthetic oligonucleotide"
uuugcaugauucuuaaauaa

SEQ ID NO: 4112 - RNA, 20 nt, Artificial Sequence
  source: /note="Description of Artificial Sequence: Synthetic oligonucleotide"
guuugcaugauucuuaaaua

SEQ ID NO: 4113 - RNA, 20 nt, Artificial Sequence
  source: /note="Description of Artificial Sequence: Synthetic oligonucleotide"
caccugcugccuaucagcuc

SEQ ID NO: 4114 - RNA, 20 nt, Artificial Sequence
  source: /note="Description of Artificial Sequence: Synthetic oligonucleotide"
agcagaauuacuagcuaccu

SEQ ID NO: 4115 - RNA, 20 nt, Artificial Sequence
  source: /note="Description of Artificial Sequence: Synthetic oligonucleotide"
gaaggagcuauaguggcuua

SEQ ID NO: 4116 - RNA, 20 nt, Artificial Sequence
  source: /note="Description of Artificial Sequence: Synthetic oligonucleotide"
ggaaggagcuauaguggcuu

SEQ ID NO: 4117 - RNA, 20 nt, Artificial Sequence
  source: /note="Description of Artificial Sequence: Synthetic oligonucleotide"
uaauggggaaggagcuauag

SEQ ID NO: 4118 - RNA, 20 nt, Artificial Sequence
  source: /note="Description of Artificial Sequence: Synthetic oligonucleotide"
gacccagggaguaaugggga

SEQ ID NO: 4119 - RNA, 20 nt, Artificial Sequence
  source: /note="Description of Artificial Sequence: Synthetic oligonucleotide"
gguagacccagggaguaaug

SEQ ID NO: 4120 - RNA, 20 nt, Artificial Sequence
  source: /note="Description of Artificial Sequence: Synthetic oligonucleotide"
ggguagacccagggaguaau

SEQ ID NO: 4121 - RNA, 20 nt, Artificial Sequence
  source: /note="Description of Artificial Sequence: Synthetic oligonucleotide"
uggguagacccagggaguaa

SEQ ID NO: 4122 - RNA, 20 nt, Artificial Sequence
  source: /note="Description of Artificial Sequence: Synthetic oligonucleotide"
caggaugguggguagaccca

SEQ ID NO: 4123 - RNA, 20 nt, Artificial Sequence
  source: /note="Description of Artificial Sequence: Synthetic oligonucleotide"
gcaggaugguggguagaccc

SEQ ID NO: 4124 - RNA, 20 nt, Artificial Sequence
  source: /note="Description of Artificial Sequence: Synthetic oligonucleotide"
uauucuagcugcaggauggu

SEQ ID NO: 4125 - RNA, 20 nt, Artificial Sequence
  source: /note="Description of Artificial Sequence: Synthetic oligonucleotide"
uuauucuagcugcaggaugg

SEQ ID NO: 4126 - RNA, 20 nt, Artificial Sequence
  source: /note="Description of Artificial Sequence: Synthetic oligonucleotide"
uuauuauucuagcugcagga

SEQ ID NO: 4127 - RNA, 20 nt, Artificial Sequence
  source: /note="Description of Artificial Sequence: Synthetic oligonucleotide"
ccauuuauuauucuagcugc

SEQ ID NO: 4128 - RNA, 20 nt, Artificial Sequence
  source: /note="Description of Artificial Sequence: Synthetic oligonucleotide"
gugcuggaggaggauccuag

SEQ ID NO: 4129 - RNA, 20 nt, Artificial Sequence
  source: /note="Description of Artificial Sequence: Synthetic oligonucleotide"
uugagacauagugcuggagg

SEQ ID NO: 4130 - RNA, 20 nt, Artificial Sequence
  source: /note="Description of Artificial Sequence: Synthetic oligonucleotide"
ccguugagacauagugcugg

SEQ ID NO: 4131 - RNA, 20 nt, Artificial Sequence
  source: /note="Description of Artificial Sequence: Synthetic oligonucleotide"
gguccguugagacauagugc

SEQ ID NO: 4132 - RNA, 20 nt, Artificial Sequence
  source: /note="Description of Artificial Sequence: Synthetic oligonucleotide"
uaaauugucgaguauacagg

SEQ ID NO: 4133 - RNA, 20 nt, Artificial Sequence
  source: /note="Description of Artificial Sequence: Synthetic oligonucleotide"
agacgucucccuuaccacag

SEQ ID NO: 4134 - RNA, 20 nt, Artificial Sequence
  source: /note="Description of Artificial Sequence: Synthetic oligonucleotide"
aagugucuacuuuuaucaua

SEQ ID NO: 4135 - RNA, 20 nt, Artificial Sequence
  source: /note="Description of Artificial Sequence: Synthetic oligonucleotide"
acucugcaguuauguuuacc

SEQ ID NO: 4136 - RNA, 20 nt, Artificial Sequence
  source: /note="Description of Artificial Sequence: Synthetic oligonucleotide"
uuaaagauuucaaaacguau

SEQ ID NO: 4137 - RNA, 20 nt, Artificial Sequence
  source: /note="Description of Artificial Sequence: Synthetic oligonucleotide"
cuaaucuauuucuaauagaa

SEQ ID NO: 4138 - RNA, 20 nt, Artificial Sequence
  source: /note="Description of Artificial Sequence: Synthetic oligonucleotide"
ucauucuaaaaauugaaaca

SEQ ID NO: 4139 - RNA, 20 nt, Artificial Sequence
  source: /note="Description of Artificial Sequence: Synthetic oligonucleotide"
aauucuaaugcuuaauggga

SEQ ID NO: 4140 - RNA, 20 nt, Artificial Sequence
  source: /note="Description of Artificial Sequence: Synthetic oligonucleotide"
uaaaaauucuaaugcuuaau

SEQ ID NO: 4141 - RNA, 20 nt, Artificial Sequence
  source: /note="Description of Artificial Sequence: Synthetic oligonucleotide"
auaaaaauucuaaugcuuaa

SEQ ID NO: 4142 - RNA, 20 nt, Artificial Sequence
  source: /note="Description of Artificial Sequence: Synthetic oligonucleotide"
aucaugaauauaaacaucaa

SEQ ID NO: 4143 - RNA, 20 nt, Artificial Sequence
  source: /note="Description of Artificial Sequence: Synthetic oligonucleotide"
cauaugaccuauaugagcua

SEQ ID NO: 4144 - RNA, 20 nt, Artificial Sequence
  source: /note="Description of Artificial Sequence: Synthetic oligonucleotide"
agcccaaauaucuucaucua

SEQ ID NO: 4145 - RNA, 20 nt, Artificial Sequence
  source: /note="Description of Artificial Sequence: Synthetic oligonucleotide"
uacaauuucuucaaaaugga

SEQ ID NO: 4146 - RNA, 20 nt, Artificial Sequence
  source: /note="Description of Artificial Sequence: Synthetic oligonucleotide"
accuuacaauuucuucaaaa

SEQ ID NO: 4147 - RNA, 20 nt, Artificial Sequence
  source: /note="Description of Artificial Sequence: Synthetic oligonucleotide"
auuuuggggggauaaguauu

SEQ ID NO: 4148 - RNA, 20 nt, Artificial Sequence
  source: /note="Description of Artificial Sequence: Synthetic oligonucleotide"
uuuauuuuucguauuuuggg

SEQ ID NO: 4149 - RNA, 20 nt, Artificial Sequence
  source: /note="Description of Artificial Sequence: Synthetic oligonucleotide"
uuuuauuuuucguauuuugg

SEQ ID NO: 4150 - RNA, 20 nt, Artificial Sequence
  source: /note="Description of Artificial Sequence: Synthetic oligonucleotide"
auuuuauuuuucguauuuug

SEQ ID NO: 4151 - RNA, 20 nt, Artificial Sequence
  source: /note="Description of Artificial Sequence: Synthetic oligonucleotide"
gauuuuauuuuucguauuuu

SEQ ID NO: 4152 - RNA, 20 nt, Artificial Sequence
  source: /note="Description of Artificial Sequence: Synthetic oligonucleotide"
ugauuuuauuuuucguauuu

SEQ ID NO: 4153 - RNA, 20 nt, Artificial Sequence
  source: /note="Description of Artificial Sequence: Synthetic oligonucleotide"
cagauugaggaucaauaaac

SEQ ID NO: 4154 - RNA, 20 nt, Artificial Sequence
  source: /note="Description of Artificial Sequence: Synthetic oligonucleotide"
uuuaaaacagccacagauug

SEQ ID NO: 4155 - RNA, 20 nt, Artificial Sequence
  source: /note="Description of Artificial Sequence: Synthetic oligonucleotide"
gaguaaugagucuacuacca

SEQ ID NO: 4156 - RNA, 20 nt, Artificial Sequence
  source: /note="Description of Artificial Sequence: Synthetic oligonucleotide"
aaaugauguaaugguuucug

SEQ ID NO: 4157 - RNA, 20 nt, Artificial Sequence
  source: /note="Description of Artificial Sequence: Synthetic oligonucleotide"
aaaaugauguaaugguuucu

SEQ ID NO: 4158 - RNA, 20 nt, Artificial Sequence
  source: /note="Description of Artificial Sequence: Synthetic oligonucleotide"
caaaaugauguaaugguuuc

SEQ ID NO: 4159 - RNA, 20 nt, Artificial Sequence
  source: /note="Description of Artificial Sequence: Synthetic oligonucleotide"
aauauuacaaaaugauguaa

SEQ ID NO: 4160 - RNA, 20 nt, Artificial Sequence
  source: /note="Description of Artificial Sequence: Synthetic oligonucleotide"
ugugauauuaaguuuauaaa

SEQ ID NO: 4161 - RNA, 20 nt, Artificial Sequence
  source: /note="Description of Artificial Sequence: Synthetic oligonucleotide"
cacaagcaaaauuauauuaa

SEQ ID NO: 4162 - RNA, 20 nt, Artificial Sequence
  source: /note="Description of Artificial Sequence: Synthetic oligonucleotide"
aaagaguuauugaaaugaau

SEQ ID NO: 4163 - RNA, 20 nt, Artificial Sequence
  source: /note="Description of Artificial Sequence: Synthetic oligonucleotide"
uugagauaaaaaauauauau

SEQ ID NO: 4164 - RNA, 20 nt, Artificial Sequence
  source: /note="Description of Artificial Sequence: Synthetic oligonucleotide"
agacaagguugggucgaaau

SEQ ID NO: 4165 - RNA, 20 nt, Artificial Sequence
  source: /note="Description of Artificial Sequence: Synthetic oligonucleotide"
ggcuagugaaucccuuugac

SEQ ID NO: 4166 - RNA, 20 nt, Artificial Sequence
  source: /note="Description of Artificial Sequence: Synthetic oligonucleotide"
cuagaacucggcuagugaau

SEQ ID NO: 4167 - RNA, 20 nt, Artificial Sequence
  source: /note="Description of Artificial Sequence: Synthetic oligonucleotide"
acuagaacucggcuagugaa

SEQ ID NO: 4168 - RNA, 20 nt, Artificial Sequence
  source: /note="Description of Artificial Sequence: Synthetic oligonucleotide"
uguuucauauuuaauuagaa

SEQ ID NO: 4169 - RNA, 20 nt, Artificial Sequence
  source: /note="Description of Artificial Sequence: Synthetic oligonucleotide"
uuguuucauauuuaauuaga

SEQ ID NO: 4170 - RNA, 20 nt, Artificial Sequence
  source: /note="Description of Artificial Sequence: Synthetic oligonucleotide"
cacaggcaaacuaagggggu

SEQ ID NO: 4171 - RNA, 20 nt, Artificial Sequence
  source: /note="Description of Artificial Sequence: Synthetic oligonucleotide"
aacccacaggcaaacuaagg

SEQ ID NO: 4172 - RNA, 20 nt, Artificial Sequence
  source: /note="Description of Artificial Sequence: Synthetic oligonucleotide"
aaacccacaggcaaacuaag

SEQ ID NO: 4173 - RNA, 20 nt, Artificial Sequence
  source: /note="Description of Artificial Sequence: Synthetic oligonucleotide"
uaaacccacaggcaaacuaa

SEQ ID NO: 4174 - RNA, 20 nt, Artificial Sequence
  source: /note="Description of Artificial Sequence: Synthetic oligonucleotide"
auaaacccacaggcaaacua

SEQ ID NO: 4175 - RNA, 20 nt, Artificial Sequence
  source: /note="Description of Artificial Sequence: Synthetic oligonucleotide"
uguaacuuccauaaacccac

SEQ ID NO: 4176 - RNA, 20 nt, Artificial Sequence
  source: /note="Description of Artificial Sequence: Synthetic oligonucleotide"
caauaauucuauugggagcu

SEQ ID NO: 4177 - RNA, 20 nt, Artificial Sequence
  source: /note="Description of Artificial Sequence: Synthetic oligonucleotide"
uacagggcaauaauucuauu

SEQ ID NO: 4178 - RNA, 20 nt, Artificial Sequence
  source: /note="Description of Artificial Sequence: Synthetic oligonucleotide"
cuacagggcaauaauucuau

SEQ ID NO: 4179 - RNA, 20 nt, Artificial Sequence
  source: /note="Description of Artificial Sequence: Synthetic oligonucleotide"
uauuugcgcggcugacuaca

SEQ ID NO: 4180 - RNA, 20 nt, Artificial Sequence
  source: /note="Description of Artificial Sequence: Synthetic oligonucleotide"
guauuugcgcggcugacuac

SEQ ID NO: 4181 - RNA, 20 nt, Artificial Sequence
  source: /note="Description of Artificial Sequence: Synthetic oligonucleotide"
uauuugugauuguauuugcg

SEQ ID NO: 4182 - RNA, 20 nt, Artificial Sequence
  source: /note="Description of Artificial Sequence: Synthetic oligonucleotide"
uucuucacacaaggaacuuc

SEQ ID NO: 4183 - RNA, 20 nt, Artificial Sequence
  source: /note="Description of Artificial Sequence: Synthetic oligonucleotide"
auuuucuuuuucuucacaca

SEQ ID NO: 4184 - RNA, 20 nt, Artificial Sequence
  source: /note="Description of Artificial Sequence: Synthetic oligonucleotide"
gggaagaaaggggcaaagaa

SEQ ID NO: 4185 - RNA, 20 nt, Artificial Sequence
  source: /note="Description of Artificial Sequence: Synthetic oligonucleotide"
ggagugaaaggggaagaaag

SEQ ID NO: 4186 - RNA, 20 nt, Artificial Sequence
  source: /note="Description of Artificial Sequence: Synthetic oligonucleotide"
aggagugaaaggggaagaaa

SEQ ID NO: 4187 - RNA, 20 nt, Artificial Sequence
  source: /note="Description of Artificial Sequence: Synthetic oligonucleotide"
aaggagugaaaggggaagaa

SEQ ID NO: 4188 - RNA, 20 nt, Artificial Sequence
  source: /note="Description of Artificial Sequence: Synthetic oligonucleotide"
ggagaagaaaggagugaaag

SEQ ID NO: 4189 - RNA, 20 nt, Artificial Sequence
  source: /note="Description of Artificial Sequence: Synthetic oligonucleotide"
aggagaagaaaggagugaaa

SEQ ID NO: 4190 - RNA, 20 nt, Artificial Sequence
  source: /note="Description of Artificial Sequence: Synthetic oligonucleotide"
uaggagaagaaaggagugaa

SEQ ID NO: 4191 - RNA, 20 nt, Artificial Sequence
  source: /note="Description of Artificial Sequence: Synthetic oligonucleotide"
caaguaguauaggagaagaa

SEQ ID NO: 4192 - RNA, 20 nt, Artificial Sequence
  source: /note="Description of Artificial Sequence: Synthetic oligonucleotide"
cuagaaauuucaaguaguau

SEQ ID NO: 4193 - RNA, 20 nt, Artificial Sequence
  source: /note="Description of Artificial Sequence: Synthetic oligonucleotide"
acuuaccauuccuaacaucc

SEQ ID NO: 4194 - RNA, 20 nt, Artificial Sequence
  source: /note="Description of Artificial Sequence: Synthetic oligonucleotide"
ugaaaagccucuuaagggua

SEQ ID NO: 4195 - RNA, 20 nt, Artificial Sequence
  source: /note="Description of Artificial Sequence: Synthetic oligonucleotide"
aacuuugaaaagccucuuaa

SEQ ID NO: 4196 - RNA, 20 nt, Artificial Sequence
  source: /note="Description of Artificial Sequence: Synthetic oligonucleotide"
uaacuuugaaaagccucuua

SEQ ID NO: 4197 - RNA, 20 nt, Artificial Sequence
  source: /note="Description of Artificial Sequence: Synthetic oligonucleotide"
gucagagacugggccaauga

SEQ ID NO: 4198 - RNA, 20 nt, Artificial Sequence
  source: /note="Description of Artificial Sequence: Synthetic oligonucleotide"
gaccucacuggucagagacu

SEQ ID NO: 4199 - RNA, 20 nt, Artificial Sequence
  source: /note="Description of Artificial Sequence: Synthetic oligonucleotide"
ugaccucacuggucagagac

SEQ ID NO: 4200 - RNA, 20 nt, Artificial Sequence
  source: /note="Description of Artificial Sequence: Synthetic oligonucleotide"
uggcuaauacuugaccucac

SEQ ID NO: 4201 - RNA, 20 nt, Artificial Sequence
  source: /note="Description of Artificial Sequence: Synthetic oligonucleotide"
uuuucacgacauucugacac

SEQ ID NO: 4202 - RNA, 20 nt, Artificial Sequence
  source: /note="Description of Artificial Sequence: Synthetic oligonucleotide"
gauauuuuuaaaaaccaaga

SEQ ID NO: 4203 - RNA, 20 nt, Artificial Sequence
  source: /note="Description of Artificial Sequence: Synthetic oligonucleotide"
aaaauaaaaagaaguuauga

SEQ ID NO: 4204 - RNA, 20 nt, Artificial Sequence
  source: /note="Description of Artificial Sequence: Synthetic oligonucleotide"
gaaaauaaaaagaaguuaug

SEQ ID NO: 4205 - RNA, 20 nt, Artificial Sequence
  source: /note="Description of Artificial Sequence: Synthetic oligonucleotide"
gguacagguauaaauucaca

SEQ ID NO: 4206 - RNA, 20 nt, Artificial Sequence
  source: /note="Description of Artificial Sequence: Synthetic oligonucleotide"
cacuggaacaugagagguac

SEQ ID NO: 4207 - RNA, 20 nt, Artificial Sequence
  source: /note="Description of Artificial Sequence: Synthetic oligonucleotide"
accaaacacuggaacaugag

SEQ ID NO: 4208 - RNA, 20 nt, Artificial Sequence
  source: /note="Description of Artificial Sequence: Synthetic oligonucleotide"
auuauuuaagaaccaaacac

SEQ ID NO: 4209 - RNA, 20 nt, Artificial Sequence
  source: /note="Description of Artificial Sequence: Synthetic oligonucleotide"
auaacuacgauagccaaaca

SEQ ID NO: 4210 - RNA, 20 nt, Artificial Sequence
  source: /note="Description of Artificial Sequence: Synthetic oligonucleotide"
aaacaagcauacaccauaug

SEQ ID NO: 4211 - RNA, 20 nt, Artificial Sequence
  source: /note="Description of Artificial Sequence: Synthetic oligonucleotide"
uccuccuaacauagacaaag

SEQ ID NO: 4212 - RNA, 20 nt, Artificial Sequence
  source: /note="Description of Artificial Sequence: Synthetic oligonucleotide"
ugucagcuacuuggcaguga

SEQ ID NO: 4213 - RNA, 20 nt, Artificial Sequence
  source: /note="Description of Artificial Sequence: Synthetic oligonucleotide"
auuucagaaugucagcuacu

SEQ ID NO: 4214 - RNA, 20 nt, Artificial Sequence
  source: /note="Description of Artificial Sequence: Synthetic oligonucleotide"
ccaacuguacagugccuaaa

SEQ ID NO: 4215 - RNA, 20 nt, Artificial Sequence
  source: /note="Description of Artificial Sequence: Synthetic oligonucleotide"
uccaacuguacagugccuaa

SEQ ID NO: 4216 - RNA, 20 nt, Artificial Sequence
  source: /note="Description of Artificial Sequence: Synthetic oligonucleotide"
agcacguuacucaccucagc

SEQ ID NO: 4217 - RNA, 20 nt, Artificial Sequence
  source: /note="Description of Artificial Sequence: Synthetic oligonucleotide"
agguuuaaaugggaugagac

SEQ ID NO: 4218 - RNA, 20 nt, Artificial Sequence
  source: /note="Description of Artificial Sequence: Synthetic oligonucleotide"
guucuccuccagguuuaaau

SEQ ID NO: 4219 - RNA, 20 nt, Artificial Sequence
  source: /note="Description of Artificial Sequence: Synthetic oligonucleotide"
gguucuccuccagguuuaaa

SEQ ID NO: 4220 - RNA, 20 nt, Artificial Sequence
  source: /note="Description of Artificial Sequence: Synthetic oligonucleotide"
gcuugaugugguucuccucc

SEQ ID NO: 4221 - RNA, 20 nt, Artificial Sequence
  source: /note="Description of Artificial Sequence: Synthetic oligonucleotide"
ggcugcuucugugcuugaug

SEQ ID NO: 4222 - RNA, 20 nt, Artificial Sequence
  source: /note="Description of Artificial Sequence: Synthetic oligonucleotide"
uuccuguugaaaugcugcuu

SEQ ID NO: 4223 - RNA, 20 nt, Artificial Sequence
  source: /note="Description of Artificial Sequence: Synthetic oligonucleotide"
gugauauuaguacaccuuca

SEQ ID NO: 4224 - RNA, 20 nt, Artificial Sequence
  source: /note="Description of Artificial Sequence: Synthetic oligonucleotide"
aacacuuccguuacaaaaaa

SEQ ID NO: 4225 - RNA, 20 nt, Artificial Sequence
  source: /note="Description of Artificial Sequence: Synthetic oligonucleotide"
aaacacuuccguuacaaaaa

SEQ ID NO: 4226 - RNA, 20 nt, Artificial Sequence
  source: /note="Description of Artificial Sequence: Synthetic oligonucleotide"
auauaagaauccuccauuug

SEQ ID NO: 4227 - RNA, 20 nt, Artificial Sequence
  source: /note="Description of Artificial Sequence: Synthetic oligonucleotide"
uauauaagaauccuccauuu

SEQ ID NO: 4228 - RNA, 20 nt, Artificial Sequence
  source: /note="Description of Artificial Sequence: Synthetic oligonucleotide"
uuauauaagaauccuccauu

SEQ ID NO: 4229 - RNA, 20 nt, Artificial Sequence
  source: /note="Description of Artificial Sequence: Synthetic oligonucleotide"
ugaauauaucauuacaagcu

SEQ ID NO: 4230 - RNA, 20 nt, Artificial Sequence
  source: /note="Description of Artificial Sequence: Synthetic oligonucleotide"
aaguuuucguucaaaaauga

SEQ ID NO: 4231 - RNA, 20 nt, Artificial Sequence
  source: /note="Description of Artificial Sequence: Synthetic oligonucleotide"
aaacauuucauuuuggggaa

SEQ ID NO: 4232 - RNA, 20 nt, Artificial Sequence
  source: /note="Description of Artificial Sequence: Synthetic oligonucleotide"
cagugaaacauuucauuuug

SEQ ID NO: 4233 - RNA, 20 nt, Artificial Sequence
  source: /note="Description of Artificial Sequence: Synthetic oligonucleotide"
ucagugaaacauuucauuuu

SEQ ID NO: 4234 - RNA, 20 nt, Artificial Sequence
  source: /note="Description of Artificial Sequence: Synthetic oligonucleotide"
uucagugaaacauuucauuu

SEQ ID NO: 4235 - RNA, 20 nt, Artificial Sequence
  source: /note="Description of Artificial Sequence: Synthetic oligonucleotide"
cauggccuccacaagcuugu

SEQ ID NO: 4236 - RNA, 20 nt, Artificial Sequence
  source: /note="Description of Artificial Sequence: Synthetic oligonucleotide"
cucuuauucaacaugcuuca

SEQ ID NO: 4237 - RNA, 20 nt, Artificial Sequence
  source: /note="Description of Artificial Sequence: Synthetic oligonucleotide"
cacacccuuuguggguggca

SEQ ID NO: 4238 - RNA, 20 nt, Artificial Sequence
  source: /note="Description of Artificial Sequence: Synthetic oligonucleotide"
gcacacccuuuguggguggc

SEQ ID NO: 4239 - RNA, 20 nt, Artificial Sequence
  source: /note="Description of Artificial Sequence: Synthetic oligonucleotide"
cuuagcacacccuuuguggg

SEQ ID NO: 4240 - RNA, 20 nt, Artificial Sequence
  source: /note="Description of Artificial Sequence: Synthetic oligonucleotide"
uaccuuagcacacccuuugu

SEQ ID NO: 4241 - RNA, 20 nt, Artificial Sequence
  source: /note="Description of Artificial Sequence: Synthetic oligonucleotide"
uuaccuuagcacacccuuug

SEQ ID NO: 4242 - RNA, 20 nt, Artificial Sequence
  source: /note="Description of Artificial Sequence: Synthetic oligonucleotide"
aauagcuaaaauuuauugaa

SEQ ID NO: 4243 - RNA, 20 nt, Artificial Sequence
  source: /note="Description of Artificial Sequence: Synthetic oligonucleotide"
ccagucacuguguuuuagaa

SEQ ID NO: 4244 - RNA, 20 nt, Artificial Sequence
  source: /note="Description of Artificial Sequence: Synthetic oligonucleotide"
guccguacucggugacgcgg

SEQ ID NO: 4245 - RNA, 20 nt, Artificial Sequence
  source: /note="Description of Artificial Sequence: Synthetic oligonucleotide"
aggcuuucacgacccuaaug

SEQ ID NO: 4246 - RNA, 20 nt, Artificial Sequence
  source: /note="Description of Artificial Sequence: Synthetic oligonucleotide"
ggagccggaggcuuucacga

SEQ ID NO: 4247 - RNA, 20 nt, Artificial Sequence
  source: /note="Description of Artificial Sequence: Synthetic oligonucleotide"
uggagccggaggcuuucacg

SEQ ID NO: 4248 - RNA, 20 nt, Artificial Sequence
  source: /note="Description of Artificial Sequence: Synthetic oligonucleotide"
uggagcacuaggcguaugga

SEQ ID NO: 4249 - RNA, 20 nt, Artificial Sequence
  source: /note="Description of Artificial Sequence: Synthetic oligonucleotide"
aaaguggcacaaucgguccu

SEQ ID NO: 4250 - RNA, 20 nt, Artificial Sequence
  source: /note="Description of Artificial Sequence: Synthetic oligonucleotide"
cccuaaaguggcacaaucgg

SEQ ID NO: 4251 - RNA, 20 nt, Artificial Sequence
  source: /note="Description of Artificial Sequence: Synthetic oligonucleotide"
aaacauaaaaaucaucucug

SEQ ID NO: 4252 - RNA, 20 nt, Artificial Sequence
  source: /note="Description of Artificial Sequence: Synthetic oligonucleotide"
aaaacauaaaaaucaucucu

SEQ ID NO: 4253 - RNA, 20 nt, Artificial Sequence
  source: /note="Description of Artificial Sequence: Synthetic oligonucleotide"
guccgcguacgggggugcgg

SEQ ID NO: 4254 - RNA, 20 nt, Artificial Sequence
  source: /note="Description of Artificial Sequence: Synthetic oligonucleotide"
aggacucaucgacccuaaug

SEQ ID NO: 4255 - RNA, 20 nt, Artificial Sequence
  source: /note="Description of Artificial Sequence: Synthetic oligonucleotide"
ggagucggaggacucaucga

SEQ ID NO: 4256 - RNA, 20 nt, Artificial Sequence
  source: /note="Description of Artificial Sequence: Synthetic oligonucleotide"
cggagucggaggacucaucg

SEQ ID NO: 4257 - RNA, 20 nt, Artificial Sequence
  source: /note="Description of Artificial Sequence: Synthetic oligonucleotide"
gugacguucgaggcggaggg

SEQ ID NO: 4258 - RNA, 20 nt, Artificial Sequence
  source: /note="Description of Artificial Sequence: Synthetic oligonucleotide"
ccucacgucaccacgcuaga

SEQ ID NO: 4259 - RNA, 20 nt, Artificial Sequence
  source: /note="Description of Artificial Sequence: Synthetic oligonucleotide"
aucggguccgaccucacguc

SEQ ID NO: 4260 - RNA, 20 nt, Artificial Sequence
  source: /note="Description of Artificial Sequence: Synthetic oligonucleotide"
agaacgagacaucggguccg

SEQ ID NO: 4261 - RNA, 20 nt, Artificial Sequence
  source: /note="Description of Artificial Sequence: Synthetic oligonucleotide"
ucucagaacgagacaucggg

SEQ ID NO: 4262 - RNA, 20 nt, Artificial Sequence
  source: /note="Description of Artificial Sequence: Synthetic oligonucleotide"
aagguuucacgacccuaaug

SEQ ID NO: 4263 - RNA, 20 nt, Artificial Sequence
  source: /note="Description of Artificial Sequence: Synthetic oligonucleotide"
gcaguuggaagguuucacga

SEQ ID NO: 4264 - RNA, 20 nt, Artificial Sequence
  source: /note="Description of Artificial Sequence: Synthetic oligonucleotide"
cgcaguuggaagguuucacg

SEQ ID NO: 4265 - RNA, 20 nt, Artificial Sequence
  source: /note="Description of Artificial Sequence: Synthetic oligonucleotide"
agagugauacaacggguccg

SEQ ID NO: 4266 - RNA, 20 nt, Artificial Sequence
  source: /note="Description of Artificial Sequence: Synthetic oligonucleotide"
cuccagagugauacaacggg

SEQ ID NO: 4267 - RNA, 20 nt, Artificial Sequence
  source: /note="Description of Artificial Sequence: Synthetic oligonucleotide"
caaauaaaaaacaucucuac

SEQ ID NO: 4268 - RNA, 20 nt, Artificial Sequence
  source: /note="Description of Artificial Sequence: Synthetic oligonucleotide"
aggguucaccgauccugaug

SEQ ID NO: 4269 - RNA, 20 nt, Artificial Sequence
  source: /note="Description of Artificial Sequence: Synthetic oligonucleotide"
agagucagaggguucaccga

SEQ ID NO: 4270 - RNA, 20 nt, Artificial Sequence
  source: /note="Description of Artificial Sequence: Synthetic oligonucleotide"
aagguagagucagaggguuc

SEQ ID NO: 4271 - RNA, 20 nt, Artificial Sequence
  source: /note="Description of Artificial Sequence: Synthetic oligonucleotide"
guucacgucaccgugcuaga

SEQ ID NO: 4272 - RNA, 20 nt, Artificial Sequence
  source: /note="Description of Artificial Sequence: Synthetic oligonucleotide"
aguggguccgaguucacguc

SEQ ID NO: 4273 - RNA, 20 nt, Artificial Sequence
  source: /note="Description of Artificial Sequence: Synthetic oligonucleotide"
ucccagaacgagacaguggg

SEQ ID NO: 4274 - RNA, 20 nt, Artificial Sequence
  source: /note="Description of Artificial Sequence: Synthetic oligonucleotide"
aacaaacaaaagaacucugu

SEQ ID NO: 4275 - RNA, 20 nt, Artificial Sequence
  source: /note="Description of Artificial Sequence: Synthetic oligonucleotide"
aaacaaacaaaagaacucug

SEQ ID NO: 4276 - RNA, 20 nt, Artificial Sequence
  source: /note="Description of Artificial Sequence: Synthetic oligonucleotide"
uaagauaagggccaugaagg

SEQ ID NO: 4277 - RNA, 20 nt, Artificial Sequence
  source: /note="Description of Artificial Sequence: Synthetic oligonucleotide"
uuaagauaagggccaugaag

SEQ ID NO: 4278 - RNA, 20 nt, Artificial Sequence
  source: /note="Description of Artificial Sequence: Synthetic oligonucleotide"
guuaagauaagggccaugaa

SEQ ID NO: 4279 - RNA, 20 nt, Artificial Sequence
  source: /note="Description of Artificial Sequence: Synthetic oligonucleotide"
gguuaagauaagggccauga

SEQ ID NO: 4280 - RNA, 20 nt, Artificial Sequence
  source: /note="Description of Artificial Sequence: Synthetic oligonucleotide"
gaagacagagguuaagauaa

SEQ ID NO: 4281 - RNA, 20 nt, Artificial Sequence
  source: /note="Description of Artificial Sequence: Synthetic oligonucleotide"
ugaagacagagguuaagaua

SEQ ID NO: 4282 - RNA, 20 nt, Artificial Sequence
  source: /note="Description of Artificial Sequence: Synthetic oligonucleotide"
aaggguagugcugaagacag

SEQ ID NO: 4283 - RNA, 20 nt, Artificial Sequence
  source: /note="Description of Artificial Sequence: Synthetic oligonucleotide"
aaacggaacaaacauaugaa

SEQ ID NO: 4284 - RNA, 20 nt, Artificial Sequence
  source: /note="Description of Artificial Sequence: Synthetic oligonucleotide"
aaaacggaacaaacauauga

SEQ ID NO: 4285 - RNA, 20 nt, Artificial Sequence
  source: /note="Description of Artificial Sequence: Synthetic oligonucleotide"
aaaucacuuagaagauaaaa

SEQ ID NO: 4286 - RNA, 20 nt, Artificial Sequence
  source: /note="Description of Artificial Sequence: Synthetic oligonucleotide"
cguggugacgugaggucgga

SEQ ID NO: 4287 - RNA, 20 nt, Artificial Sequence
  source: /note="Description of Artificial Sequence: Synthetic oligonucleotide"
gcguggugacgugaggucgg

SEQ ID NO: 4288 - RNA, 20 nt, Artificial Sequence
  source: /note="Description of Artificial Sequence: Synthetic oligonucleotide"
cuuagcggagguccuccgcc

SEQ ID NO: 4289 - RNA, 20 nt, Artificial Sequence
  source: /note="Description of Artificial Sequence: Synthetic oligonucleotide"
ccucuuagcggagguccucc

SEQ ID NO: 4290 - RNA, 20 nt, Artificial Sequence
  source: /note="Description of Artificial Sequence: Synthetic oligonucleotide"
cgcccucuuagcggaggucc

SEQ ID NO: 4291 - RNA, 20 nt, Artificial Sequence
  source: /note="Description of Artificial Sequence: Synthetic oligonucleotide"
cuccgcccucuuagcggagg

SEQ ID NO: 4292 - RNA, 20 nt, Artificial Sequence
  source: /note="Description of Artificial Sequence: Synthetic oligonucleotide"
cgaugaccccuccgacuccg

SEQ ID NO: 4293 - RNA, 20 nt, Artificial Sequence
  source: /note="Description of Artificial Sequence: Synthetic oligonucleotide"
ucgaugaccccuccgacucc

SEQ ID NO: 4294 - RNA, 20 nt, Artificial Sequence
  source: /note="Description of Artificial Sequence: Synthetic oligonucleotide"
gggucgaugaccccuccgac

SEQ ID NO: 4295 - RNA, 20 nt, Artificial Sequence
  source: /note="Description of Artificial Sequence: Synthetic oligonucleotide"
acaucagggucgaugacccc

SEQ ID NO: 4296 - RNA, 20 nt, Artificial Sequence
  source: /note="Description of Artificial Sequence: Synthetic oligonucleotide"
cggacaucagggucgaugac

SEQ ID NO: 4297 - RNA, 20 nt, Artificial Sequence
  source: /note="Description of Artificial Sequence: Synthetic oligonucleotide"
ucggacaucagggucgauga

SEQ ID NO: 4298 - RNA, 20 nt, Artificial Sequence
  source: /note="Description of Artificial Sequence: Synthetic oligonucleotide"
uucggacaucagggucgaug

SEQ ID NO: 4299 - RNA, 20 nt, Artificial Sequence
  source: /note="Description of Artificial Sequence: Synthetic oligonucleotide"
auuuuuaauagguccguacc

SEQ ID NO: 4300 - RNA, 20 nt, Artificial Sequence
  source: /note="Description of Artificial Sequence: Synthetic oligonucleotide"
uauauuuuuaauagguccgu

SEQ ID NO: 4301 - RNA, 20 nt, Artificial Sequence
  source: /note="Description of Artificial Sequence: Synthetic oligonucleotide"
auuuuuauauuuuuaauagg

SEQ ID NO: 4302 - RNA, 20 nt, Artificial Sequence
  source: /note="Description of Artificial Sequence: Synthetic oligonucleotide"
acccaccuagugaacuccag

SEQ ID NO: 4303 - RNA, 20 nt, Artificial Sequence
  source: /note="Description of Artificial Sequence: Synthetic oligonucleotide"
guuccacccaccuagugaac

SEQ ID NO: 4304 - RNA, 20 nt, Artificial Sequence
  source: /note="Description of Artificial Sequence: Synthetic oligonucleotide"
gaaacccuccgguuccaccc

SEQ ID NO: 4305 - RNA, 20 nt, Artificial Sequence
  source: /note="Description of Artificial Sequence: Synthetic oligonucleotide"
cgugaaacccuccgguucca

SEQ ID NO: 4306 - RNA, 20 nt, Artificial Sequence
  source: /note="Description of Artificial Sequence: Synthetic oligonucleotide"
ucgugaaacccuccgguucc

SEQ ID NO: 4307 - RNA, 20 nt, Artificial Sequence
  source: /note="Description of Artificial Sequence: Synthetic oligonucleotide"
gggucgugaaacccuccggu

SEQ ID NO: 4308 - RNA, 20 nt, Artificial Sequence
  source: /note="Description of Artificial Sequence: Synthetic oligonucleotide"
acguuagggucgugaaaccc

SEQ ID NO: 4309 - RNA, 20 nt, Artificial Sequence
  source: /note="Description of Artificial Sequence: Synthetic oligonucleotide"
cggacguuagggucgugaaa

SEQ ID NO: 4310 - RNA, 20 nt, Artificial Sequence
  source: /note="Description of Artificial Sequence: Synthetic oligonucleotide"
acggacguuagggucgugaa

SEQ ID NO: 4311 - RNA, 20 nt, Artificial Sequence
  source: /note="Description of Artificial Sequence: Synthetic oligonucleotide"
aucaugaacgguccggcgcc

SEQ ID NO: 4312 - RNA, 20 nt, Artificial Sequence
  source: /note="Description of Artificial Sequence: Synthetic oligonucleotide"
uggaucaugaacgguccggc

SEQ ID NO: 4313 - RNA, 20 nt, Artificial Sequence
  source: /note="Description of Artificial Sequence: Synthetic oligonucleotide"
cuauuuuggaucaugaacgg

SEQ ID NO: 4314 - RNA, 20 nt, Artificial Sequence
  source: /note="Description of Artificial Sequence: Synthetic oligonucleotide"
gaagcuuaaugaugcuauuu

SEQ ID NO: 4315 - RNA, 20 nt, Artificial Sequence
  source: /note="Description of Artificial Sequence: Synthetic oligonucleotide"
uaaauacagugaugacucac

SEQ ID NO: 4316 - RNA, 20 nt, Artificial Sequence
  source: /note="Description of Artificial Sequence: Synthetic oligonucleotide"
uccucaguagccaauaauuc

SEQ ID NO: 4317 - RNA, 20 nt, Artificial Sequence
  source: /note="Description of Artificial Sequence: Synthetic oligonucleotide"
caguccccuuuaguaaaaag

SEQ ID NO: 4318 - RNA, 20 nt, Artificial Sequence
  source: /note="Description of Artificial Sequence: Synthetic oligonucleotide"
aucaagcuggcaaacuauca

SEQ ID NO: 4319 - RNA, 20 nt, Artificial Sequence
  source: /note="Description of Artificial Sequence: Synthetic oligonucleotide"
ugguugacugggaaucaagc

SEQ ID NO: 4320 - RNA, 20 nt, Artificial Sequence
  source: /note="Description of Artificial Sequence: Synthetic oligonucleotide"
cagcaguuaucugguugacu

SEQ ID NO: 4321 - RNA, 20 nt, Artificial Sequence
  source: /note="Description of Artificial Sequence: Synthetic oligonucleotide"
ccagcaguuaucugguugac

SEQ ID NO: 4322 - RNA, 20 nt, Artificial Sequence
  source: /note="Description of Artificial Sequence: Synthetic oligonucleotide"
ugucacuaccagcaguuauc

SEQ ID NO: 4323 - RNA, 20 nt, Artificial Sequence
  source: /note="Description of Artificial Sequence: Synthetic oligonucleotide"
cacaagauugggaguccugg

SEQ ID NO: 4324 - RNA, 20 nt, Artificial Sequence
  source: /note="Description of Artificial Sequence: Synthetic oligonucleotide"
uggcacaagauugggagucc

SEQ ID NO: 4325 - RNA, 20 nt, Artificial Sequence
  source: /note="Description of Artificial Sequence: Synthetic oligonucleotide"
cucugagcuggcacaagauu

SEQ ID NO: 4326 - RNA, 20 nt, Artificial Sequence
  source: /note="Description of Artificial Sequence: Synthetic oligonucleotide"
ucucugagcuggcacaagau

SEQ ID NO: 4327 - RNA, 20 nt, Artificial Sequence
  source: /note="Description of Artificial Sequence: Synthetic oligonucleotide"
ggggauuucccucucugagc

SEQ ID NO: 4328 - RNA, 20 nt, Artificial Sequence
  source: /note="Description of Artificial Sequence: Synthetic oligonucleotide"
auggugugagcaguucuagg

SEQ ID NO: 4329 - RNA, 20 nt, Artificial Sequence
  source: /note="Description of Artificial Sequence: Synthetic oligonucleotide"
aauggugugagcaguucuag

SEQ ID NO: 4330 - RNA, 20 nt, Artificial Sequence
  source: /note="Description of Artificial Sequence: Synthetic oligonucleotide"
gaauggugugagcaguucua

SEQ ID NO: 4331 - RNA, 20 nt, Artificial Sequence
  source: /note="Description of Artificial Sequence: Synthetic oligonucleotide"
ggaauggugugagcaguucu

SEQ ID NO: 4332 - RNA, 20 nt, Artificial Sequence
  source: /note="Description of Artificial Sequence: Synthetic oligonucleotide"
ggugcuugugguucuuggaa

SEQ ID NO: 4333 - RNA, 20 nt, Artificial Sequence
  source: /note="Description of Artificial Sequence: Synthetic oligonucleotide"
aagguggugcuugugguucu

SEQ ID NO: 4334 - RNA, 20 nt, Artificial Sequence
  source: /note="Description of Artificial Sequence: Synthetic oligonucleotide"
cuauaccaagguggugcuug

SEQ ID NO: 4335 - RNA, 20 nt, Artificial Sequence
  source: /note="Description of Artificial Sequence: Synthetic oligonucleotide"
cauuuuuaacuauaccaagg

SEQ ID NO: 4336 - RNA, 20 nt, Artificial Sequence
  source: /note="Description of Artificial Sequence: Synthetic oligonucleotide"
ucacauuuuuaacuauacca

SEQ ID NO: 4337 - RNA, 20 nt, Artificial Sequence
  source: /note="Description of Artificial Sequence: Synthetic oligonucleotide"
guuuuuaucagaauuugagu

SEQ ID NO: 4338 - RNA, 20 nt, Artificial Sequence
  source: /note="Description of Artificial Sequence: Synthetic oligonucleotide"
ccaaauacugaggaaggcag

SEQ ID NO: 4339 - RNA, 20 nt, Artificial Sequence
  source: /note="Description of Artificial Sequence: Synthetic oligonucleotide"
gacaaaccaaauacugagga

SEQ ID NO: 4340 - RNA, 20 nt, Artificial Sequence
  source: /note="Description of Artificial Sequence: Synthetic oligonucleotide"
aacugacaaaccaaauacug

SEQ ID NO: 4341 - RNA, 20 nt, Artificial Sequence
  source: /note="Description of Artificial Sequence: Synthetic oligonucleotide"
acauuauuaagauuagaaga

SEQ ID NO: 4342 - RNA, 20 nt, Artificial Sequence
  source: /note="Description of Artificial Sequence: Synthetic oligonucleotide"
aacauuauuaagauuagaag

SEQ ID NO: 4343 - RNA, 20 nt, Artificial Sequence
  source: /note="Description of Artificial Sequence: Synthetic oligonucleotide"
aggucaggguuggagucaau

SEQ ID NO: 4344 - RNA, 20 nt, Artificial Sequence
  source: /note="Description of Artificial Sequence: Synthetic oligonucleotide"
gaaguacaggaggucagggu

SEQ ID NO: 4345 - RNA, 20 nt, Artificial Sequence
  source: /note="Description of Artificial Sequence: Synthetic oligonucleotide"
aggugaaguacaggagguca

SEQ ID NO: 4346 - RNA, 20 nt, Artificial Sequence
  source: /note="Description of Artificial Sequence: Synthetic oligonucleotide"
caggugaaguacaggagguc

SEQ ID NO: 4347 - RNA, 20 nt, Artificial Sequence
  source: /note="Description of Artificial Sequence: Synthetic oligonucleotide"
ucaggcaggugaaguacagg

SEQ ID NO: 4348 - RNA, 20 nt, Artificial Sequence
  source: /note="Description of Artificial Sequence: Synthetic oligonucleotide"
ucaucaggcaggugaaguac

SEQ ID NO: 4349 - RNA, 20 nt, Artificial Sequence
  source: /note="Description of Artificial Sequence: Synthetic oligonucleotide"
caaauaaauauucaucaggc

SEQ ID NO: 4350 - RNA, 20 nt, Artificial Sequence
  source: /note="Description of Artificial Sequence: Synthetic oligonucleotide"
auuccaaauaaauauucauc

SEQ ID NO: 4351 - RNA, 20 nt, Artificial Sequence
  source: /note="Description of Artificial Sequence: Synthetic oligonucleotide"
auaaauagauaauucuagaa

SEQ ID NO: 4352 - RNA, 20 nt, Artificial Sequence
  source: /note="Description of Artificial Sequence: Synthetic oligonucleotide"
agugauaaagcuuuugaguu

SEQ ID NO: 4353 - RNA, 20 nt, Artificial Sequence
  source: /note="Description of Artificial Sequence: Synthetic oligonucleotide"
auuacugauaaagaaaugaa

SEQ ID NO: 4354 - RNA, 20 nt, Artificial Sequence
  source: /note="Description of Artificial Sequence: Synthetic oligonucleotide"
caauaguuggaaugagaggg

SEQ ID NO: 4355 - RNA, 20 nt, Artificial Sequence
  source: /note="Description of Artificial Sequence: Synthetic oligonucleotide"
aagcaauaguuggaaugaga

SEQ ID NO: 4356 - RNA, 20 nt, Artificial Sequence
  source: /note="Description of Artificial Sequence: Synthetic oligonucleotide"
uaagcaauaguuggaaugag

SEQ ID NO: 4357 - RNA, 20 nt, Artificial Sequence
  source: /note="Description of Artificial Sequence: Synthetic oligonucleotide"
acucaaguauaagcaauagu

SEQ ID NO: 4358 - RNA, 20 nt, Artificial Sequence
  source: /note="Description of Artificial Sequence: Synthetic oligonucleotide"
aauaaucauaugcaagauau

SEQ ID NO: 4359 - RNA, 20 nt, Artificial Sequence
  source: /note="Description of Artificial Sequence: Synthetic oligonucleotide"
acacuucaccaugaagauuu

SEQ ID NO: 4360 - RNA, 20 nt, Artificial Sequence
  source: /note="Description of Artificial Sequence: Synthetic oligonucleotide"
gguagggucacucacacuuc

SEQ ID NO: 4361 - RNA, 20 nt, Artificial Sequence
  source: /note="Description of Artificial Sequence: Synthetic oligonucleotide"
uaaggugaucguuacacagu

SEQ ID NO: 4362 - RNA, 20 nt, Artificial Sequence
  source: /note="Description of Artificial Sequence: Synthetic oligonucleotide"
guaaggugaucguuacacag

SEQ ID NO: 4363 - RNA, 20 nt, Artificial Sequence
  source: /note="Description of Artificial Sequence: Synthetic oligonucleotide"
acgguuugacaaaacguuuc

SEQ ID NO: 4364 - RNA, 20 nt, Artificial Sequence
  source: /note="Description of Artificial Sequence: Synthetic oligonucleotide"
ucgcuuugaugacccagaau

SEQ ID NO: 4365 - RNA, 20 nt, Artificial Sequence
  source: /note="Description of Artificial Sequence: Synthetic oligonucleotide"
agggauucucgcuuugauga

SEQ ID NO: 4366 - RNA, 20 nt, Artificial Sequence
  source: /note="Description of Artificial Sequence: Synthetic oligonucleotide"
uagggauucucgcuuugaug

SEQ ID NO: 4367 - RNA, 20 nt, Artificial Sequence
  source: /note="Description of Artificial Sequence: Synthetic oligonucleotide"
caaaaguuaagagaacucuc

SEQ ID NO: 4368 - RNA, 20 nt, Artificial Sequence
  source: /note="Description of Artificial Sequence: Synthetic oligonucleotide"
uacaaauauucaaaaacaua

SEQ ID NO: 4369 - RNA, 20 nt, Artificial Sequence
  source: /note="Description of Artificial Sequence: Synthetic oligonucleotide"
uuacaaauauucaaaaacau

SEQ ID NO: 4370 - RNA, 20 nt, Artificial Sequence
  source: /note="Description of Artificial Sequence: Synthetic oligonucleotide"
cuuauuacgacguuguuugu

SEQ ID NO: 4371 - RNA, 20 nt, Artificial Sequence
  source: /note="Description of Artificial Sequence: Synthetic oligonucleotide"
aaacccaacgaagauggaaa

SEQ ID NO: 4372 - RNA, 20 nt, Artificial Sequence
  source: /note="Description of Artificial Sequence: Synthetic oligonucleotide"
aguagguagacauccguaaa

SEQ ID NO: 4373 - RNA, 20 nt, Artificial Sequence
  source: /note="Description of Artificial Sequence: Synthetic oligonucleotide"
aaguagguagacauccguaa

SEQ ID NO: 4374 - RNA, 20 nt, Artificial Sequence
  source: /note="Description of Artificial Sequence: Synthetic oligonucleotide"
aauagguaaguagguagaca

SEQ ID NO: 4375 - RNA, 20 nt, Artificial Sequence
  source: /note="Description of Artificial Sequence: Synthetic oligonucleotide"
gucuuaaaagaaggagaaau

SEQ ID NO: 4376 - RNA, 20 nt, Artificial Sequence
  source: /note="Description of Artificial Sequence: Synthetic oligonucleotide"
uuauaaaaagaaacacacua

SEQ ID NO: 4377 - RNA, 20 nt, Artificial Sequence
  source: /note="Description of Artificial Sequence: Synthetic oligonucleotide"
aagauucauggaguacauuc

SEQ ID NO: 4378 - RNA, 20 nt, Artificial Sequence
  source: /note="Description of Artificial Sequence: Synthetic oligonucleotide"
aacgaggaggagggucgggg

SEQ ID NO: 4379 - RNA, 20 nt, Artificial Sequence
  source: /note="Description of Artificial Sequence: Synthetic oligonucleotide"
auaaauucauaugauaagac

SEQ ID NO: 4380 - RNA, 20 nt, Artificial Sequence
  source: /note="Description of Artificial Sequence: Synthetic oligonucleotide"
ggaguauuuauuacgaagaa

SEQ ID NO: 4381 - RNA, 20 nt, Artificial Sequence
  source: /note="Description of Artificial Sequence: Synthetic oligonucleotide"
cgauaguuacuacuugaaaa

SEQ ID NO: 4382 - RNA, 20 nt, Artificial Sequence
  source: /note="Description of Artificial Sequence: Synthetic oligonucleotide"
ucgauaguuacuacuugaaa

SEQ ID NO: 4383 - RNA, 20 nt, Artificial Sequence
  source: /note="Description of Artificial Sequence: Synthetic oligonucleotide"
gugaaucacauuacaaaaau

SEQ ID NO: 4384 - RNA, 20 nt, Artificial Sequence
  source: /note="Description of Artificial Sequence: Synthetic oligonucleotide"
uuuuaaaccggaaaaugcag

SEQ ID NO: 4385 - RNA, 20 nt, Artificial Sequence
  source: /note="Description of Artificial Sequence: Synthetic oligonucleotide"
uauauuuugguauguuuuaa

SEQ ID NO: 4386 - RNA, 20 nt, Artificial Sequence
  source: /note="Description of Artificial Sequence: Synthetic oligonucleotide"
uuaguugaaagucagaaaua

SEQ ID NO: 4387 - RNA, 20 nt, Artificial Sequence
  source: /note="Description of Artificial Sequence: Synthetic oligonucleotide"
auuaguugaaagucagaaau

SEQ ID NO: 4388 - RNA, 20 nt, Artificial Sequence
  source: /note="Description of Artificial Sequence: Synthetic oligonucleotide"
aaguaaggagggggcccgga

SEQ ID NO: 4389 - RNA, 20 nt, Artificial Sequence
  source: /note="Description of Artificial Sequence: Synthetic oligonucleotide"
aaaaguaaguaaggaggggg

SEQ ID NO: 4390 - RNA, 20 nt, Artificial Sequence
  source: /note="Description of Artificial Sequence: Synthetic oligonucleotide"
caaaaguaaguaaggagggg

SEQ ID NO: 4391 - RNA, 20 nt, Artificial Sequence
  source: /note="Description of Artificial Sequence: Synthetic oligonucleotide"
guuuuuugggucauggguaa

SEQ ID NO: 4392 - RNA, 20 nt, Artificial Sequence
  source: /note="Description of Artificial Sequence: Synthetic oligonucleotide"
acauuucauauacucaguca

SEQ ID NO: 4393 - RNA, 20 nt, Artificial Sequence
  source: /note="Description of Artificial Sequence: Synthetic oligonucleotide"
aacauuucauauacucaguc

SEQ ID NO: 4394 - RNA, 20 nt, Artificial Sequence
  source: /note="Description of Artificial Sequence: Synthetic oligonucleotide"
gccauacguuaaaauuuaag

SEQ ID NO: 4395 - RNA, 20 nt, Artificial Sequence
  source: /note="Description of Artificial Sequence: Synthetic oligonucleotide"
agccauacguuaaaauuuaa

SEQ ID NO: 4396 - RNA, 20 nt, Artificial Sequence
  source: /note="Description of Artificial Sequence: Synthetic oligonucleotide"
aagccauacguuaaaauuua

SEQ ID NO: 4397 - RNA, 20 nt, Artificial Sequence
  source: /note="Description of Artificial Sequence: Synthetic oligonucleotide"
acguugcuucuuuagaaaca

SEQ ID NO: 4398 - RNA, 20 nt, Artificial Sequence
  source: /note="Description of Artificial Sequence: Synthetic oligonucleotide"
ucuuuaucauucgacucuga

SEQ ID NO: 4399 - RNA, 20 nt, Artificial Sequence
  source: /note="Description of Artificial Sequence: Synthetic oligonucleotide"
aucuuuaucauucgacucug

SEQ ID NO: 4400 - RNA, 20 nt, Artificial Sequence
  source: /note="Description of Artificial Sequence: Synthetic oligonucleotide"
uaaaaugucucauucuuccc

SEQ ID NO: 4401 - RNA, 20 nt, Artificial Sequence
  source: /note="Description of Artificial Sequence: Synthetic oligonucleotide"
ggguaaaaugucucauucuu

SEQ ID NO: 4402 - RNA, 20 nt, Artificial Sequence
  source: /note="Description of Artificial Sequence: Synthetic oligonucleotide"
aggguaaaaugucucauucu

SEQ ID NO: 4403 - RNA, 20 nt, Artificial Sequence
  source: /note="Description of Artificial Sequence: Synthetic oligonucleotide"
uaaauugugaguuuuuuuag

SEQ ID NO: 4404 - RNA, 20 nt, Artificial Sequence
  source: /note="Description of Artificial Sequence: Synthetic oligonucleotide"
gcucagguucccgggguuga

SEQ ID NO: 4405 - RNA, 20 nt, Artificial Sequence
  source: /note="Description of Artificial Sequence: Synthetic oligonucleotide"
aguugaagcucagguucccg

SEQ ID NO: 4406 - RNA, 20 nt, Artificial Sequence
  source: /note="Description of Artificial Sequence: Synthetic oligonucleotide"
caguugaagcucagguuccc

SEQ ID NO: 4407 - RNA, 20 nt, Artificial Sequence
  source: /note="Description of Artificial Sequence: Synthetic oligonucleotide"
gcaguugaagcucagguucc

SEQ ID NO: 4408 - RNA, 20 nt, Artificial Sequence
  source: /note="Description of Artificial Sequence: Synthetic oligonucleotide"
aucagaagcaguugaagcuc

SEQ ID NO: 4409 - RNA, 20 nt, Artificial Sequence
  source: /note="Description of Artificial Sequence: Synthetic oligonucleotide"
gaauauccugaaauaguauc

SEQ ID NO: 4410 - RNA, 20 nt, Artificial Sequence
  source: /note="Description of Artificial Sequence: Synthetic oligonucleotide"
ugaauauauggaaacaguau

SEQ ID NO: 4411 - RNA, 20 nt, Artificial Sequence
  source: /note="Description of Artificial Sequence: Synthetic oligonucleotide"
gguccauuguccugaauaua

SEQ ID NO: 4412 - RNA, 20 nt, Artificial Sequence
  source: /note="Description of Artificial Sequence: Synthetic oligonucleotide"
gauaaaauggcuaaaggagu

SEQ ID NO: 4413 - RNA, 20 nt, Artificial Sequence
  source: /note="Description of Artificial Sequence: Synthetic oligonucleotide"
aguuuugauaaaauggcuaa

SEQ ID NO: 4414 - RNA, 20 nt, Artificial Sequence
  source: /note="Description of Artificial Sequence: Synthetic oligonucleotide"
ucuaaagaguuuugauaaaa

SEQ ID NO: 4415 - RNA, 20 nt, Artificial Sequence
  source: /note="Description of Artificial Sequence: Synthetic oligonucleotide"
aaaggagcacaagaagacuu

SEQ ID NO: 4416 - RNA, 20 nt, Artificial Sequence
  source: /note="Description of Artificial Sequence: Synthetic oligonucleotide"
ugacugaagagugucuacaa

SEQ ID NO: 4417 - RNA, 20 nt, Artificial Sequence
  source: /note="Description of Artificial Sequence: Synthetic oligonucleotide"
auacagcugcagcaaauugg

SEQ ID NO: 4418 - RNA, 20 nt, Artificial Sequence
  source: /note="Description of Artificial Sequence: Synthetic oligonucleotide"
cagauacagcugcagcaaau

SEQ ID NO: 4419 - RNA, 20 nt, Artificial Sequence
  source: /note="Description of Artificial Sequence: Synthetic oligonucleotide"
ggggagaaagcguuguuuug

SEQ ID NO: 4420 - RNA, 20 nt, Artificial Sequence
  source: /note="Description of Artificial Sequence: Synthetic oligonucleotide"
gcagagagaaaagaggaaug

SEQ ID NO: 4421 - RNA, 20 nt, Artificial Sequence
  source: /note="Description of Artificial Sequence: Synthetic oligonucleotide"
ggcagagagaaaagaggaau

SEQ ID NO: 4422 - RNA, 20 nt, Artificial Sequence
  source: /note="Description of Artificial Sequence: Synthetic oligonucleotide"
gggcagagagaaaagaggaa

SEQ ID NO: 4423 - RNA, 20 nt, Artificial Sequence
  source: /note="Description of Artificial Sequence: Synthetic oligonucleotide"
uccaagggcagagagaaaag

SEQ ID NO: 4424 - RNA, 20 nt, Artificial Sequence
  source: /note="Description of Artificial Sequence: Synthetic oligonucleotide"
agaaguccacagaguuccaa

SEQ ID NO: 4425 - RNA, 20 nt, Artificial Sequence
  source: /note="Description of Artificial Sequence: Synthetic oligonucleotide"
gagaaguccacagaguucca

SEQ ID NO: 4426 - RNA, 20 nt, Artificial Sequence
  source: /note="Description of Artificial Sequence: Synthetic oligonucleotide"
augcacugauaaaagggagu

SEQ ID NO: 4427 - RNA, 20 nt, Artificial Sequence
  source: /note="Description of Artificial Sequence: Synthetic oligonucleotide"
gaugacaugcacugauaaaa

SEQ ID NO: 4428 - RNA, 20 nt, Artificial Sequence
  source: /note="Description of Artificial Sequence: Synthetic oligonucleotide"
agaugacaugcacugauaaa

SEQ ID NO: 4429 - RNA, 20 nt, Artificial Sequence
  source: /note="Description of Artificial Sequence: Synthetic oligonucleotide"
uauugggugcuacaaauaag

SEQ ID NO: 4430 - RNA, 20 nt, Artificial Sequence
  source: /note="Description of Artificial Sequence: Synthetic oligonucleotide"
aaagauguaguaaaaauauu

SEQ ID NO: 4431 - RNA, 20 nt, Artificial Sequence
  source: /note="Description of Artificial Sequence: Synthetic oligonucleotide"
caaagauguaguaaaaauau

SEQ ID NO: 4432 - RNA, 20 nt, Artificial Sequence
  source: /note="Description of Artificial Sequence: Synthetic oligonucleotide"
uaacccaaguaagacuuaau

SEQ ID NO: 4433 - RNA, 20 nt, Artificial Sequence
  source: /note="Description of Artificial Sequence: Synthetic oligonucleotide"
cugaccuguauaucuuuaaa

SEQ ID NO: 4434 - RNA, 20 nt, Artificial Sequence
  source: /note="Description of Artificial Sequence: Synthetic oligonucleotide"
aaauuaaaucgaccucucug

SEQ ID NO: 4435 - RNA, 20 nt, Artificial Sequence
  source: /note="Description of Artificial Sequence: Synthetic oligonucleotide"
gaguucccaaaauuaaaucg

SEQ ID NO: 4436 - RNA, 20 nt, Artificial Sequence
  source: /note="Description of Artificial Sequence: Synthetic oligonucleotide"
guacaccagagacacgaguu

SEQ ID NO: 4437 - RNA, 20 nt, Artificial Sequence
  source: /note="Description of Artificial Sequence: Synthetic oligonucleotide"
uguacaccagagacacgagu

SEQ ID NO: 4438 - RNA, 20 nt, Artificial Sequence
  source: /note="Description of Artificial Sequence: Synthetic oligonucleotide"
uccauuuuguaauauuguac

SEQ ID NO: 4439 - RNA, 20 nt, Artificial Sequence
  source: /note="Description of Artificial Sequence: Synthetic oligonucleotide"
guacgauucacgauaccuuu

SEQ ID NO: 4440 - RNA, 20 nt, Artificial Sequence
  source: /note="Description of Artificial Sequence: Synthetic oligonucleotide"
uccauuguacgauucacgau

SEQ ID NO: 4441 - RNA, 20 nt, Artificial Sequence
  source: /note="Description of Artificial Sequence: Synthetic oligonucleotide"
uaagucauauacgguacagu

SEQ ID NO: 4442 - RNA, 20 nt, Artificial Sequence
  source: /note="Description of Artificial Sequence: Synthetic oligonucleotide"
ucccuguacuucaugagaug

SEQ ID NO: 4443 - RNA, 20 nt, Artificial Sequence
  source: /note="Description of Artificial Sequence: Synthetic oligonucleotide"
ccacugacauucuacuucag

SEQ ID NO: 4444 - RNA, 20 nt, Artificial Sequence
  source: /note="Description of Artificial Sequence: Synthetic oligonucleotide"
uucuccuuugaaauaagagg

SEQ ID NO: 4445 - RNA, 20 nt, Artificial Sequence
  source: /note="Description of Artificial Sequence: Synthetic oligonucleotide"
aagacugaacaacucgauuc

SEQ ID NO: 4446 - RNA, 20 nt, Artificial Sequence
  source: /note="Description of Artificial Sequence: Synthetic oligonucleotide"
uaguggauccauucuucaac

SEQ ID NO: 4447 - RNA, 20 nt, Artificial Sequence
  source: /note="Description of Artificial Sequence: Synthetic oligonucleotide"
ccgaauguucucauagugga

SEQ ID NO: 4448 - RNA, 20 nt, Artificial Sequence
  source: /note="Description of Artificial Sequence: Synthetic oligonucleotide"
gaaucgucaccaagugucac

SEQ ID NO: 4449 - RNA, 20 nt, Artificial Sequence
  source: /note="Description of Artificial Sequence: Synthetic oligonucleotide"
acuucaucuguugaaucguc

SEQ ID NO: 4450 - RNA, 20 nt, Artificial Sequence
  source: /note="Description of Artificial Sequence: Synthetic oligonucleotide"
caaugaggcuuaagagccag

SEQ ID NO: 4451 - RNA, 20 nt, Artificial Sequence
  source: /note="Description of Artificial Sequence: Synthetic oligonucleotide"
cuucaccgcaauaaucaaug

SEQ ID NO: 4452 - RNA, 20 nt, Artificial Sequence
  source: /note="Description of Artificial Sequence: Synthetic oligonucleotide"
uggauauuuccauuacagug

SEQ ID NO: 4453 - RNA, 20 nt, Artificial Sequence
  source: /note="Description of Artificial Sequence: Synthetic oligonucleotide"
agguuuuggauaccuauaau

SEQ ID NO: 4454 - RNA, 20 nt, Artificial Sequence
  source: /note="Description of Artificial Sequence: Synthetic oligonucleotide"
auaaagaguuuaaaagguuu

SEQ ID NO: 4455 - RNA, 20 nt, Artificial Sequence
  source: /note="Description of Artificial Sequence: Synthetic oligonucleotide"
ccugauauaaagaguuuaaa

SEQ ID NO: 4456 - RNA, 20 nt, Artificial Sequence
  source: /note="Description of Artificial Sequence: Synthetic oligonucleotide"
uaaguuagcaaaaaggaaca

SEQ ID NO: 4457 - RNA, 20 nt, Artificial Sequence
  source: /note="Description of Artificial Sequence: Synthetic oligonucleotide"
uuaaguuagcaaaaaggaac

SEQ ID NO: 4458 - RNA, 20 nt, Artificial Sequence
  source: /note="Description of Artificial Sequence: Synthetic oligonucleotide"
acauuuuuaaguuagcaaaa

SEQ ID NO: 4459 - RNA, 20 nt, Artificial Sequence
  source: /note="Description of Artificial Sequence: Synthetic oligonucleotide"
cugagcugcugguaagacag

SEQ ID NO: 4460 - RNA, 20 nt, Artificial Sequence
  source: /note="Description of Artificial Sequence: Synthetic oligonucleotide"
ugaauuuauuccuaauguaa

SEQ ID NO: 4461 - RNA, 20 nt, Artificial Sequence
  source: /note="Description of Artificial Sequence: Synthetic oligonucleotide"
uuucuuuauugucuaugcuu

SEQ ID NO: 4462 - RNA, 20 nt, Artificial Sequence
  source: /note="Description of Artificial Sequence: Synthetic oligonucleotide"
uugucuaugcuuaggacaca

SEQ ID NO: 4463 - RNA, 20 nt, Artificial Sequence
  source: /note="Description of Artificial Sequence: Synthetic oligonucleotide"
uauguauagcuguauuuuuc

SEQ ID NO: 4464 - RNA, 20 nt, Artificial Sequence
  source: /note="Description of Artificial Sequence: Synthetic oligonucleotide"
uuaucaauucucaaugucua

SEQ ID NO: 4465 - RNA, 20 nt, Artificial Sequence
  source: /note="Description of Artificial Sequence: Synthetic oligonucleotide"
ucuauggaguuuuuaaaaag

SEQ ID NO: 4466 - RNA, 20 nt, Artificial Sequence
  source: /note="Description of Artificial Sequence: Synthetic oligonucleotide"
ggaguuuuuaaaaagaggua

SEQ ID NO: 4467 - RNA, 20 nt, Artificial Sequence
  source: /note="Description of Artificial Sequence: Synthetic oligonucleotide"
acuucgucucaaucuuguua

SEQ ID NO: 4468 - RNA, 20 nt, Artificial Sequence
  source: /note="Description of Artificial Sequence: Synthetic oligonucleotide"
cuuguuaaggaccaaauaaa

SEQ ID NO: 4469 - RNA, 20 nt, Artificial Sequence
  source: /note="Description of Artificial Sequence: Synthetic oligonucleotide"
gaccaaauaaaugguauuug

SEQ ID NO: 4470 - RNA, 20 nt, Artificial Sequence
  source: /note="Description of Artificial Sequence: Synthetic oligonucleotide"
aagugaguaccuccugcacc

SEQ ID NO: 4471 - RNA, 20 nt, Artificial Sequence
  source: /note="Description of Artificial Sequence: Synthetic oligonucleotide"
uagucagucuugugacaauu

SEQ ID NO: 4472 - RNA, 20 nt, Artificial Sequence
  source: /note="Description of Artificial Sequence: Synthetic oligonucleotide"
acuagcagagaacuaaauua

SEQ ID NO: 4473 - RNA, 20 nt, Artificial Sequence
  source: /note="Description of Artificial Sequence: Synthetic oligonucleotide"
cagagaacuaaauuauggaa

SEQ ID NO: 4474 - RNA, 20 nt, Artificial Sequence
  source: /note="Description of Artificial Sequence: Synthetic oligonucleotide"
auuauggaauggcagaucuc

SEQ ID NO: 4475 - RNA, 20 nt, Artificial Sequence
  source: /note="Description of Artificial Sequence: Synthetic oligonucleotide"
cagcuaugugauuuuacaua

SEQ ID NO: 4476 - RNA, 20 nt, Artificial Sequence
  source: /note="Description of Artificial Sequence: Synthetic oligonucleotide"
uacauacgguuuguuuuuaa

SEQ ID NO: 4477 - RNA, 20 nt, Artificial Sequence
  source: /note="Description of Artificial Sequence: Synthetic oligonucleotide"
uaauggauagagacagaguc

SEQ ID NO: 4478 - RNA, 20 nt, Artificial Sequence
  source: /note="Description of Artificial Sequence: Synthetic oligonucleotide"
agagucuggcuauguugccc

SEQ ID NO: 4479 - RNA, 20 nt, Artificial Sequence
  source: /note="Description of Artificial Sequence: Synthetic oligonucleotide"
ccaggcugcucugaaacucc

SEQ ID NO: 4480 - RNA, 20 nt, Artificial Sequence
  source: /note="Description of Artificial Sequence: Synthetic oligonucleotide"
caggcugcucugaaacuccu

SEQ ID NO: 4481 - RNA, 20 nt, Artificial Sequence
  source: /note="Description of Artificial Sequence: Synthetic oligonucleotide"
cauccugccuuagccucuua

SEQ ID NO: 4482 - RNA, 20 nt, Artificial Sequence
  source: /note="Description of Artificial Sequence: Synthetic oligonucleotide"
gccuuagccucuuaaggagc

SEQ ID NO: 4483 - RNA, 20 nt, Artificial Sequence
  source: /note="Description of Artificial Sequence: Synthetic oligonucleotide"
ccuuagccucuuaaggagcu

SEQ ID NO: 4484 - RNA, 20 nt, Artificial Sequence
  source: /note="Description of Artificial Sequence: Synthetic oligonucleotide"
ucuuaaggagcugggauuac

SEQ ID NO: 4485 - RNA, 20 nt, Artificial Sequence
  source: /note="Description of Artificial Sequence: Synthetic oligonucleotide"
gauuacaggugcaugccccc

SEQ ID NO: 4486 - RNA, 20 nt, Artificial Sequence
  source: /note="Description of Artificial Sequence: Synthetic oligonucleotide"
ucugaaaauacaaaagaaag

SEQ ID NO: 4487 - RNA, 20 nt, Artificial Sequence
  source: /note="Description of Artificial Sequence: Synthetic oligonucleotide"
cugaaaauacaaaagaaaga

SEQ ID NO: 4488 - RNA, 20 nt, Artificial Sequence
  source: /note="Description of Artificial Sequence: Synthetic oligonucleotide"
cugcugagugucccaaccua

SEQ ID NO: 4489 - RNA, 20 nt, Artificial Sequence
  source: /note="Description of Artificial Sequence: Synthetic oligonucleotide"
ugcugagugucccaaccuaa

SEQ ID NO: 4490 - RNA, 20 nt, Artificial Sequence
  source: /note="Description of Artificial Sequence: Synthetic oligonucleotide"
auauaugcauguauagaagu

SEQ ID NO: 4491 - RNA, 20 nt, Artificial Sequence
  source: /note="Description of Artificial Sequence: Synthetic oligonucleotide"
uauaugcauguauagaagua

SEQ ID NO: 4492 - RNA, 20 nt, Artificial Sequence
  source: /note="Description of Artificial Sequence: Synthetic oligonucleotide"
uaaaauuauagagacauugc

SEQ ID NO: 4493 - RNA, 20 nt, Artificial Sequence
  source: /note="Description of Artificial Sequence: Synthetic oligonucleotide"
agacauugcaggagagacuc

SEQ ID NO: 4494 - RNA, 20 nt, Artificial Sequence
  source: /note="Description of Artificial Sequence: Synthetic oligonucleotide"
cucuggauuagauagaaaaa

SEQ ID NO: 4495 - RNA, 20 nt, Artificial Sequence
  source: /note="Description of Artificial Sequence: Synthetic oligonucleotide"
gauagaaaaaaggaagaauu

SEQ ID NO: 4496 - RNA, 20 nt, Artificial Sequence
  source: /note="Description of Artificial Sequence: Synthetic oligonucleotide"
uugucuauaauccuuuuagu

SEQ ID NO: 4497 - RNA, 20 nt, Artificial Sequence
  source: /note="Description of Artificial Sequence: Synthetic oligonucleotide"
ugccuuacugcagacaccug

SEQ ID NO: 4498 - RNA, 20 nt, Artificial Sequence
  source: /note="Description of Artificial Sequence: Synthetic oligonucleotide"
auacuucucagagacuguuc

SEQ ID NO: 4499 - RNA, 20 nt, Artificial Sequence
  source: /note="Description of Artificial Sequence: Synthetic oligonucleotide"
aguugaacucccaugauucc

SEQ ID NO: 4500 - RNA, 20 nt, Artificial Sequence
  source: /note="Description of Artificial Sequence: Synthetic oligonucleotide"
uguugccauuuucaagacac

SEQ ID NO: 4501 - RNA, 20 nt, Artificial Sequence
  source: /note="Description of Artificial Sequence: Synthetic oligonucleotide"
guugccauuuucaagacaca

SEQ ID NO: 4502 - RNA, 20 nt, Artificial Sequence
  source: /note="Description of Artificial Sequence: Synthetic oligonucleotide"
ucuagauuaccucucuaccu

SEQ ID NO: 4503 - RNA, 20 nt, Artificial Sequence
  source: /note="Description of Artificial Sequence: Synthetic oligonucleotide"
cuagauuaccucucuaccuu

SEQ ID NO: 4504 - RNA, 20 nt, Artificial Sequence
  source: /note="Description of Artificial Sequence: Synthetic oligonucleotide"
gaauuuuaagucacucugug

SEQ ID NO: 4505 - RNA, 20 nt, Artificial Sequence
  source: /note="Description of Artificial Sequence: Synthetic oligonucleotide"
aauuuuaagucacucuguga

SEQ ID NO: 4506 - RNA, 20 nt, Artificial Sequence
  source: /note="Description of Artificial Sequence: Synthetic oligonucleotide"
uccucuuuccccucucaugc

SEQ ID NO: 4507 - RNA, 20 nt, Artificial Sequence
  source: /note="Description of Artificial Sequence: Synthetic oligonucleotide"
cucucaugcuggaaaaucuu

SEQ ID NO: 4508 - RNA, 20 nt, Artificial Sequence
  source: /note="Description of Artificial Sequence: Synthetic oligonucleotide"
cugagagcgcauuuuuaaga

SEQ ID NO: 4509 - RNA, 20 nt, Artificial Sequence
  source: /note="Description of Artificial Sequence: Synthetic oligonucleotide"
cucuucuugaacguuaagcc

SEQ ID NO: 4510 - RNA, 20 nt, Artificial Sequence
  source: /note="Description of Artificial Sequence: Synthetic oligonucleotide"
ucuucuugaacguuaagccu

SEQ ID NO: 4511 - RNA, 20 nt, Artificial Sequence
  source: /note="Description of Artificial Sequence: Synthetic oligonucleotide"
uugaacguuaagccugggua

SEQ ID NO: 4512 - RNA, 20 nt, Artificial Sequence
  source: /note="Description of Artificial Sequence: Synthetic oligonucleotide"
gaauaaagugcagaaguuua

SEQ ID NO: 4513 - RNA, 20 nt, Artificial Sequence
  source: /note="Description of Artificial Sequence: Synthetic oligonucleotide"
aauuaaaauauuagccauug

SEQ ID NO: 4514 - RNA, 20 nt, Artificial Sequence
  source: /note="Description of Artificial Sequence: Synthetic oligonucleotide"
auuaaaauauuagccauuga

SEQ ID NO: 4515 - RNA, 20 nt, Artificial Sequence
  source: /note="Description of Artificial Sequence: Synthetic oligonucleotide"
auauuagccauugagggaaa

SEQ ID NO: 4516 - RNA, 20 nt, Artificial Sequence
  source: /note="Description of Artificial Sequence: Synthetic oligonucleotide"
auugagggaaaagguuuuac

SEQ ID NO: 4517 - RNA, 20 nt, Artificial Sequence
  source: /note="Description of Artificial Sequence: Synthetic oligonucleotide"
guuuuacagguagcucucug

SEQ ID NO: 4518 - RNA, 20 nt, Artificial Sequence
  source: /note="Description of Artificial Sequence: Synthetic oligonucleotide"
ugcauuuaauuuuuuacagu

SEQ ID NO: 4519 - RNA, 20 nt, Artificial Sequence
  source: /note="Description of Artificial Sequence: Synthetic oligonucleotide"
uuauuuuuaguacauuuauu

SEQ ID NO: 4520 - RNA, 20 nt, Artificial Sequence
  source: /note="Description of Artificial Sequence: Synthetic oligonucleotide"
auuuauuaggaauguguucu

SEQ ID NO: 4521 - RNA, 20 nt, Artificial Sequence
  source: /note="Description of Artificial Sequence: Synthetic oligonucleotide"
uuuauuaggaauguguucuu

SEQ ID NO: 4522 - RNA, 20 nt, Artificial Sequence
  source: /note="Description of Artificial Sequence: Synthetic oligonucleotide"
ucuguaagcccugcuuuaaa

SEQ ID NO: 4523 - RNA, 20 nt, Artificial Sequence
  source: /note="Description of Artificial Sequence: Synthetic oligonucleotide"
uaaauggcaaagaagaaagu

SEQ ID NO: 4524 - RNA, 20 nt, Artificial Sequence
  source: /note="Description of Artificial Sequence: Synthetic oligonucleotide"
agguaauaauagauaauaac

SEQ ID NO: 4525 - RNA, 20 nt, Artificial Sequence
  source: /note="Description of Artificial Sequence: Synthetic oligonucleotide"
guaaguucucaauuuuauau

SEQ ID NO: 4526 - RNA, 20 nt, Artificial Sequence
  source: /note="Description of Artificial Sequence: Synthetic oligonucleotide"
uugagcaccugccaaauacc

SEQ ID NO: 4527 - RNA, 20 nt, Artificial Sequence
  source: /note="Description of Artificial Sequence: Synthetic oligonucleotide"
caaauaccaggcacucuucu

SEQ ID NO: 4528 - RNA, 20 nt, Artificial Sequence
  source: /note="Description of Artificial Sequence: Synthetic oligonucleotide"
cacucuucuaggaacuagag

SEQ ID NO: 4529 - RNA, 20 nt, Artificial Sequence
  source: /note="Description of Artificial Sequence: Synthetic oligonucleotide"
gaguggcauuaaugaguaag

SEQ ID NO: 4530 - RNA, 20 nt, Artificial Sequence
  source: /note="Description of Artificial Sequence: Synthetic oligonucleotide"
uaaaaauguaaagcagaaaa

SEQ ID NO: 4531 - RNA, 20 nt, Artificial Sequence
  source: /note="Description of Artificial Sequence: Synthetic oligonucleotide"
agcagaaaaaggaaauugag

SEQ ID NO: 4532 - RNA, 20 nt, Artificial Sequence
  source: /note="Description of Artificial Sequence: Synthetic oligonucleotide"
gaaaaaggaaauugaguggc

SEQ ID NO: 4533 - RNA, 20 nt, Artificial Sequence
  source: /note="Description of Artificial Sequence: Synthetic oligonucleotide"
aaaaaggaaauugaguggca

SEQ ID NO: 4534 - RNA, 20 nt, Artificial Sequence
  source: /note="Description of Artificial Sequence: Synthetic oligonucleotide"
ggaaauugaguggcaggguu

SEQ ID NO: 4535 - RNA, 20 nt, Artificial Sequence
  source: /note="Description of Artificial Sequence: Synthetic oligonucleotide"
gaagauauaguagucaagua

SEQ ID NO: 4536 - RNA, 20 nt, Artificial Sequence
  source: /note="Description of Artificial Sequence: Synthetic oligonucleotide"
caagccaugaaguuaucuga

SEQ ID NO: 4537 - RNA, 20 nt, Artificial Sequence
  source: /note="Description of Artificial Sequence: Synthetic oligonucleotide"
aaguuaucugaaggaauugc

SEQ ID NO: 4538 - RNA, 20 nt, Artificial Sequence
  source: /note="Description of Artificial Sequence: Synthetic oligonucleotide"
ucugaaggaauugcagguag

SEQ ID NO: 4539 - RNA, 20 nt, Artificial Sequence
  source: /note="Description of Artificial Sequence: Synthetic oligonucleotide"
uggagaacagccaaaagacc

SEQ ID NO: 4540 - RNA, 20 nt, Artificial Sequence
  source: /note="Description of Artificial Sequence: Synthetic oligonucleotide"
aaaagaccuggaguaguaaa

SEQ ID NO: 4541 - RNA, 20 nt, Artificial Sequence
  source: /note="Description of Artificial Sequence: Synthetic oligonucleotide"
auacacuuaaguaagugaua

SEQ ID NO: 4542 - RNA, 20 nt, Artificial Sequence
  source: /note="Description of Artificial Sequence: Synthetic oligonucleotide"
agugauauggacaagaacuu

SEQ ID NO: 4543 - RNA, 20 nt, Artificial Sequence
  source: /note="Description of Artificial Sequence: Synthetic oligonucleotide"
acuuuggaaguugaauagca

SEQ ID NO: 4544 - RNA, 20 nt, Artificial Sequence
  source: /note="Description of Artificial Sequence: Synthetic oligonucleotide"
guugaauagcaagguccauc

SEQ ID NO: 4545 - RNA, 20 nt, Artificial Sequence
  source: /note="Description of Artificial Sequence: Synthetic oligonucleotide"
guccaucuggacuauaacag

SEQ ID NO: 4546 - RNA, 20 nt, Artificial Sequence
  source: /note="Description of Artificial Sequence: Synthetic oligonucleotide"
caucuggacuauaacagagg

SEQ ID NO: 4547 - RNA, 20 nt, Artificial Sequence
  source: /note="Description of Artificial Sequence: Synthetic oligonucleotide"
uaacagaggaggcuucacaa

SEQ ID NO: 4548 - RNA, 20 nt, Artificial Sequence
  source: /note="Description of Artificial Sequence: Synthetic oligonucleotide"
agaggaggcuucacaaagga

SEQ ID NO: 4549 - RNA, 20 nt, Artificial Sequence
  source: /note="Description of Artificial Sequence: Synthetic oligonucleotide"
gcuucacaaaggaaggugac

SEQ ID NO: 4550 - RNA, 20 nt, Artificial Sequence
  source: /note="Description of Artificial Sequence: Synthetic oligonucleotide"
cuucacaaaggaaggugaca

SEQ ID NO: 4551 - RNA, 20 nt, Artificial Sequence
  source: /note="Description of Artificial Sequence: Synthetic oligonucleotide"
caaaggaaggugacagggca

SEQ ID NO: 4552 - RNA, 20 nt, Artificial Sequence
  source: /note="Description of Artificial Sequence: Synthetic oligonucleotide"
gaaggugacagggcauggcc

SEQ ID NO: 4553 - RNA, 20 nt, Artificial Sequence
  source: /note="Description of Artificial Sequence: Synthetic oligonucleotide"
gggcauggccuggauccuga

SEQ ID NO: 4554 - RNA, 20 nt, Artificial Sequence
  source: /note="Description of Artificial Sequence: Synthetic oligonucleotide"
uggccuggauccugaaggac

SEQ ID NO: 4555 - RNA, 20 nt, Artificial Sequence
  source: /note="Description of Artificial Sequence: Synthetic oligonucleotide"
uccugaaggacaggaagaau

SEQ ID NO: 4556 - RNA, 20 nt, Artificial Sequence
  source: /note="Description of Artificial Sequence: Synthetic oligonucleotide"
ccugaaggacaggaagaauu

SEQ ID NO: 4557 - RNA, 20 nt, Artificial Sequence
  source: /note="Description of Artificial Sequence: Synthetic oligonucleotide"
aacaaagaaugacaucccag

SEQ ID NO: 4558 - RNA, 20 nt, Artificial Sequence
  source: /note="Description of Artificial Sequence: Synthetic oligonucleotide"
gacaucccaguggagagaag

SEQ ID NO: 4559 - RNA, 20 nt, Artificial Sequence
  source: /note="Description of Artificial Sequence: Synthetic oligonucleotide"
aucccaguggagagaagugg

SEQ ID NO: 4560 - RNA, 20 nt, Artificial Sequence
  source: /note="Description of Artificial Sequence: Synthetic oligonucleotide"
ucccaguggagagaagugga

SEQ ID NO: 4561 - RNA, 20 nt, Artificial Sequence
  source: /note="Description of Artificial Sequence: Synthetic oligonucleotide"
cccaguggagagaaguggag

SEQ ID NO: 4562 - RNA, 20 nt, Artificial Sequence
  source: /note="Description of Artificial Sequence: Synthetic oligonucleotide"
ggaggggaaacagcaugaaa

SEQ ID NO: 4563 - RNA, 20 nt, Artificial Sequence
  source: /note="Description of Artificial Sequence: Synthetic oligonucleotide"
auggagugaaauaagaaugu

SEQ ID NO: 4564 - RNA, 20 nt, Artificial Sequence
  source: /note="Description of Artificial Sequence: Synthetic oligonucleotide"
aaauaagaauguuggccuuu

SEQ ID NO: 4565 - RNA, 20 nt, Artificial Sequence
  source: /note="Description of Artificial Sequence: Synthetic oligonucleotide"
aauaagaauguuggccuuua

SEQ ID NO: 4566 - RNA, 20 nt, Artificial Sequence
  source: /note="Description of Artificial Sequence: Synthetic oligonucleotide"
agaauguuggccuuuagggc

SEQ ID NO: 4567 - RNA, 20 nt, Artificial Sequence
  source: /note="Description of Artificial Sequence: Synthetic oligonucleotide"
guuggccuuuagggcaggaa

SEQ ID NO: 4568 - RNA, 20 nt, Artificial Sequence
  source: /note="Description of Artificial Sequence: Synthetic oligonucleotide"
uuggccuuuagggcaggaau

SEQ ID NO: 4569 - RNA, 20 nt, Artificial Sequence
  source: /note="Description of Artificial Sequence: Synthetic oligonucleotide"
cuuuagggcaggaaugggcc

SEQ ID NO: 4570 - RNA, 20 nt, Artificial Sequence
  source: /note="Description of Artificial Sequence: Synthetic oligonucleotide"
ggcaggaaugggccaggcag

SEQ ID NO: 4571 - RNA, 20 nt, Artificial Sequence
  source: /note="Description of Artificial Sequence: Synthetic oligonucleotide"
gcaggaaugggccaggcaga

SEQ ID NO: 4572 - RNA, 20 nt, Artificial Sequence
  source: /note="Description of Artificial Sequence: Synthetic oligonucleotide"
ugggccaggcagagggcaag

SEQ ID NO: 4573 - RNA, 20 nt, Artificial Sequence
  source: /note="Description of Artificial Sequence: Synthetic oligonucleotide"
gggccaggcagagggcaagu

SEQ ID NO: 4574 - RNA, 20 nt, Artificial Sequence
  source: /note="Description of Artificial Sequence: Synthetic oligonucleotide"
gcagagggcaagugggaagc

SEQ ID NO: 4575 - RNA, 20 nt, Artificial Sequence
  source: /note="Description of Artificial Sequence: Synthetic oligonucleotide"
gcaagugggaagcaggaaaa

SEQ ID NO: 4576 - RNA, 20 nt, Artificial Sequence
  source: /note="Description of Artificial Sequence: Synthetic oligonucleotide"
accuuguauaaaguucaugu

SEQ ID NO: 4577 - RNA, 20 nt, Artificial Sequence
  source: /note="Description of Artificial Sequence: Synthetic oligonucleotide"
guuggcaaauagagagaaga

SEQ ID NO: 4578 - RNA, 20 nt, Artificial Sequence
  source: /note="Description of Artificial Sequence: Synthetic oligonucleotide"
uuggcaaauagagagaagau

SEQ ID NO: 4579 - RNA, 20 nt, Artificial Sequence
  source: /note="Description of Artificial Sequence: Synthetic oligonucleotide"
uagagagaagaugggaaagc

SEQ ID NO: 4580 - RNA, 20 nt, Artificial Sequence
  source: /note="Description of Artificial Sequence: Synthetic oligonucleotide"
agagagaagaugggaaagca

SEQ ID NO: 4581 - RNA, 20 nt, Artificial Sequence
  source: /note="Description of Artificial Sequence: Synthetic oligonucleotide"
gaagaugggaaagcagggua

SEQ ID NO: 4582 - RNA, 20 nt, Artificial Sequence
  source: /note="Description of Artificial Sequence: Synthetic oligonucleotide"
gcaugcuauccugaaaauau

SEQ ID NO: 4583 - RNA, 20 nt, Artificial Sequence
  source: /note="Description of Artificial Sequence: Synthetic oligonucleotide"
caugcuauccugaaaauauu

SEQ ID NO: 4584 - RNA, 20 nt, Artificial Sequence
  source: /note="Description of Artificial Sequence: Synthetic oligonucleotide"
augcuauccugaaaauauug

SEQ ID NO: 4585 - RNA, 20 nt, Artificial Sequence
  source: /note="Description of Artificial Sequence: Synthetic oligonucleotide"
auuagagcagaugaguagaa

SEQ ID NO: 4586 - RNA, 20 nt, Artificial Sequence
  source: /note="Description of Artificial Sequence: Synthetic oligonucleotide"
uuuacaaauuuaaacaaaua

SEQ ID NO: 4587 - RNA, 20 nt, Artificial Sequence
  source: /note="Description of Artificial Sequence: Synthetic oligonucleotide"
aauuuaaacaaauaaggaaa

SEQ ID NO: 4588 - RNA, 20 nt, Artificial Sequence
  source: /note="Description of Artificial Sequence: Synthetic oligonucleotide"
uuaaacaaauaaggaaaugg

SEQ ID NO: 4589 - RNA, 20 nt, Artificial Sequence
  source: /note="Description of Artificial Sequence: Synthetic oligonucleotide"
aaggaaauggaggcaguagu

SEQ ID NO: 4590 - RNA, 20 nt, Artificial Sequence
  source: /note="Description of Artificial Sequence: Synthetic oligonucleotide"
ggcaguaguuggaguaauuu

SEQ ID NO: 4591 - RNA, 20 nt, Artificial Sequence
  source: /note="Description of Artificial Sequence: Synthetic oligonucleotide"
uuuaggagauaaauugaaaa

SEQ ID NO: 4592 - RNA, 20 nt, Artificial Sequence
  source: /note="Description of Artificial Sequence: Synthetic oligonucleotide"
auggauuuuguuaagagaga

SEQ ID NO: 4593 - RNA, 20 nt, Artificial Sequence
  source: /note="Description of Artificial Sequence: Synthetic oligonucleotide"
uggauuuuguuaagagagaa

SEQ ID NO: 4594 - RNA, 20 nt, Artificial Sequence
  source: /note="Description of Artificial Sequence: Synthetic oligonucleotide"
gauagauuuuauauauuuua

SEQ ID NO: 4595 - RNA, 20 nt, Artificial Sequence
  source: /note="Description of Artificial Sequence: Synthetic oligonucleotide"
uauuuuaaggaaaaaucaug

SEQ ID NO: 4596 - RNA, 20 nt, Artificial Sequence
  source: /note="Description of Artificial Sequence: Synthetic oligonucleotide"
gcacguaagagauaaaagag

SEQ ID NO: 4597 - RNA, 20 nt, Artificial Sequence
  source: /note="Description of Artificial Sequence: Synthetic oligonucleotide"
caaaaugauuaauuacgugu

SEQ ID NO: 4598 - RNA, 20 nt, Artificial Sequence
  source: /note="Description of Artificial Sequence: Synthetic oligonucleotide"
guguugguauuaaaagaaau

SEQ ID NO: 4599 - RNA, 20 nt, Artificial Sequence
  source: /note="Description of Artificial Sequence: Synthetic oligonucleotide"
uguugguauuaaaagaaaua

SEQ ID NO: 4600 - RNA, 20 nt, Artificial Sequence
  source: /note="Description of Artificial Sequence: Synthetic oligonucleotide"
auuaaaagaaauagggaagu

SEQ ID NO: 4601 - RNA, 20 nt, Artificial Sequence
  source: /note="Description of Artificial Sequence: Synthetic oligonucleotide"
uuaaaagaaauagggaaguu

SEQ ID NO: 4602 - RNA, 20 nt, Artificial Sequence
  source: /note="Description of Artificial Sequence: Synthetic oligonucleotide"
aucagaugcagauauucuua

SEQ ID NO: 4603 - RNA, 20 nt, Artificial Sequence
  source: /note="Description of Artificial Sequence: Synthetic oligonucleotide"
ucauuugauauuugucauau

SEQ ID NO: 4604 - RNA, 20 nt, Artificial Sequence
  source: /note="Description of Artificial Sequence: Synthetic oligonucleotide"
uuuguauuuuuauaauaagu

SEQ ID NO: 4605 - RNA, 20 nt, Artificial Sequence
  source: /note="Description of Artificial Sequence: Synthetic oligonucleotide"
gaaucaaaaaauuauugauu

SEQ ID NO: 4606 - RNA, 20 nt, Artificial Sequence
  source: /note="Description of Artificial Sequence: Synthetic oligonucleotide"
aguccaauuaguucauuuug

SEQ ID NO: 4607 - RNA, 20 nt, Artificial Sequence
  source: /note="Description of Artificial Sequence: Synthetic oligonucleotide"
caauuaguucauuuugugga

SEQ ID NO: 4608 - RNA, 20 nt, Artificial Sequence
  source: /note="Description of Artificial Sequence: Synthetic oligonucleotide"
uucauuuuguggaaggaaaa

SEQ ID NO: 4609 - RNA, 20 nt, Artificial Sequence
  source: /note="Description of Artificial Sequence: Synthetic oligonucleotide"
ccucuagcuaguaucuaacu

SEQ ID NO: 4610 - RNA, 20 nt, Artificial Sequence
  source: /note="Description of Artificial Sequence: Synthetic oligonucleotide"
uaucuaacuuggucuagccc

SEQ ID NO: 4611 - RNA, 20 nt, Artificial Sequence
  source: /note="Description of Artificial Sequence: Synthetic oligonucleotide"
aaauaauaaaaaaguauuag

SEQ ID NO: 4612 - RNA, 20 nt, Artificial Sequence
  source: /note="Description of Artificial Sequence: Synthetic oligonucleotide"
auuagugguuuguauuuugc

SEQ ID NO: 4613 - RNA, 20 nt, Artificial Sequence
  source: /note="Description of Artificial Sequence: Synthetic oligonucleotide"
guauuuugcuggcuugcuug

SEQ ID NO: 4614 - RNA, 20 nt, Artificial Sequence
  source: /note="Description of Artificial Sequence: Synthetic oligonucleotide"
cuggcuugcuuguggagaau

SEQ ID NO: 4615 - RNA, 20 nt, Artificial Sequence
  source: /note="Description of Artificial Sequence: Synthetic oligonucleotide"
uuguggagaauaggauuaga

SEQ ID NO: 4616 - RNA, 20 nt, Artificial Sequence
  source: /note="Description of Artificial Sequence: Synthetic oligonucleotide"
uuuaucuuuucaguaguaua

SEQ ID NO: 4617 - RNA, 20 nt, Artificial Sequence
  source: /note="Description of Artificial Sequence: Synthetic oligonucleotide"
aucuuuucaguaguauaagg

SEQ ID NO: 4618 - RNA, 20 nt, Artificial Sequence
  source: /note="Description of Artificial Sequence: Synthetic oligonucleotide"
agaaaaauagcuuuucuuau

SEQ ID NO: 4619 - RNA, 20 nt, Artificial Sequence
  source: /note="Description of Artificial Sequence: Synthetic oligonucleotide"
ccaaaaaaccaucacccuac

SEQ ID NO: 4620 - RNA, 20 nt, Artificial Sequence
  source: /note="Description of Artificial Sequence: Synthetic oligonucleotide"
uuugcuugauuuuccugauc

SEQ ID NO: 4621 - RNA, 20 nt, Artificial Sequence
  source: /note="Description of Artificial Sequence: Synthetic oligonucleotide"
cuucauuguuacuuccuuac

SEQ ID NO: 4622 - RNA, 20 nt, Artificial Sequence
  source: /note="Description of Artificial Sequence: Synthetic oligonucleotide"
caguuuauucuuugagucac

SEQ ID NO: 4623 - RNA, 20 nt, Artificial Sequence
  source: /note="Description of Artificial Sequence: Synthetic oligonucleotide"
ucuccauuacacaugccaca

SEQ ID NO: 4624 - RNA, 20 nt, Artificial Sequence
  source: /note="Description of Artificial Sequence: Synthetic oligonucleotide"
agcaaaaccacucuuauaca

SEQ ID NO: 4625 - RNA, 20 nt, Artificial Sequence
  source: /note="Description of Artificial Sequence: Synthetic oligonucleotide"
ggugucuugcauauauauua

SEQ ID NO: 4626 - RNA, 20 nt, Artificial Sequence
  source: /note="Description of Artificial Sequence: Synthetic oligonucleotide"
auauauauuaaggcccagag

SEQ ID NO: 4627 - RNA, 20 nt, Artificial Sequence
  source: /note="Description of Artificial Sequence: Synthetic oligonucleotide"
caagacuguugaccuucuug

SEQ ID NO: 4628 - RNA, 20 nt, Artificial Sequence
  source: /note="Description of Artificial Sequence: Synthetic oligonucleotide"
uggcauuuaucugacaaccu

SEQ ID NO: 4629 - RNA, 20 nt, Artificial Sequence
  source: /note="Description of Artificial Sequence: Synthetic oligonucleotide"
guuucaguuuccucaucaaa

SEQ ID NO: 4630 - RNA, 20 nt, Artificial Sequence
  source: /note="Description of Artificial Sequence: Synthetic oligonucleotide"
cagcugccucuguugaucuc

SEQ ID NO: 4631 - RNA, 20 nt, Artificial Sequence
  source: /note="Description of Artificial Sequence: Synthetic oligonucleotide"
caggaucuuuuaaguagaaa

SEQ ID NO: 4632 - RNA, 20 nt, Artificial Sequence
  source: /note="Description of Artificial Sequence: Synthetic oligonucleotide"
gaaaauugcaauguaaauac

SEQ ID NO: 4633 - RNA, 20 nt, Artificial Sequence
  source: /note="Description of Artificial Sequence: Synthetic oligonucleotide"
cucaaaaugugaaaauagua

SEQ ID NO: 4634 - RNA, 20 nt, Artificial Sequence
  source: /note="Description of Artificial Sequence: Synthetic oligonucleotide"
caguuguccuucaguaucug

SEQ ID NO: 4635 - RNA, 20 nt, Artificial Sequence
  source: /note="Description of Artificial Sequence: Synthetic oligonucleotide"
aguuguccuucaguaucugu

SEQ ID NO: 4636 - RNA, 20 nt, Artificial Sequence
  source: /note="Description of Artificial Sequence: Synthetic oligonucleotide"
cuucaguaucugugggagau

SEQ ID NO: 4637 - RNA, 20 nt, Artificial Sequence
  source: /note="Description of Artificial Sequence: Synthetic oligonucleotide"
aucugugggagauugguucc

SEQ ID NO: 4638 - RNA, 20 nt, Artificial Sequence
  source: /note="Description of Artificial Sequence: Synthetic oligonucleotide"
auugguuccaggacccccca

SEQ ID NO: 4639 - RNA, 20 nt, Artificial Sequence
  source: /note="Description of Artificial Sequence: Synthetic oligonucleotide"
cccauggauaucaaaaucug

SEQ ID NO: 4640 - RNA, 20 nt, Artificial Sequence
  source: /note="Description of Artificial Sequence: Synthetic oligonucleotide"
guuauuacacuguauuguuu

SEQ ID NO: 4641 - RNA, 20 nt, Artificial Sequence
  source: /note="Description of Artificial Sequence: Synthetic oligonucleotide"
uuauuacacuguauuguuua

SEQ ID NO: 4642 - RNA, 20 nt, Artificial Sequence
  source: /note="Description of Artificial Sequence: Synthetic oligonucleotide"
uugauugaauccacagaugc

SEQ ID NO: 4643 - RNA, 20 nt, Artificial Sequence
  source: /note="Description of Artificial Sequence: Synthetic oligonucleotide"
cuggaauccaugaauaccca

SEQ ID NO: 4644 - RNA, 20 nt, Artificial Sequence
  source: /note="Description of Artificial Sequence: Synthetic oligonucleotide"
uggaauccaugaauacccau

SEQ ID NO: 4645 - RNA, 20 nt, Artificial Sequence
  source: /note="Description of Artificial Sequence: Synthetic oligonucleotide"
ggaauccaugaauacccaug

SEQ ID NO: 4646 - RNA, 20 nt, Artificial Sequence
  source: /note="Description of Artificial Sequence: Synthetic oligonucleotide"
gaauccaugaauacccaugg

SEQ ID NO: 4647 - RNA, 20 nt, Artificial Sequence
  source: /note="Description of Artificial Sequence: Synthetic oligonucleotide"
aauccaugaauacccauggg

SEQ ID NO: 4648 - RNA, 20 nt, Artificial Sequence
  source: /note="Description of Artificial Sequence: Synthetic oligonucleotide"
aauuuuguaauucucaacca

SEQ ID NO: 4649 - RNA, 20 nt, Artificial Sequence
  source: /note="Description of Artificial Sequence: Synthetic oligonucleotide"
cacguauaguccuugaaucu

SEQ ID NO: 4650 - RNA, 20 nt, Artificial Sequence
  source: /note="Description of Artificial Sequence: Synthetic oligonucleotide"
uauaguccuugaaucuuggu

SEQ ID NO: 4651 - RNA, 20 nt, Artificial Sequence
  source: /note="Description of Artificial Sequence: Synthetic oligonucleotide"
uugaaucuugguaggagucu

SEQ ID NO: 4652 - RNA, 20 nt, Artificial Sequence
  source: /note="Description of Artificial Sequence: Synthetic oligonucleotide"
ugaaucuugguaggagucuu

SEQ ID NO: 4653 - RNA, 20 nt, Artificial Sequence
  source: /note="Description of Artificial Sequence: Synthetic oligonucleotide"
gaaucuugguaggagucuug

SEQ ID NO: 4654 - RNA, 20 nt, Artificial Sequence
  source: /note="Description of Artificial Sequence: Synthetic oligonucleotide"
ucuuaauauccuuucuuuua

SEQ ID NO: 4655 - RNA, 20 nt, Artificial Sequence
  source: /note="Description of Artificial Sequence: Synthetic oligonucleotide"
cccauuucagacuuuauuaa

SEQ ID NO: 4656 - RNA, 20 nt, Artificial Sequence
  source: /note="Description of Artificial Sequence: Synthetic oligonucleotide"
uucagacuuuauuaaaggag

SEQ ID NO: 4657 - RNA, 20 nt, Artificial Sequence
  source: /note="Description of Artificial Sequence: Synthetic oligonucleotide"
ugaaguuuuugcaauuagaa

SEQ ID NO: 4658 - RNA, 20 nt, Artificial Sequence
  source: /note="Description of Artificial Sequence: Synthetic oligonucleotide"
caauuagaauggaguuuauu

SEQ ID NO: 4659 - RNA, 20 nt, Artificial Sequence
  source: /note="Description of Artificial Sequence: Synthetic oligonucleotide"
uagaugugauguagaauucu

SEQ ID NO: 4660 - RNA, 20 nt, Artificial Sequence
  source: /note="Description of Artificial Sequence: Synthetic oligonucleotide"
agaugugauguagaauucuu

SEQ ID NO: 4661 - RNA, 20 nt, Artificial Sequence
  source: /note="Description of Artificial Sequence: Synthetic oligonucleotide"
gaugugauguagaauucuug

SEQ ID NO: 4662 - RNA, 20 nt, Artificial Sequence
  source: /note="Description of Artificial Sequence: Synthetic oligonucleotide"
uacuuauccccuuuucagag

SEQ ID NO: 4663 - RNA, 20 nt, Artificial Sequence
  source: /note="Description of Artificial Sequence: Synthetic oligonucleotide"
cugaauagcucugugaaccc

SEQ ID NO: 4664 - RNA, 20 nt, Artificial Sequence
  source: /note="Description of Artificial Sequence: Synthetic oligonucleotide"
uaugcuugauauuccugauc

SEQ ID NO: 4665 - RNA, 20 nt, Artificial Sequence
  source: /note="Description of Artificial Sequence: Synthetic oligonucleotide"
gauauuccugaucuggcucc

SEQ ID NO: 4666 - RNA, 20 nt, Artificial Sequence
  source: /note="Description of Artificial Sequence: Synthetic oligonucleotide"
cacagcucagauuucucaua

SEQ ID NO: 4667 - RNA, 20 nt, Artificial Sequence
  source: /note="Description of Artificial Sequence: Synthetic oligonucleotide"
acagcucagauuucucauaa

SEQ ID NO: 4668 - RNA, 20 nt, Artificial Sequence
  source: /note="Description of Artificial Sequence: Synthetic oligonucleotide"
gggaagcuucauauuuguug

SEQ ID NO: 4669 - RNA, 20 nt, Artificial Sequence
  source: /note="Description of Artificial Sequence: Synthetic oligonucleotide"
uugcagauucugaaauuccu

SEQ ID NO: 4670 - RNA, 20 nt, Artificial Sequence
  source: /note="Description of Artificial Sequence: Synthetic oligonucleotide"
ugcagauucugaaauuccua

SEQ ID NO: 4671 - RNA, 20 nt, Artificial Sequence
  source: /note="Description of Artificial Sequence: Synthetic oligonucleotide"
uucugaaauuccuagggcaa

SEQ ID NO: 4672 - RNA, 20 nt, Artificial Sequence
  source: /note="Description of Artificial Sequence: Synthetic oligonucleotide"
cuaauauuuuacacaguauc

SEQ ID NO: 4673 - RNA, 20 nt, Artificial Sequence
  source: /note="Description of Artificial Sequence: Synthetic oligonucleotide"
acaguaucugguuacauagu

SEQ ID NO: 4674 - RNA, 20 nt, Artificial Sequence
  source: /note="Description of Artificial Sequence: Synthetic oligonucleotide"
aucauacaauuuaaaagaag

SEQ ID NO: 4675 - RNA, 20 nt, Artificial Sequence
  source: /note="Description of Artificial Sequence: Synthetic oligonucleotide"
uuauuucccucucccccuac

SEQ ID NO: 4676 - RNA, 20 nt, Artificial Sequence
  source: /note="Description of Artificial Sequence: Synthetic oligonucleotide"
uacagcacuugcccacuaag

SEQ ID NO: 4677 - RNA, 20 nt, Artificial Sequence
  source: /note="Description of Artificial Sequence: Synthetic oligonucleotide"
agcacuugcccacuaagugg

SEQ ID NO: 4678 - RNA, 20 nt, Artificial Sequence
  source: /note="Description of Artificial Sequence: Synthetic oligonucleotide"
gcacuugcccacuaagugga

SEQ ID NO: 4679 - RNA, 20 nt, Artificial Sequence
  source: /note="Description of Artificial Sequence: Synthetic oligonucleotide"
gcccacuaaguggagggaag

SEQ ID NO: 4680 - RNA, 20 nt, Artificial Sequence
  source: /note="Description of Artificial Sequence: Synthetic oligonucleotide"
cuaaguggagggaagaggug

SEQ ID NO: 4681 - RNA, 20 nt, Artificial Sequence
  source: /note="Description of Artificial Sequence: Synthetic oligonucleotide"
uaaguggagggaagaggugu

SEQ ID NO: 4682 - RNA, 20 nt, Artificial Sequence
  source: /note="Description of Artificial Sequence: Synthetic oligonucleotide"
aggugugggagucgaguagu

SEQ ID NO: 4683 - RNA, 20 nt, Artificial Sequence
  source: /note="Description of Artificial Sequence: Synthetic oligonucleotide"
uuugcaaaguuacauuauau

SEQ ID NO: 4684 - RNA, 20 nt, Artificial Sequence
  source: /note="Description of Artificial Sequence: Synthetic oligonucleotide"
uuaauuauaagcaacacuug

SEQ ID NO: 4685 - RNA, 20 nt, Artificial Sequence
  source: /note="Description of Artificial Sequence: Synthetic oligonucleotide"
uguugcaguugagauuugug

SEQ ID NO: 4686 - RNA, 20 nt, Artificial Sequence
  source: /note="Description of Artificial Sequence: Synthetic oligonucleotide"
uuuagcuauuuagagacuuu

SEQ ID NO: 4687 - RNA, 20 nt, Artificial Sequence
  source: /note="Description of Artificial Sequence: Synthetic oligonucleotide"
uuagcuauuuagagacuuua

SEQ ID NO: 4688 - RNA, 20 nt, Artificial Sequence
  source: /note="Description of Artificial Sequence: Synthetic oligonucleotide"
aaugauauuugaugucuauu

SEQ ID NO: 4689 - RNA, 20 nt, Artificial Sequence
  source: /note="Description of Artificial Sequence: Synthetic oligonucleotide"
uuuucuuauccagcaguuuu

SEQ ID NO: 4690 - RNA, 20 nt, Artificial Sequence
  source: /note="Description of Artificial Sequence: Synthetic oligonucleotide"
acugucagagaagcagaaag

SEQ ID NO: 4691 - RNA, 20 nt, Artificial Sequence
  source: /note="Description of Artificial Sequence: Synthetic oligonucleotide"
gagaagcagaaaguggucag

SEQ ID NO: 4692 - RNA, 20 nt, Artificial Sequence
  source: /note="Description of Artificial Sequence: Synthetic oligonucleotide"
gucaguggacuuuagaaugu

SEQ ID NO: 4693 - RNA, 20 nt, Artificial Sequence
  source: /note="Description of Artificial Sequence: Synthetic oligonucleotide"
uuuagaauguaggcucuugu

SEQ ID NO: 4694 - RNA, 20 nt, Artificial Sequence
  source: /note="Description of Artificial Sequence: Synthetic oligonucleotide"
agaauguaggcucuuguagg

SEQ ID NO: 4695 - RNA, 20 nt, Artificial Sequence
  source: /note="Description of Artificial Sequence: Synthetic oligonucleotide"
uauguuugagagugcugucc

SEQ ID NO: 4696 - RNA, 20 nt, Artificial Sequence
  source: /note="Description of Artificial Sequence: Synthetic oligonucleotide"
uguccaggugcuuugugaug

SEQ ID NO: 4697 - RNA, 20 nt, Artificial Sequence
  source: /note="Description of Artificial Sequence: Synthetic oligonucleotide"
cuuugugauguggcugagaa

SEQ ID NO: 4698 - RNA, 20 nt, Artificial Sequence
  source: /note="Description of Artificial Sequence: Synthetic oligonucleotide"
auguggcugagaauggaugc

SEQ ID NO: 4699 - RNA, 20 nt, Artificial Sequence
  source: /note="Description of Artificial Sequence: Synthetic oligonucleotide"
gagaauggaugcaggcuugc

SEQ ID NO: 4700 - RNA, 20 nt, Artificial Sequence
  source: /note="Description of Artificial Sequence: Synthetic oligonucleotide"
agaauggaugcaggcuugca

SEQ ID NO: 4701 - RNA, 20 nt, Artificial Sequence
  source: /note="Description of Artificial Sequence: Synthetic oligonucleotide"
agaucucuagagagcauuuu

SEQ ID NO: 4702 - RNA, 20 nt, Artificial Sequence
  source: /note="Description of Artificial Sequence: Synthetic oligonucleotide"
aggaaagacuucuaagcuuu

SEQ ID NO: 4703 - RNA, 20 nt, Artificial Sequence
  source: /note="Description of Artificial Sequence: Synthetic oligonucleotide"
cuuaauauccauagcuauag

SEQ ID NO: 4704 - RNA, 20 nt, Artificial Sequence
  source: /note="Description of Artificial Sequence: Synthetic oligonucleotide"
aaauguagaauuaaauauuu

SEQ ID NO: 4705 - RNA, 20 nt, Artificial Sequence
  source: /note="Description of Artificial Sequence: Synthetic oligonucleotide"
uaaugaaauauaaaaccaga

SEQ ID NO: 4706 - RNA, 20 nt, Artificial Sequence
  source: /note="Description of Artificial Sequence: Synthetic oligonucleotide"
aaaaccagauggucucugaa

SEQ ID NO: 4707 - RNA, 20 nt, Artificial Sequence
  source: /note="Description of Artificial Sequence: Synthetic oligonucleotide"
cuuuacucacuuucagagua

SEQ ID NO: 4708 - RNA, 20 nt, Artificial Sequence
  source: /note="Description of Artificial Sequence: Synthetic oligonucleotide"
cucacuuucagaguaaggca

SEQ ID NO: 4709 - RNA, 20 nt, Artificial Sequence
  source: /note="Description of Artificial Sequence: Synthetic oligonucleotide"
aguauuuaauaaauguuuuu

SEQ ID NO: 4710 - RNA, 20 nt, Artificial Sequence
  source: /note="Description of Artificial Sequence: Synthetic oligonucleotide"
guauuuaauaaauguuuuuu

SEQ ID NO: 4711 - RNA, 20 nt, Artificial Sequence
  source: /note="Description of Artificial Sequence: Synthetic oligonucleotide"
uaauaaauguuuuuugggcc

SEQ ID NO: 4712 - RNA, 20 nt, Artificial Sequence
  source: /note="Description of Artificial Sequence: Synthetic oligonucleotide"
aauguuuuuugggccaggug

SEQ ID NO: 4713 - RNA, 20 nt, Artificial Sequence
  source: /note="Description of Artificial Sequence: Synthetic oligonucleotide"
cuccuguaaucccagcaauu

SEQ ID NO: 4714 - RNA, 20 nt, Artificial Sequence
  source: /note="Description of Artificial Sequence: Synthetic oligonucleotide"
uccuguaaucccagcaauuu

SEQ ID NO: 4715 - RNA, 20 nt, Artificial Sequence
  source: /note="Description of Artificial Sequence: Synthetic oligonucleotide"
uguaaucccagcaauuuggg

SEQ ID NO: 4716 - RNA, 20 nt, Artificial Sequence
  source: /note="Description of Artificial Sequence: Synthetic oligonucleotide"
cccagcaauuugggaggccg

SEQ ID NO: 4717 - RNA, 20 nt, Artificial Sequence
  source: /note="Description of Artificial Sequence: Synthetic oligonucleotide"
agcaauuugggaggccgagg

SEQ ID NO: 4718 - RNA, 20 nt, Artificial Sequence
  source: /note="Description of Artificial Sequence: Synthetic oligonucleotide"
gcaauuugggaggccgaggc

SEQ ID NO: 4719 - RNA, 20 nt, Artificial Sequence
  source: /note="Description of Artificial Sequence: Synthetic oligonucleotide"
auuugggaggccgaggcggg

SEQ ID NO: 4720 - RNA, 20 nt, Artificial Sequence
  source: /note="Description of Artificial Sequence: Synthetic oligonucleotide"
cgaggcggguggaucaccug

SEQ ID NO: 4721 - RNA, 20 nt, Artificial Sequence
  source: /note="Description of Artificial Sequence: Synthetic oligonucleotide"
ugagaccagccugaccagua

SEQ ID NO: 4722 - RNA, 20 nt, Artificial Sequence
  source: /note="Description of Artificial Sequence: Synthetic oligonucleotide"
acuaaaaaugcaaaauuagc

SEQ ID NO: 4723 - RNA, 20 nt, Artificial Sequence
  source: /note="Description of Artificial Sequence: Synthetic oligonucleotide"
cuaaaaaugcaaaauuagcu

SEQ ID NO: 4724 - RNA, 20 nt, Artificial Sequence
  source: /note="Description of Artificial Sequence: Synthetic oligonucleotide"
uaaaaaugcaaaauuagcug

SEQ ID NO: 4725 - RNA, 20 nt, Artificial Sequence
  source: /note="Description of Artificial Sequence: Synthetic oligonucleotide"
aaaaaugcaaaauuagcugg

SEQ ID NO: 4726 - RNA, 20 nt, Artificial Sequence
  source: /note="Description of Artificial Sequence: Synthetic oligonucleotide"
aaugcaaaauuagcuggggg

SEQ ID NO: 4727 - RNA, 20 nt, Artificial Sequence
  source: /note="Description of Artificial Sequence: Synthetic oligonucleotide"
gcaaaauuagcugggggugg

SEQ ID NO: 4728 - RNA, 20 nt, Artificial Sequence
  source: /note="Description of Artificial Sequence: Synthetic oligonucleotide"
ugccuauaauaccagcuacu

SEQ ID NO: 4729 - RNA, 20 nt, Artificial Sequence
  source: /note="Description of Artificial Sequence: Synthetic oligonucleotide"
gccuauaauaccagcuacuc

SEQ ID NO: 4730 - RNA, 20 nt, Artificial Sequence
  source: /note="Description of Artificial Sequence: Synthetic oligonucleotide"
uauaauaccagcuacucggg

SEQ ID NO: 4731 - RNA, 20 nt, Artificial Sequence
  source: /note="Description of Artificial Sequence: Synthetic oligonucleotide"
accagcuacucgggaggcug

SEQ ID NO: 4732 - RNA, 20 nt, Artificial Sequence
  source: /note="Description of Artificial Sequence: Synthetic oligonucleotide"
gcuacucgggaggcugaggc

SEQ ID NO: 4733 - RNA, 20 nt, Artificial Sequence
  source: /note="Description of Artificial Sequence: Synthetic oligonucleotide"
cuacucgggaggcugaggca

SEQ ID NO: 4734 - RNA, 20 nt, Artificial Sequence
  source: /note="Description of Artificial Sequence: Synthetic oligonucleotide"
uacucgggaggcugaggcag

SEQ ID NO: 4735 - RNA, 20 nt, Artificial Sequence
  source: /note="Description of Artificial Sequence: Synthetic oligonucleotide"
caggggaaucgcuugaacuc

SEQ ID NO: 4736 - RNA, 20 nt, Artificial Sequence
  source: /note="Description of Artificial Sequence: Synthetic oligonucleotide"
gggaaucgcuugaacucagg

SEQ ID NO: 4737 - RNA, 20 nt, Artificial Sequence
  source: /note="Description of Artificial Sequence: Synthetic oligonucleotide"
aaucgcuugaacucaggagg

SEQ ID NO: 4738 - RNA, 20 nt, Artificial Sequence
  source: /note="Description of Artificial Sequence: Synthetic oligonucleotide"
cgcuugaacucaggaggugg

SEQ ID NO: 4739 - RNA, 20 nt, Artificial Sequence
  source: /note="Description of Artificial Sequence: Synthetic oligonucleotide"
aaugcuuuuugauuuaacga

SEQ ID NO: 4740 - RNA, 20 nt, Artificial Sequence
  source: /note="Description of Artificial Sequence: Synthetic oligonucleotide"
ggugucauuguccuaugaaa

SEQ ID NO: 4741 - RNA, 20 nt, Artificial Sequence
  source: /note="Description of Artificial Sequence: Synthetic oligonucleotide"
cuuagcuuuugauaaugaua

SEQ ID NO: 4742 - RNA, 20 nt, Artificial Sequence
  source: /note="Description of Artificial Sequence: Synthetic oligonucleotide"
aaauauuugagaccaguuaa

SEQ ID NO: 4743 - RNA, 20 nt, Artificial Sequence
  source: /note="Description of Artificial Sequence: Synthetic oligonucleotide"
gaccaguuaaaggagacaga

SEQ ID NO: 4744 - RNA, 20 nt, Artificial Sequence
  source: /note="Description of Artificial Sequence: Synthetic oligonucleotide"
aaggagacagaaggaaguua

SEQ ID NO: 4745 - RNA, 20 nt, Artificial Sequence
  source: /note="Description of Artificial Sequence: Synthetic oligonucleotide"
gaagcaguagccagaaaaua

SEQ ID NO: 4746 - RNA, 20 nt, Artificial Sequence
  source: /note="Description of Artificial Sequence: Synthetic oligonucleotide"
aagcaguagccagaaaauaa

SEQ ID NO: 4747 - RNA, 20 nt, Artificial Sequence
  source: /note="Description of Artificial Sequence: Synthetic oligonucleotide"
aaauugcuauuauuaucauc

SEQ ID NO: 4748 - RNA, 20 nt, Artificial Sequence
  source: /note="Description of Artificial Sequence: Synthetic oligonucleotide"
cuggaaaaaauaugccuugu

SEQ ID NO: 4749 - RNA, 20 nt, Artificial Sequence
  source: /note="Description of Artificial Sequence: Synthetic oligonucleotide"
auucccuuuccauaccaugc

SEQ ID NO: 4750 - RNA, 20 nt, Artificial Sequence
  source: /note="Description of Artificial Sequence: Synthetic oligonucleotide"
uucuuuacugcauuccuaag

SEQ ID NO: 4751 - RNA, 20 nt, Artificial Sequence
  source: /note="Description of Artificial Sequence: Synthetic oligonucleotide"
ggacuagucuagcaccuaau

SEQ ID NO: 4752 - RNA, 20 nt, Artificial Sequence
  source: /note="Description of Artificial Sequence: Synthetic oligonucleotide"
agcaccuaauuggauacuug

SEQ ID NO: 4753 - RNA, 20 nt, Artificial Sequence
  source: /note="Description of Artificial Sequence: Synthetic oligonucleotide"
uggauacuugugguaauauu

SEQ ID NO: 4754 - RNA, 20 nt, Artificial Sequence
  source: /note="Description of Artificial Sequence: Synthetic oligonucleotide"
ggauacuugugguaauauuu

SEQ ID NO: 4755 - RNA, 20 nt, Artificial Sequence
  source: /note="Description of Artificial Sequence: Synthetic oligonucleotide"
uauuugggaacucacugauc

SEQ ID NO: 4756 - RNA, 20 nt, Artificial Sequence
  source: /note="Description of Artificial Sequence: Synthetic oligonucleotide"
acugaucugguacaucagug

SEQ ID NO: 4757 - RNA, 20 nt, Artificial Sequence
  source: /note="Description of Artificial Sequence: Synthetic oligonucleotide"
cugaucugguacaucagugu

SEQ ID NO: 4758 - RNA, 20 nt, Artificial Sequence
  source: /note="Description of Artificial Sequence: Synthetic oligonucleotide"
uguugcaguugagaguugug

SEQ ID NO: 4759 - RNA, 20 nt, Artificial Sequence
  source: /note="Description of Artificial Sequence: Synthetic oligonucleotide"
guugugagguuuuagcuauu

SEQ ID NO: 4760 - RNA, 20 nt, Artificial Sequence
  source: /note="Description of Artificial Sequence: Synthetic oligonucleotide"
uuuagcuauuuggaaacuuu

SEQ ID NO: 4761 - RNA, 20 nt, Artificial Sequence
  source: /note="Description of Artificial Sequence: Synthetic oligonucleotide"
uuagcuauuuggaaacuuua

SEQ ID NO: 4762 - RNA, 20 nt, Artificial Sequence
  source: /note="Description of Artificial Sequence: Synthetic oligonucleotide"
gagcaagaaucugucacucu

SEQ ID NO: 4763 - RNA, 20 nt, Artificial Sequence
  source: /note="Description of Artificial Sequence: Synthetic oligonucleotide"
uacucuuuauuaaagaaugu

SEQ ID NO: 4764 - RNA, 20 nt, Artificial Sequence
  source: /note="Description of Artificial Sequence: Synthetic oligonucleotide"
uggauucauuuauaacuuac

SEQ ID NO: 4765 - RNA, 20 nt, Artificial Sequence
  source: /note="Description of Artificial Sequence: Synthetic oligonucleotide"
gucccuuaaauauuaaaguu

SEQ ID NO: 4766 - RNA, 20 nt, Artificial Sequence
  source: /note="Description of Artificial Sequence: Synthetic oligonucleotide"
aaauauuaaaguuugguguu

SEQ ID NO: 4767 - RNA, 20 nt, Artificial Sequence
  source: /note="Description of Artificial Sequence: Synthetic oligonucleotide"
aaacaugauuacauccuuau

SEQ ID NO: 4768 - RNA, 20 nt, Artificial Sequence
  source: /note="Description of Artificial Sequence: Synthetic oligonucleotide"
aacaugauuacauccuuaua

SEQ ID NO: 4769 - RNA, 20 nt, Artificial Sequence
  source: /note="Description of Artificial Sequence: Synthetic oligonucleotide"
agggcucucuucuaauugcc

SEQ ID NO: 4770 - RNA, 20 nt, Artificial Sequence
  source: /note="Description of Artificial Sequence: Synthetic oligonucleotide"
acauugaaguuaguccgcaa

SEQ ID NO: 4771 - RNA, 20 nt, Artificial Sequence
  source: /note="Description of Artificial Sequence: Synthetic oligonucleotide"
aagguuuuugucuuuuuuuc

SEQ ID NO: 4772 - RNA, 20 nt, Artificial Sequence
  source: /note="Description of Artificial Sequence: Synthetic oligonucleotide"
gugauuuucuaaauaaaugu

SEQ ID NO: 4773 - RNA, 20 nt, Artificial Sequence
  source: /note="Description of Artificial Sequence: Synthetic oligonucleotide"
uucuucaagucccuccuuua

SEQ ID NO: 4774 - RNA, 20 nt, Artificial Sequence
  source: /note="Description of Artificial Sequence: Synthetic oligonucleotide"
cccuccuuuaaggaaauuua

SEQ ID NO: 4775 - RNA, 20 nt, Artificial Sequence
  source: /note="Description of Artificial Sequence: Synthetic oligonucleotide"
ucuuuuuccauaccaucaag

SEQ ID NO: 4776 - RNA, 20 nt, Artificial Sequence
  source: /note="Description of Artificial Sequence: Synthetic oligonucleotide"
uaacuuuuuuccuuaaguuc

SEQ ID NO: 4777 - RNA, 20 nt, Artificial Sequence
  source: /note="Description of Artificial Sequence: Synthetic oligonucleotide"
aaguucaggaguacacgugc

SEQ ID NO: 4778 - RNA, 20 nt, Artificial Sequence
  source: /note="Description of Artificial Sequence: Synthetic oligonucleotide"
cacgugcagguuuguugcau

SEQ ID NO: 4779 - RNA, 20 nt, Artificial Sequence
  source: /note="Description of Artificial Sequence: Synthetic oligonucleotide"
guuuguugcauaggcaaccu

SEQ ID NO: 4780 - RNA, 20 nt, Artificial Sequence
  source: /note="Description of Artificial Sequence: Synthetic oligonucleotide"
uuuguugcauaggcaaccuu

SEQ ID NO: 4781 - RNA, 20 nt, Artificial Sequence
  source: /note="Description of Artificial Sequence: Synthetic oligonucleotide"
gcauaggcaaccuuggguca

SEQ ID NO: 4782 - RNA, 20 nt, Artificial Sequence
  source: /note="Description of Artificial Sequence: Synthetic oligonucleotide"
cauaggcaaccuugggucau

SEQ ID NO: 4783 - RNA, 20 nt, Artificial Sequence
  source: /note="Description of Artificial Sequence: Synthetic oligonucleotide"
gucaugggaguuuguuguac

SEQ ID NO: 4784 - RNA, 20 nt, Artificial Sequence
  source: /note="Description of Artificial Sequence: Synthetic oligonucleotide"
uacagguuauuucaucaccc

SEQ ID NO: 4785 - RNA, 20 nt, Artificial Sequence
  source: /note="Description of Artificial Sequence: Synthetic oligonucleotide"
cccacccuccacccucugau

SEQ ID NO: 4786 - RNA, 20 nt, Artificial Sequence
  source: /note="Description of Artificial Sequence: Synthetic oligonucleotide"
cuccacccucugauaggccc

SEQ ID NO: 4787 - RNA, 20 nt, Artificial Sequence
  source: /note="Description of Artificial Sequence: Synthetic oligonucleotide"
aagugagaacaugcaguauu

SEQ ID NO: 4788 - RNA, 20 nt, Artificial Sequence
  source: /note="Description of Artificial Sequence: Synthetic oligonucleotide"
guuccuauguuaguuugcua

SEQ ID NO: 4789 - RNA, 20 nt, Artificial Sequence
  source: /note="Description of Artificial Sequence: Synthetic oligonucleotide"
uguuaguuugcuauggauaa

SEQ ID NO: 4790 - RNA, 20 nt, Artificial Sequence
  source: /note="Description of Artificial Sequence: Synthetic oligonucleotide"
caugaucuuauucucuuaua

SEQ ID NO: 4791 - RNA, 20 nt, Artificial Sequence
  source: /note="Description of Artificial Sequence: Synthetic oligonucleotide"
uauggcugcauguuauucca

SEQ ID NO: 4792 - RNA, 20 nt, Artificial Sequence
  source: /note="Description of Artificial Sequence: Synthetic oligonucleotide"
uuuuuuauccagucuauuau

SEQ ID NO: 4793 - RNA, 20 nt, Artificial Sequence
  source: /note="Description of Artificial Sequence: Synthetic oligonucleotide"
uuuauccagucuauuauugg

SEQ ID NO: 4794 - RNA, 20 nt, Artificial Sequence
  source: /note="Description of Artificial Sequence: Synthetic oligonucleotide"
uuauccagucuauuauuggu

SEQ ID NO: 4795 - RNA, 20 nt, Artificial Sequence
  source: /note="Description of Artificial Sequence: Synthetic oligonucleotide"
ucuauuauuggugggcauuu

SEQ ID NO: 4796 - RNA, 20 nt, Artificial Sequence
  source: /note="Description of Artificial Sequence: Synthetic oligonucleotide"
augucuuugcuauugugaau

SEQ ID NO: 4797 - RNA, 20 nt, Artificial Sequence
  source: /note="Description of Artificial Sequence: Synthetic oligonucleotide"
agaauaauuuuuuuuuccuu

SEQ ID NO: 4798 - RNA, 20 nt, Artificial Sequence
  source: /note="Description of Artificial Sequence: Synthetic oligonucleotide"
cuuugguauauacccaguag

SEQ ID NO: 4799 - RNA, 20 nt, Artificial Sequence
  source: /note="Description of Artificial Sequence: Synthetic oligonucleotide"
uuugguauauacccaguagu

SEQ ID NO: 4800 - RNA, 20 nt, Artificial Sequence
  source: /note="Description of Artificial Sequence: Synthetic oligonucleotide"
uugguauauacccaguagug

SEQ ID NO: 4801 - RNA, 20 nt, Artificial Sequence
  source: /note="Description of Artificial Sequence: Synthetic oligonucleotide"
auacccaguagugggguugc

SEQ ID NO: 4802 - RNA, 20 nt, Artificial Sequence
  source: /note="Description of Artificial Sequence: Synthetic oligonucleotide"
uacccaguagugggguugcu

SEQ ID NO: 4803 - RNA, 20 nt, Artificial Sequence
  source: /note="Description of Artificial Sequence: Synthetic oligonucleotide"
ugaauaguauuucugucuug

SEQ ID NO: 4804 - RNA, 20 nt, Artificial Sequence
  source: /note="Description of Artificial Sequence: Synthetic oligonucleotide"
uuucugucuugaggucuuug

SEQ ID NO: 4805 - RNA, 20 nt, Artificial Sequence
  source: /note="Description of Artificial Sequence: Synthetic oligonucleotide"
cgcuacacugucuuccacaa

SEQ ID NO: 4806 - RNA, 20 nt, Artificial Sequence
  source: /note="Description of Artificial Sequence: Synthetic oligonucleotide"
uuaauaauagccguccugac

SEQ ID NO: 4807 - RNA, 20 nt, Artificial Sequence
  source: /note="Description of Artificial Sequence: Synthetic oligonucleotide"
ccguccugacuggugugaga

SEQ ID NO: 4808 - RNA, 20 nt, Artificial Sequence
  source: /note="Description of Artificial Sequence: Synthetic oligonucleotide"
ugugagaugguaucucauug

SEQ ID NO: 4809 - RNA, 20 nt, Artificial Sequence
  source: /note="Description of Artificial Sequence: Synthetic oligonucleotide"
gcuuuauuucauauguuugu

SEQ ID NO: 4810 - RNA, 20 nt, Artificial Sequence
  source: /note="Description of Artificial Sequence: Synthetic oligonucleotide"
uccuuugcccacuuuuucaa

SEQ ID NO: 4811 - RNA, 20 nt, Artificial Sequence
  source: /note="Description of Artificial Sequence: Synthetic oligonucleotide"
ccuuugcccacuuuuucaau

SEQ ID NO: 4812 - RNA, 20 nt, Artificial Sequence
  source: /note="Description of Artificial Sequence: Synthetic oligonucleotide"
cuuugcccacuuuuucaaug

SEQ ID NO: 4813 - RNA, 20 nt, Artificial Sequence
  source: /note="Description of Artificial Sequence: Synthetic oligonucleotide"
uuuaagauccuuauagaugc

SEQ ID NO: 4814 - RNA, 20 nt, Artificial Sequence
  source: /note="Description of Artificial Sequence: Synthetic oligonucleotide"
aaauuuuucucccauucugu

SEQ ID NO: 4815 - RNA, 20 nt, Artificial Sequence
  source: /note="Description of Artificial Sequence: Synthetic oligonucleotide"
ugugaauuuuugcuaugaac

SEQ ID NO: 4816 - RNA, 20 nt, Artificial Sequence
  source: /note="Description of Artificial Sequence: Synthetic oligonucleotide"
uauguuuaauuuuaacuccc

SEQ ID NO: 4817 - RNA, 20 nt, Artificial Sequence
  source: /note="Description of Artificial Sequence: Synthetic oligonucleotide"
uguuuuuguuuuuguuuuuu

SEQ ID NO: 4818 - RNA, 20 nt, Artificial Sequence
  source: /note="Description of Artificial Sequence: Synthetic oligonucleotide"
uguuuuuguuuuuuuggaga

SEQ ID NO: 4819 - RNA, 20 nt, Artificial Sequence
  source: /note="Description of Artificial Sequence: Synthetic oligonucleotide"
gucucacgcugucaccaguc

SEQ ID NO: 4820 - RNA, 20 nt, Artificial Sequence
  source: /note="Description of Artificial Sequence: Synthetic oligonucleotide"
gcugucaccagucuggagug

SEQ ID NO: 4821 - RNA, 20 nt, Artificial Sequence
  source: /note="Description of Artificial Sequence: Synthetic oligonucleotide"
ggaguguggugauacaaucu

SEQ ID NO: 4822 - RNA, 20 nt, Artificial Sequence
  source: /note="Description of Artificial Sequence: Synthetic oligonucleotide"
ucauugcaaccuccacauuc

SEQ ID NO: 4823 - RNA, 20 nt, Artificial Sequence
  source: /note="Description of Artificial Sequence: Synthetic oligonucleotide"
cauugcaaccuccacauucc

SEQ ID NO: 4824 - RNA, 20 nt, Artificial Sequence
  source: /note="Description of Artificial Sequence: Synthetic oligonucleotide"
gccucagccuccugaguagc

SEQ ID NO: 4825 - RNA, 20 nt, Artificial Sequence
  source: /note="Description of Artificial Sequence: Synthetic oligonucleotide"
ccucagccuccugaguagcu

SEQ ID NO: 4826 - RNA, 20 nt, Artificial Sequence
  source: /note="Description of Artificial Sequence: Synthetic oligonucleotide"
uccugaguagcugggacuac

SEQ ID NO: 4827 - RNA, 20 nt, Artificial Sequence
  source: /note="Description of Artificial Sequence: Synthetic oligonucleotide"
uuuuguauuuuuaguaaaga

SEQ ID NO: 4828 - RNA, 20 nt, Artificial Sequence
  source: /note="Description of Artificial Sequence: Synthetic oligonucleotide"
uuuguauuuuuaguaaagau

SEQ ID NO: 4829 - RNA, 20 nt, Artificial Sequence
  source: /note="Description of Artificial Sequence: Synthetic oligonucleotide"
uuguauuuuuaguaaagaug

SEQ ID NO: 4830 - RNA, 20 nt, Artificial Sequence
  source: /note="Description of Artificial Sequence: Synthetic oligonucleotide"
aagaugggguuucaccaugu

SEQ ID NO: 4831 - RNA, 20 nt, Artificial Sequence
  source: /note="Description of Artificial Sequence: Synthetic oligonucleotide"
gggguuucaccauguuggcc

SEQ ID NO: 4832 - RNA, 20 nt, Artificial Sequence
  source: /note="Description of Artificial Sequence: Synthetic oligonucleotide"
uuucaccauguuggccagga

SEQ ID NO: 4833 - RNA, 20 nt, Artificial Sequence
  source: /note="Description of Artificial Sequence: Synthetic oligonucleotide"
gccucagccucccaaagugc

SEQ ID NO: 4834 - RNA, 20 nt, Artificial Sequence
  source: /note="Description of Artificial Sequence: Synthetic oligonucleotide"
ccucagccucccaaagugcu

SEQ ID NO: 4835 - RNA, 20 nt, Artificial Sequence
  source: /note="Description of Artificial Sequence: Synthetic oligonucleotide"
ucccaaagugcugggauuac

SEQ ID NO: 4836 - RNA, 20 nt, Artificial Sequence
  source: /note="Description of Artificial Sequence: Synthetic oligonucleotide"
caggcuugagccaccacacc

SEQ ID NO: 4837 - RNA, 20 nt, Artificial Sequence
  source: /note="Description of Artificial Sequence: Synthetic oligonucleotide"
gagccaccacaccuggcccc

SEQ ID NO: 4838 - RNA, 20 nt, Artificial Sequence
  source: /note="Description of Artificial Sequence: Synthetic oligonucleotide"
agaaaaaagauugacuucac

SEQ ID NO: 4839 - RNA, 20 nt, Artificial Sequence
  source: /note="Description of Artificial Sequence: Synthetic oligonucleotide"
ugaguuacuugauaauacca

SEQ ID NO: 4840 - RNA, 20 nt, Artificial Sequence
  source: /note="Description of Artificial Sequence: Synthetic oligonucleotide"
uugaauccuucaaccccuug

SEQ ID NO: 4841 - RNA, 20 nt, Artificial Sequence
  source: /note="Description of Artificial Sequence: Synthetic oligonucleotide"
cuugauacauuuuuuaaagc

SEQ ID NO: 4842 - RNA, 20 nt, Artificial Sequence
  source: /note="Description of Artificial Sequence: Synthetic oligonucleotide"
uuaucucuucuucaaaaaaa

SEQ ID NO: 4843 - RNA, 20 nt, Artificial Sequence
  source: /note="Description of Artificial Sequence: Synthetic oligonucleotide"
cccccacaaauguguaauuu

SEQ ID NO: 4844 - RNA, 20 nt, Artificial Sequence
  source: /note="Description of Artificial Sequence: Synthetic oligonucleotide"
auuuaggaauuguuuucuau

SEQ ID NO: 4845 - RNA, 20 nt, Artificial Sequence
  source: /note="Description of Artificial Sequence: Synthetic oligonucleotide"
ggaauuguuuucuauuggag

SEQ ID NO: 4846 - RNA, 20 nt, Artificial Sequence
  source: /note="Description of Artificial Sequence: Synthetic oligonucleotide"
auuuuaguugcucuaaugca

SEQ ID NO: 4847 - RNA, 20 nt, Artificial Sequence
  source: /note="Description of Artificial Sequence: Synthetic oligonucleotide"
gguguuuccuaaaaaguuua

SEQ ID NO: 4848 - RNA, 20 nt, Artificial Sequence
  source: /note="Description of Artificial Sequence: Synthetic oligonucleotide"
augauaguaaauaauacaau

SEQ ID NO: 4849 - RNA, 20 nt, Artificial Sequence
  source: /note="Description of Artificial Sequence: Synthetic oligonucleotide"
ugauaguaaauaauacaaua

SEQ ID NO: 4850 - RNA, 20 nt, Artificial Sequence
  source: /note="Description of Artificial Sequence: Synthetic oligonucleotide"
gauaguaaauaauacaauag

SEQ ID NO: 4851 - RNA, 20 nt, Artificial Sequence
  source: /note="Description of Artificial Sequence: Synthetic oligonucleotide"
auaguaaauaauacaauagg

SEQ ID NO: 4852 - RNA, 20 nt, Artificial Sequence
  source: /note="Description of Artificial Sequence: Synthetic oligonucleotide"
aaaucaaacaguuccacaag

SEQ ID NO: 4853 - RNA, 20 nt, Artificial Sequence
  source: /note="Description of Artificial Sequence: Synthetic oligonucleotide"
uuuuaaacuuaaccuuacug

SEQ ID NO: 4854 - RNA, 20 nt, Artificial Sequence
  source: /note="Description of Artificial Sequence: Synthetic oligonucleotide"
uuuaaacuuaaccuuacuga

SEQ ID NO: 4855 - RNA, 20 nt, Artificial Sequence
  source: /note="Description of Artificial Sequence: Synthetic oligonucleotide"
uuaaacuuaaccuuacugag

SEQ ID NO: 4856 - RNA, 20 nt, Artificial Sequence
  source: /note="Description of Artificial Sequence: Synthetic oligonucleotide"
aaccuuacugagggguuuua

SEQ ID NO: 4857 - RNA, 20 nt, Artificial Sequence
  source: /note="Description of Artificial Sequence: Synthetic oligonucleotide"
gcaaaguauaaaguaauaga

SEQ ID NO: 4858 - RNA, 20 nt, Artificial Sequence
  source: /note="Description of Artificial Sequence: Synthetic oligonucleotide"
aauagaagguuaccaaguug

SEQ ID NO: 4859 - RNA, 20 nt, Artificial Sequence
  source: /note="Description of Artificial Sequence: Synthetic oligonucleotide"
uagugccaauacaguuaaaa

SEQ ID NO: 4860 - RNA, 20 nt, Artificial Sequence
  source: /note="Description of Artificial Sequence: Synthetic oligonucleotide"
uuaacagaacaucuucaucc

SEQ ID NO: 4861 - RNA, 20 nt, Artificial Sequence
  source: /note="Description of Artificial Sequence: Synthetic oligonucleotide"
uuuuuuuuuuuuuuucagac

SEQ ID NO: 4862 - RNA, 20 nt, Artificial Sequence
  source: /note="Description of Artificial Sequence: Synthetic oligonucleotide"
uuuuuuuuuuuuuucagaca

SEQ ID NO: 4863 - RNA, 20 nt, Artificial Sequence
  source: /note="Description of Artificial Sequence: Synthetic oligonucleotide"
cacuccuguugcccagacug

SEQ ID NO: 4864 - RNA, 20 nt, Artificial Sequence
  source: /note="Description of Artificial Sequence: Synthetic oligonucleotide"
uugcccagacugcggugcag

SEQ ID NO: 4865 - RNA, 20 nt, Artificial Sequence
  source: /note="Description of Artificial Sequence: Synthetic oligonucleotide"
gcggugcaguggccugauug

SEQ ID NO: 4866 - RNA, 20 nt, Artificial Sequence
  source: /note="Description of Artificial Sequence: Synthetic oligonucleotide"
cacugcagccucaacuuccc

SEQ ID NO: 4867 - RNA, 20 nt, Artificial Sequence
  source: /note="Description of Artificial Sequence: Synthetic oligonucleotide"
agccucaacuucccaggcuc

SEQ ID NO: 4868 - RNA, 20 nt, Artificial Sequence
  source: /note="Description of Artificial Sequence: Synthetic oligonucleotide"
uccagaguagcugagaccac

SEQ ID NO: 4869 - RNA, 20 nt, Artificial Sequence
  source: /note="Description of Artificial Sequence: Synthetic oligonucleotide"
ccagaguagcugagaccaca

SEQ ID NO: 4870 - RNA, 20 nt, Artificial Sequence
  source: /note="Description of Artificial Sequence: Synthetic oligonucleotide"
cagaguagcugagaccacag

SEQ ID NO: 4871 - RNA, 20 nt, Artificial Sequence
  source: /note="Description of Artificial Sequence: Synthetic oligonucleotide"
caggggcaugccaccacccc

SEQ ID NO: 4872 - RNA, 20 nt, Artificial Sequence
  source: /note="Description of Artificial Sequence: Synthetic oligonucleotide"
uuuguauuuuuuguagagac

SEQ ID NO: 4873 - RNA, 20 nt, Artificial Sequence
  source: /note="Description of Artificial Sequence: Synthetic oligonucleotide"
uuguauuuuuuguagagaca

SEQ ID NO: 4874 - RNA, 20 nt, Artificial Sequence
  source: /note="Description of Artificial Sequence: Synthetic oligonucleotide"
aggguuuugccauguugccc

SEQ ID NO: 4875 - RNA, 20 nt, Artificial Sequence
  source: /note="Description of Artificial Sequence: Synthetic oligonucleotide"
ccaggcuguucgcaaacucc

SEQ ID NO: 4876 - RNA, 20 nt, Artificial Sequence
  source: /note="Description of Artificial Sequence: Synthetic oligonucleotide"
cucaagcaauccaccugccu

SEQ ID NO: 4877 - RNA, 20 nt, Artificial Sequence
  source: /note="Description of Artificial Sequence: Synthetic oligonucleotide"
gccucggcuucccaaagugc

SEQ ID NO: 4878 - RNA, 20 nt, Artificial Sequence
  source: /note="Description of Artificial Sequence: Synthetic oligonucleotide"
uucccaaagugcuggaauua

SEQ ID NO: 4879 - RNA, 20 nt, Artificial Sequence
  source: /note="Description of Artificial Sequence: Synthetic oligonucleotide"
ucccaaagugcuggaauuau

SEQ ID NO: 4880 - RNA, 20 nt, Artificial Sequence
  source: /note="Description of Artificial Sequence: Synthetic oligonucleotide"
gcugccacacccagccccuc

SEQ ID NO: 4881 - RNA, 20 nt, Artificial Sequence
  source: /note="Description of Artificial Sequence: Synthetic oligonucleotide"
auuaccaacuucugucuucc

SEQ ID NO: 4882 - RNA, 20 nt, Artificial Sequence
  source: /note="Description of Artificial Sequence: Synthetic oligonucleotide"
cuuccagguuuuuauguccu

SEQ ID NO: 4883 - RNA, 20 nt, Artificial Sequence
  source: /note="Description of Artificial Sequence: Synthetic oligonucleotide"
aaauuuaugcauauuuuuag

SEQ ID NO: 4884 - RNA, 20 nt, Artificial Sequence
  source: /note="Description of Artificial Sequence: Synthetic oligonucleotide"
auacuuuaacuuauuauaga

SEQ ID NO: 4885 - RNA, 20 nt, Artificial Sequence
  source: /note="Description of Artificial Sequence: Synthetic oligonucleotide"
uagaaggcuuacaaaaacug

SEQ ID NO: 4886 - RNA, 20 nt, Artificial Sequence
  source: /note="Description of Artificial Sequence: Synthetic oligonucleotide"
gugaagcagcgaauuucuag

SEQ ID NO: 4887 - RNA, 20 nt, Artificial Sequence
  source: /note="Description of Artificial Sequence: Synthetic oligonucleotide"
agcagcgaauuucuagaggc

SEQ ID NO: 4888 - RNA, 20 nt, Artificial Sequence
  source: /note="Description of Artificial Sequence: Synthetic oligonucleotide"
gcagcgaauuucuagaggcu

SEQ ID NO: 4889 - RNA, 20 nt, Artificial Sequence
  source: /note="Description of Artificial Sequence: Synthetic oligonucleotide"
agaggcuggguucacgcuuc

SEQ ID NO: 4890 - RNA, 20 nt, Artificial Sequence
  source: /note="Description of Artificial Sequence: Synthetic oligonucleotide"
cuucagguccucuaaauccu

SEQ ID NO: 4891 - RNA, 20 nt, Artificial Sequence
  source: /note="Description of Artificial Sequence: Synthetic oligonucleotide"
aauuuuuauugaacaaauac

SEQ ID NO: 4892 - RNA, 20 nt, Artificial Sequence
  source: /note="Description of Artificial Sequence: Synthetic oligonucleotide"
cucauugcucuugaauacau

SEQ ID NO: 4893 - RNA, 20 nt, Artificial Sequence
  source: /note="Description of Artificial Sequence: Synthetic oligonucleotide"
ugaaauucuguuuuccuuaa

SEQ ID NO: 4894 - RNA, 20 nt, Artificial Sequence
  source: /note="Description of Artificial Sequence: Synthetic oligonucleotide"
ccuuaaaggcagucauuuuu

SEQ ID NO: 4895 - RNA, 20 nt, Artificial Sequence
  source: /note="Description of Artificial Sequence: Synthetic oligonucleotide"
uaguaacaucauaacuucag

SEQ ID NO: 4896 - RNA, 20 nt, Artificial Sequence
  source: /note="Description of Artificial Sequence: Synthetic oligonucleotide"
auaugccuacuuuucauauc

SEQ ID NO: 4897 - RNA, 20 nt, Artificial Sequence
  source: /note="Description of Artificial Sequence: Synthetic oligonucleotide"
aauugcugucaacaaaguag

SEQ ID NO: 4898 - RNA, 20 nt, Artificial Sequence
  source: /note="Description of Artificial Sequence: Synthetic oligonucleotide"
uucauugugaaaacaugaaa

SEQ ID NO: 4899 - RNA, 20 nt, Artificial Sequence
  source: /note="Description of Artificial Sequence: Synthetic oligonucleotide"
auggcuguuaacuauacauc

SEQ ID NO: 4900 - RNA, 20 nt, Artificial Sequence
  source: /note="Description of Artificial Sequence: Synthetic oligonucleotide"
acaucaggcaaaauaaaaac

SEQ ID NO: 4901 - RNA, 20 nt, Artificial Sequence
  source: /note="Description of Artificial Sequence: Synthetic oligonucleotide"
caggaaauauaaacauuucc

SEQ ID NO: 4902 - RNA, 20 nt, Artificial Sequence
  source: /note="Description of Artificial Sequence: Synthetic oligonucleotide"
auauaaacauuuccuggaac

SEQ ID NO: 4903 - RNA, 20 nt, Artificial Sequence
  source: /note="Description of Artificial Sequence: Synthetic oligonucleotide"
uauaaacauuuccuggaaca

SEQ ID NO: 4904 - RNA, 20 nt, Artificial Sequence
  source: /note="Description of Artificial Sequence: Synthetic oligonucleotide"
agggcagaguaugaguaaua

SEQ ID NO: 4905 - RNA, 20 nt, Artificial Sequence
  source: /note="Description of Artificial Sequence: Synthetic oligonucleotide"
aauaagguaucaaauauaau

SEQ ID NO: 4906 - RNA, 20 nt, Artificial Sequence
  source: /note="Description of Artificial Sequence: Synthetic oligonucleotide"
aaugucuuaagaaaugucac

SEQ ID NO: 4907 - RNA, 20 nt, Artificial Sequence
  source: /note="Description of Artificial Sequence: Synthetic oligonucleotide"
agaaaugucacuggaaagac

SEQ ID NO: 4908 - RNA, 20 nt, Artificial Sequence
  source: /note="Description of Artificial Sequence: Synthetic oligonucleotide"
acuggaaagacuggaguacu

SEQ ID NO: 4909 - RNA, 20 nt, Artificial Sequence
  source: /note="Description of Artificial Sequence: Synthetic oligonucleotide"
uugauuccuaacacugugcu

SEQ ID NO: 4910 - RNA, 20 nt, Artificial Sequence
  source: /note="Description of Artificial Sequence: Synthetic oligonucleotide"
cuaacacugugcuuggcaca

SEQ ID NO: 4911 - RNA, 20 nt, Artificial Sequence
  source: /note="Description of Artificial Sequence: Synthetic oligonucleotide"
cacugugcuuggcacauggu

SEQ ID NO: 4912 - RNA, 20 nt, Artificial Sequence
  source: /note="Description of Artificial Sequence: Synthetic oligonucleotide"
gguaauuaauaaauguguga

SEQ ID NO: 4913 - RNA, 20 nt, Artificial Sequence
  source: /note="Description of Artificial Sequence: Synthetic oligonucleotide"
caauuagugacuaagagagu

SEQ ID NO: 4914 - RNA, 20 nt, Artificial Sequence
  source: /note="Description of Artificial Sequence: Synthetic oligonucleotide"
agugacuaagagaguuggaa

SEQ ID NO: 4915 - RNA, 20 nt, Artificial Sequence
  source: /note="Description of Artificial Sequence: Synthetic oligonucleotide"
gugacuaagagaguuggaaa

SEQ ID NO: 4916 - RNA, 20 nt, Artificial Sequence
  source: /note="Description of Artificial Sequence: Synthetic oligonucleotide"
aagggcuaucaauuucaaau

SEQ ID NO: 4917 - RNA, 20 nt, Artificial Sequence
  source: /note="Description of Artificial Sequence: Synthetic oligonucleotide"
agacauuuuuacguaagauu

SEQ ID NO: 4918 - RNA, 20 nt, Artificial Sequence
  source: /note="Description of Artificial Sequence: Synthetic oligonucleotide"
gacauuuuuacguaagauuu

SEQ ID NO: 4919 - RNA, 20 nt, Artificial Sequence
  source: /note="Description of Artificial Sequence: Synthetic oligonucleotide"
ccauuccuacauugaccaug

SEQ ID NO: 4920 - RNA, 20 nt, Artificial Sequence
  source: /note="Description of Artificial Sequence: Synthetic oligonucleotide"
ugaccauguggacucauauu

SEQ ID NO: 4921 - RNA, 20 nt, Artificial Sequence
  source: /note="Description of Artificial Sequence: Synthetic oligonucleotide"
auaaacaaagcaccaaaagu

SEQ ID NO: 4922 - RNA, 20 nt, Artificial Sequence
  source: /note="Description of Artificial Sequence: Synthetic oligonucleotide"
aaagcaccaaaaguuggaaa

SEQ ID NO: 4923 - RNA, 20 nt, Artificial Sequence
  source: /note="Description of Artificial Sequence: Synthetic oligonucleotide"
uuggaaaaggaaguaguagu

SEQ ID NO: 4924 - RNA, 20 nt, Artificial Sequence
  source: /note="Description of Artificial Sequence: Synthetic oligonucleotide"
aaaggaaguaguaguaggag

SEQ ID NO: 4925 - RNA, 20 nt, Artificial Sequence
  source: /note="Description of Artificial Sequence: Synthetic oligonucleotide"
aaggaaguaguaguaggaga

SEQ ID NO: 4926 - RNA, 20 nt, Artificial Sequence
  source: /note="Description of Artificial Sequence: Synthetic oligonucleotide"
guuuuaagcuauguauuuac

SEQ ID NO: 4927 - RNA, 20 nt, Artificial Sequence
  source: /note="Description of Artificial Sequence: Synthetic oligonucleotide"
uuuuaagcuauguauuuacu

SEQ ID NO: 4928 - RNA, 20 nt, Artificial Sequence
  source: /note="Description of Artificial Sequence: Synthetic oligonucleotide"
uaaacaguacuguaaucacu

SEQ ID NO: 4929 - RNA, 20 nt, Artificial Sequence
  source: /note="Description of Artificial Sequence: Synthetic oligonucleotide"
aaacaguacuguaaucacuu

SEQ ID NO: 4930 - RNA, 20 nt, Artificial Sequence
  source: /note="Description of Artificial Sequence: Synthetic oligonucleotide"
augugcuuugugucagacaa

SEQ ID NO: 4931 - RNA, 20 nt, Artificial Sequence
  source: /note="Description of Artificial Sequence: Synthetic oligonucleotide"
aauacauuacauuacacaga

SEQ ID NO: 4932 - RNA, 20 nt, Artificial Sequence
  source: /note="Description of Artificial Sequence: Synthetic oligonucleotide"
auacauuacauuacacagaa

SEQ ID NO: 4933 - RNA, 20 nt, Artificial Sequence
  source: /note="Description of Artificial Sequence: Synthetic oligonucleotide"
auuacacagaagggagugcc

SEQ ID NO: 4934 - RNA, 20 nt, Artificial Sequence
  source: /note="Description of Artificial Sequence: Synthetic oligonucleotide"
aauacauuacauuacacaga

SEQ ID NO: 4935 - RNA, 20 nt, Artificial Sequence
  source: /note="Description of Artificial Sequence: Synthetic oligonucleotide"
auacauuacauuacacagaa

SEQ ID NO: 4936 - RNA, 20 nt, Artificial Sequence
  source: /note="Description of Artificial Sequence: Synthetic oligonucleotide"
auuacacagaagggagugcc

SEQ ID NO: 4937 - RNA, 20 nt, Artificial Sequence
  source: /note="Description of Artificial Sequence: Synthetic oligonucleotide"
aauacauuacauuacacaga

SEQ ID NO: 4938 - RNA, 20 nt, Artificial Sequence
  source: /note="Description of Artificial Sequence: Synthetic oligonucleotide"
auacauuacauuacacagaa

SEQ ID NO: 4939 - RNA, 20 nt, Artificial Sequence
  source: /note="Description of Artificial Sequence: Synthetic oligonucleotide"
auuacacagaagggagugcc

SEQ ID NO: 4940 - RNA, 20 nt, Artificial Sequence
  source: /note="Description of Artificial Sequence: Synthetic oligonucleotide"
cagaagggagugccuggcuu

SEQ ID NO: 4941 - RNA, 20 nt, Artificial Sequence
  source: /note="Description of Artificial Sequence: Synthetic oligonucleotide"
agaagggagugccuggcuuu

SEQ ID NO: 4942 - RNA, 20 nt, Artificial Sequence
  source: /note="Description of Artificial Sequence: Synthetic oligonucleotide"
cauagcacaaugcugccaua

SEQ ID NO: 4943 - RNA, 20 nt, Artificial Sequence
  source: /note="Description of Artificial Sequence: Synthetic oligonucleotide"
gcacaaugcugccauacggu

SEQ ID NO: 4944 - RNA, 20 nt, Artificial Sequence
  source: /note="Description of Artificial Sequence: Synthetic oligonucleotide"
agguaauaccaagacaaauc

SEQ ID NO: 4945 - RNA, 20 nt, Artificial Sequence
  source: /note="Description of Artificial Sequence: Synthetic oligonucleotide"
gguaauaccaagacaaauca

SEQ ID NO: 4946 - RNA, 20 nt, Artificial Sequence
  source: /note="Description of Artificial Sequence: Synthetic oligonucleotide"
ggccguuauuaacaaccuug

SEQ ID NO: 4947 - RNA, 20 nt, Artificial Sequence
  source: /note="Description of Artificial Sequence: Synthetic oligonucleotide"
acaaccuugaggaaaugucu

SEQ ID NO: 4948 - RNA, 20 nt, Artificial Sequence
  source: /note="Description of Artificial Sequence: Synthetic oligonucleotide"
caaccuugaggaaaugucuu

SEQ ID NO: 4949 - RNA, 20 nt, Artificial Sequence
  source: /note="Description of Artificial Sequence: Synthetic oligonucleotide"
auuuuuguuuaauuauaaua

SEQ ID NO: 4950 - RNA, 20 nt, Artificial Sequence
  source: /note="Description of Artificial Sequence: Synthetic oligonucleotide"
aagucaucccaaacucuucg

SEQ ID NO: 4951 - RNA, 20 nt, Artificial Sequence
  source: /note="Description of Artificial Sequence: Synthetic oligonucleotide"
cuguuuuuuaauguuucuaa

SEQ ID NO: 4952 - RNA, 20 nt, Artificial Sequence
  source: /note="Description of Artificial Sequence: Synthetic oligonucleotide"
uguauaaucuauuagaaaac

SEQ ID NO: 4953 - RNA, 20 nt, Artificial Sequence
  source: /note="Description of Artificial Sequence: Synthetic oligonucleotide"
agaaaacuggccaagugcag

SEQ ID NO: 4954 - RNA, 20 nt, Artificial Sequence
  source: /note="Description of Artificial Sequence: Synthetic oligonucleotide"
ugccuguaaucgcagcacuu

SEQ ID NO: 4955 - RNA, 20 nt, Artificial Sequence
  source: /note="Description of Artificial Sequence: Synthetic oligonucleotide"
gccuguaaucgcagcacuuu

SEQ ID NO: 4956 - RNA, 20 nt, Artificial Sequence
  source: /note="Description of Artificial Sequence: Synthetic oligonucleotide"
uguaaucgcagcacuuuggg

SEQ ID NO: 4957 - RNA, 20 nt, Artificial Sequence
  source: /note="Description of Artificial Sequence: Synthetic oligonucleotide"
cgcagcacuuugggaggcca

SEQ ID NO: 4958 - RNA, 20 nt, Artificial Sequence
  source: /note="Description of Artificial Sequence: Synthetic oligonucleotide"
agcacuuugggaggccaagg

SEQ ID NO: 4959 - RNA, 20 nt, Artificial Sequence
  source: /note="Description of Artificial Sequence: Synthetic oligonucleotide"
gcacuuugggaggccaaggc

SEQ ID NO: 4960 - RNA, 20 nt, Artificial Sequence
  source: /note="Description of Artificial Sequence: Synthetic oligonucleotide"
caaggcggguagauuaccug

SEQ ID NO: 4961 - RNA, 20 nt, Artificial Sequence
  source: /note="Description of Artificial Sequence: Synthetic oligonucleotide"
cggguagauuaccugagguc

SEQ ID NO: 4962 - RNA, 20 nt, Artificial Sequence
  source: /note="Description of Artificial Sequence: Synthetic oligonucleotide"
ugagaccagccuagccaaua

SEQ ID NO: 4963 - RNA, 20 nt, Artificial Sequence
  source: /note="Description of Artificial Sequence: Synthetic oligonucleotide"
uaaaaauacaaaaauuagcc

SEQ ID NO: 4964 - RNA, 20 nt, Artificial Sequence
  source: /note="Description of Artificial Sequence: Synthetic oligonucleotide"
caaaaauuagccaggcguag

SEQ ID NO: 4965 - RNA, 20 nt, Artificial Sequence
  source: /note="Description of Artificial Sequence: Synthetic oligonucleotide"
gccuguaaucccagcuacuc

SEQ ID NO: 4966 - RNA, 20 nt, Artificial Sequence
  source: /note="Description of Artificial Sequence: Synthetic oligonucleotide"
uguaaucccagcuacucagg

SEQ ID NO: 4967 - RNA, 20 nt, Artificial Sequence
  source: /note="Description of Artificial Sequence: Synthetic oligonucleotide"
cccagcuacucaggaggcug

SEQ ID NO: 4968 - RNA, 20 nt, Artificial Sequence
  source: /note="Description of Artificial Sequence: Synthetic oligonucleotide"
gcuacucaggaggcugaggc

SEQ ID NO: 4969 - RNA, 20 nt, Artificial Sequence
  source: /note="Description of Artificial Sequence: Synthetic oligonucleotide"
gcaggagaaucucuugaacc

SEQ ID NO: 4970 - RNA, 20 nt, Artificial Sequence
  source: /note="Description of Artificial Sequence: Synthetic oligonucleotide"
caggagaaucucuugaaccc

SEQ ID NO: 4971 - RNA, 20 nt, Artificial Sequence
  source: /note="Description of Artificial Sequence: Synthetic oligonucleotide"
gagaaucucuugaacccggg

SEQ ID NO: 4972 - RNA, 20 nt, Artificial Sequence
  source: /note="Description of Artificial Sequence: Synthetic oligonucleotide"
ucucuugaacccgggaggcg

SEQ ID NO: 4973 - RNA, 20 nt, Artificial Sequence
  source: /note="Description of Artificial Sequence: Synthetic oligonucleotide"
cgcgucacugcauuccagcc

SEQ ID NO: 4974 - RNA, 20 nt, Artificial Sequence
  source: /note="Description of Artificial Sequence: Synthetic oligonucleotide"
gcgucacugcauuccagccu

SEQ ID NO: 4975 - RNA, 20 nt, Artificial Sequence
  source: /note="Description of Artificial Sequence: Synthetic oligonucleotide"
cugcauuccagccugggcga

SEQ ID NO: 4976 - RNA, 20 nt, Artificial Sequence
  source: /note="Description of Artificial Sequence: Synthetic oligonucleotide"
uuaagcaucucucuuccuca

SEQ ID NO: 4977 - RNA, 20 nt, Artificial Sequence
  source: /note="Description of Artificial Sequence: Synthetic oligonucleotide"
uugaauccuuagugcauaug

SEQ ID NO: 4978 - RNA, 20 nt, Artificial Sequence
  source: /note="Description of Artificial Sequence: Synthetic oligonucleotide"
auuagacaucauguaauauc

SEQ ID NO: 4979 - RNA, 20 nt, Artificial Sequence
  source: /note="Description of Artificial Sequence: Synthetic oligonucleotide"
aacuaagaauaauuuaccaa

SEQ ID NO: 4980 - RNA, 20 nt, Artificial Sequence
  source: /note="Description of Artificial Sequence: Synthetic oligonucleotide"
acauuaagaguuacguuucu

SEQ ID NO: 4981 - RNA, 20 nt, Artificial Sequence
  source: /note="Description of Artificial Sequence: Synthetic oligonucleotide"
aaaauugaaaagaauaucug

SEQ ID NO: 4982 - RNA, 20 nt, Artificial Sequence
  source: /note="Description of Artificial Sequence: Synthetic oligonucleotide"
aaagaauaucuguggcacaa

SEQ ID NO: 4983 - RNA, 20 nt, Artificial Sequence
  source: /note="Description of Artificial Sequence: Synthetic oligonucleotide"
aagaauaucuguggcacaau

SEQ ID NO: 4984 - RNA, 20 nt, Artificial Sequence
  source: /note="Description of Artificial Sequence: Synthetic oligonucleotide"
aucuguggcacaaugggcuc

SEQ ID NO: 4985 - RNA, 20 nt, Artificial Sequence
  source: /note="Description of Artificial Sequence: Synthetic oligonucleotide"
ucuguggcacaaugggcucu

SEQ ID NO: 4986 - RNA, 20 nt, Artificial Sequence
  source: /note="Description of Artificial Sequence: Synthetic oligonucleotide"
ugggcucuggguauaauugc

SEQ ID NO: 4987 - RNA, 20 nt, Artificial Sequence
  source: /note="Description of Artificial Sequence: Synthetic oligonucleotide"
guuuaaagaauauuuucaau

SEQ ID NO: 4988 - RNA, 20 nt, Artificial Sequence
  source: /note="Description of Artificial Sequence: Synthetic oligonucleotide"
caauagguauaaguuuauuu

SEQ ID NO: 4989 - RNA, 20 nt, Artificial Sequence
  source: /note="Description of Artificial Sequence: Synthetic oligonucleotide"
uuuagcaguauauauuuccc

SEQ ID NO: 4990 - RNA, 20 nt, Artificial Sequence
  source: /note="Description of Artificial Sequence: Synthetic oligonucleotide"
ccuggaacaccaugcacucu

SEQ ID NO: 4991 - RNA, 20 nt, Artificial Sequence
  source: /note="Description of Artificial Sequence: Synthetic oligonucleotide"
cucuagguuuucuaauuuau

SEQ ID NO: 4992 - RNA, 20 nt, Artificial Sequence
  source: /note="Description of Artificial Sequence: Synthetic oligonucleotide"
auuuauugguuuaaaauaca

SEQ ID NO: 4993 - RNA, 20 nt, Artificial Sequence
  source: /note="Description of Artificial Sequence: Synthetic oligonucleotide"
uaaauauucucuguaucugu

SEQ ID NO: 4994 - RNA, 20 nt, Artificial Sequence
  source: /note="Description of Artificial Sequence: Synthetic oligonucleotide"
auucacuagauuauuuucca

SEQ ID NO: 4995 - RNA, 20 nt, Artificial Sequence
  source: /note="Description of Artificial Sequence: Synthetic oligonucleotide"
guuuuccuaaauuagugauu

SEQ ID NO: 4996 - RNA, 20 nt, Artificial Sequence
  source: /note="Description of Artificial Sequence: Synthetic oligonucleotide"
uauagccaaugcauuuugag

SEQ ID NO: 4997 - RNA, 20 nt, Artificial Sequence
  source: /note="Description of Artificial Sequence: Synthetic oligonucleotide"
cuuugaacaaagaguuauuu

SEQ ID NO: 4998 - RNA, 20 nt, Artificial Sequence
  source: /note="Description of Artificial Sequence: Synthetic oligonucleotide"
agaguuauuuaggaaaagaa

SEQ ID NO: 4999 - RNA, 20 nt, Artificial Sequence
  source: /note="Description of Artificial Sequence: Synthetic oligonucleotide"
uacuucuuuauauuuuguug

SEQ ID NO: 5000 - RNA, 20 nt, Artificial Sequence
  source: /note="Description of Artificial Sequence: Synthetic oligonucleotide"
cuaagaaaauuuucuuuguc

SEQ ID NO: 5001 - RNA, 20 nt, Artificial Sequence
  source: /note="Description of Artificial Sequence: Synthetic oligonucleotide"
aaauuuucuuugucaggaua

SEQ ID NO: 5002 - RNA, 20 nt, Artificial Sequence
  source: /note="Description of Artificial Sequence: Synthetic oligonucleotide"
uugucaggauaaggcacaug

SEQ ID NO: 5003 - RNA, 20 nt, Artificial Sequence
  source: /note="Description of Artificial Sequence: Synthetic oligonucleotide"
gaagucccccccaacccaau

SEQ ID NO: 5004 - RNA, 20 nt, Artificial Sequence
  source: /note="Description of Artificial Sequence: Synthetic oligonucleotide"
uccuauucacacauucuuga

SEQ ID NO: 5005 - RNA, 20 nt, Artificial Sequence
  source: /note="Description of Artificial Sequence: Synthetic oligonucleotide"
guuuuucacucuuguugccu

SEQ ID NO: 5006 - RNA, 20 nt, Artificial Sequence
  source: /note="Description of Artificial Sequence: Synthetic oligonucleotide"
uucacucuuguugccuaggc

SEQ ID NO: 5007 - RNA, 20 nt, Artificial Sequence
  source: /note="Description of Artificial Sequence: Synthetic oligonucleotide"
uugccuaggcuggagugcaa

SEQ ID NO: 5008 - RNA, 20 nt, Artificial Sequence
  source: /note="Description of Artificial Sequence: Synthetic oligonucleotide"
cuaggcuggagugcaauggc

SEQ ID NO: 5009 - RNA, 20 nt, Artificial Sequence
  source: /note="Description of Artificial Sequence: Synthetic oligonucleotide"
ucacugcaaccuccgccucc

SEQ ID NO: 5010 - RNA, 20 nt, Artificial Sequence
  source: /note="Description of Artificial Sequence: Synthetic oligonucleotide"
gccucagccucccgaguagc

SEQ ID NO: 5011 - RNA, 20 nt, Artificial Sequence
  source: /note="Description of Artificial Sequence: Synthetic oligonucleotide"
ccucagccucccgaguagcu

SEQ ID NO: 5012 - RNA, 20 nt, Artificial Sequence
  source: /note="Description of Artificial Sequence: Synthetic oligonucleotide"
ucccgaguagcugggauuau

SEQ ID NO: 5013 - RNA, 20 nt, Artificial Sequence
  source: /note="Description of Artificial Sequence: Synthetic oligonucleotide"
uaggcaugcaccaccacucc

SEQ ID NO: 5014 - RNA, 20 nt, Artificial Sequence
  source: /note="Description of Artificial Sequence: Synthetic oligonucleotide"
uuuucuauuuuuaguagaga

SEQ ID NO: 5015 - RNA, 20 nt, Artificial Sequence
  source: /note="Description of Artificial Sequence: Synthetic oligonucleotide"
gagacggaguuucuccaugu

SEQ ID NO: 5016 - RNA, 20 nt, Artificial Sequence
  source: /note="Description of Artificial Sequence: Synthetic oligonucleotide"
ggaguuucuccauguugguc

SEQ ID NO: 5017 - RNA, 20 nt, Artificial Sequence
  source: /note="Description of Artificial Sequence: Synthetic oligonucleotide"
uuucuccauguuggucaggc

SEQ ID NO: 5018 - RNA, 20 nt, Artificial Sequence
  source: /note="Description of Artificial Sequence: Synthetic oligonucleotide"
ggucucaaacucccaaccuc

SEQ ID NO: 5019 - RNA, 20 nt, Artificial Sequence
  source: /note="Description of Artificial Sequence: Synthetic oligonucleotide"
cuucagccuccuaaagugcu

SEQ ID NO: 5020 - RNA, 20 nt, Artificial Sequence
  source: /note="Description of Artificial Sequence: Synthetic oligonucleotide"
uccuaaagugcuaggauuac

SEQ ID NO: 5021 - RNA, 20 nt, Artificial Sequence
  source: /note="Description of Artificial Sequence: Synthetic oligonucleotide"
agccgaaaacauuaucuuaa

SEQ ID NO: 5022 - RNA, 20 nt, Artificial Sequence
  source: /note="Description of Artificial Sequence: Synthetic oligonucleotide"
aaaauacugcuuaaaagauc

SEQ ID NO: 5023 - RNA, 20 nt, Artificial Sequence
  source: /note="Description of Artificial Sequence: Synthetic oligonucleotide"
uauuucucuuuuacuugucu

SEQ ID NO: 5024 - RNA, 20 nt, Artificial Sequence
  source: /note="Description of Artificial Sequence: Synthetic oligonucleotide"
ucuaguucagauuuauaguu

SEQ ID NO: 5025 - RNA, 20 nt, Artificial Sequence
  source: /note="Description of Artificial Sequence: Synthetic oligonucleotide"
uguuagugcuucagcccauc

SEQ ID NO: 5026 - RNA, 20 nt, Artificial Sequence
  source: /note="Description of Artificial Sequence: Synthetic oligonucleotide"
agugcuucagcccaucuggu

SEQ ID NO: 5027 - RNA, 20 nt, Artificial Sequence
  source: /note="Description of Artificial Sequence: Synthetic oligonucleotide"
gugcuucagcccaucugguu

SEQ ID NO: 5028 - RNA, 20 nt, Artificial Sequence
  source: /note="Description of Artificial Sequence: Synthetic oligonucleotide"
ugcuucagcccaucugguug

SEQ ID NO: 5029 - RNA, 20 nt, Artificial Sequence
  source: /note="Description of Artificial Sequence: Synthetic oligonucleotide"
ggggaacagcucuaucccac

SEQ ID NO: 5030 - RNA, 20 nt, Artificial Sequence
  source: /note="Description of Artificial Sequence: Synthetic oligonucleotide"
gggaacagcucuaucccacu

SEQ ID NO: 5031 - RNA, 20 nt, Artificial Sequence
  source: /note="Description of Artificial Sequence: Synthetic oligonucleotide"
cuuuccucaugagugacgcc

SEQ ID NO: 5032 - RNA, 20 nt, Artificial Sequence
  source: /note="Description of Artificial Sequence: Synthetic oligonucleotide"
uuuccucaugagugacgcca

SEQ ID NO: 5033 - RNA, 20 nt, Artificial Sequence
  source: /note="Description of Artificial Sequence: Synthetic oligonucleotide"
uuccccagcuucgcugccuu

SEQ ID NO: 5034 - RNA, 20 nt, Artificial Sequence
  source: /note="Description of Artificial Sequence: Synthetic oligonucleotide"
ucgccuuuaguccuugaugc

SEQ ID NO: 5035 - RNA, 20 nt, Artificial Sequence
  source: /note="Description of Artificial Sequence: Synthetic oligonucleotide"
cgccuuuaguccuugaugcu

SEQ ID NO: 5036 - RNA, 20 nt, Artificial Sequence
  source: /note="Description of Artificial Sequence: Synthetic oligonucleotide"
gccuuuaguccuugaugcug

SEQ ID NO: 5037 - RNA, 20 nt, Artificial Sequence
  source: /note="Description of Artificial Sequence: Synthetic oligonucleotide"
ccuugaugcuggggaccuuu

SEQ ID NO: 5038 - RNA, 20 nt, Artificial Sequence
  source: /note="Description of Artificial Sequence: Synthetic oligonucleotide"
gaugcuggggaccuuuuggu

SEQ ID NO: 5039 - RNA, 20 nt, Artificial Sequence
  source: /note="Description of Artificial Sequence: Synthetic oligonucleotide"
augcuggggaccuuuugguu

SEQ ID NO: 5040 - RNA, 20 nt, Artificial Sequence
  source: /note="Description of Artificial Sequence: Synthetic oligonucleotide"
gaagacagcuuccuuauguc

SEQ ID NO: 5041 - RNA, 20 nt, Artificial Sequence
  source: /note="Description of Artificial Sequence: Synthetic oligonucleotide"
aagacagcuuccuuauguca

SEQ ID NO: 5042 - RNA, 20 nt, Artificial Sequence
  source: /note="Description of Artificial Sequence: Synthetic oligonucleotide"
ucagggugagccugcuacac

SEQ ID NO: 5043 - RNA, 20 nt, Artificial Sequence
  source: /note="Description of Artificial Sequence: Synthetic oligonucleotide"
guuucuuugucucccucaaa

SEQ ID NO: 5044 - RNA, 20 nt, Artificial Sequence
  source: /note="Description of Artificial Sequence: Synthetic oligonucleotide"
ucccucaaaugguacaaacg

SEQ ID NO: 5045 - RNA, 20 nt, Artificial Sequence
  source: /note="Description of Artificial Sequence: Synthetic oligonucleotide"
cucaaaugguacaaacgugg

SEQ ID NO: 5046 - RNA, 20 nt, Artificial Sequence
  source: /note="Description of Artificial Sequence: Synthetic oligonucleotide"
ucaaaugguacaaacgugga

SEQ ID NO: 5047 - RNA, 20 nt, Artificial Sequence
  source: /note="Description of Artificial Sequence: Synthetic oligonucleotide"
gcccuccaaauaagagauga

SEQ ID NO: 5048 - RNA, 20 nt, Artificial Sequence
  source: /note="Description of Artificial Sequence: Synthetic oligonucleotide"
uccacaacugacuuuaaaag

SEQ ID NO: 5049 - RNA, 20 nt, Artificial Sequence
  source: /note="Description of Artificial Sequence: Synthetic oligonucleotide"
ccacaacugacuuuaaaaga

SEQ ID NO: 5050 - RNA, 20 nt, Artificial Sequence
  source: /note="Description of Artificial Sequence: Synthetic oligonucleotide"
acugacuuuaaaagagggac

SEQ ID NO: 5051 - RNA, 20 nt, Artificial Sequence
  source: /note="Description of Artificial Sequence: Synthetic oligonucleotide"
cugacuuuaaaagagggacu

SEQ ID NO: 5052 - RNA, 20 nt, Artificial Sequence
  source: /note="Description of Artificial Sequence: Synthetic oligonucleotide"
uuuaaaagagggacugggau

SEQ ID NO: 5053 - RNA, 20 nt, Artificial Sequence
  source: /note="Description of Artificial Sequence: Synthetic oligonucleotide"
uuaaaagagggacugggauu

SEQ ID NO: 5054 - RNA, 20 nt, Artificial Sequence
  source: /note="Description of Artificial Sequence: Synthetic oligonucleotide"
cuuagugaugacuuuuaaug

SEQ ID NO: 5055 - RNA, 20 nt, Artificial Sequence
  source: /note="Description of Artificial Sequence: Synthetic oligonucleotide"
uaaacucucugccucucagc

SEQ ID NO: 5056 - RNA, 20 nt, Artificial Sequence
  source: /note="Description of Artificial Sequence: Synthetic oligonucleotide"
ucucagcuggcacuauucca

SEQ ID NO: 5057 - RNA, 20 nt, Artificial Sequence
  source: /note="Description of Artificial Sequence: Synthetic oligonucleotide"
ccaugguauuuuagugcuaa

SEQ ID NO: 5058 - RNA, 20 nt, Artificial Sequence
  source: /note="Description of Artificial Sequence: Synthetic oligonucleotide"
caugguauuuuagugcuaau

SEQ ID NO: 5059 - RNA, 20 nt, Artificial Sequence
  source: /note="Description of Artificial Sequence: Synthetic oligonucleotide"
augguauuuuagugcuaaug

SEQ ID NO: 5060 - RNA, 20 nt, Artificial Sequence
  source: /note="Description of Artificial Sequence: Synthetic oligonucleotide"
ugguauuuuagugcuaaugg

SEQ ID NO: 5061 - RNA, 20 nt, Artificial Sequence
  source: /note="Description of Artificial Sequence: Synthetic oligonucleotide"
ugacuguuuaaaucauuuac

SEQ ID NO: 5062 - RNA, 20 nt, Artificial Sequence
  source: /note="Description of Artificial Sequence: Synthetic oligonucleotide"
uuaaaucauuuacuggaaag

SEQ ID NO: 5063 - RNA, 20 nt, Artificial Sequence
  source: /note="Description of Artificial Sequence: Synthetic oligonucleotide"
uaaaucauuuacuggaaaga

SEQ ID NO: 5064 - RNA, 20 nt, Artificial Sequence
  source: /note="Description of Artificial Sequence: Synthetic oligonucleotide"
gauuuuguucaugaacauga

SEQ ID NO: 5065 - RNA, 20 nt, Artificial Sequence
  source: /note="Description of Artificial Sequence: Synthetic oligonucleotide"
uucuuaaaugccuuuaauau

SEQ ID NO: 5066 - RNA, 20 nt, Artificial Sequence
  source: /note="Description of Artificial Sequence: Synthetic oligonucleotide"
aauauuggauacugcuuuca

SEQ ID NO: 5067 - RNA, 20 nt, Artificial Sequence
  source: /note="Description of Artificial Sequence: Synthetic oligonucleotide"
ggaaauuuaaaauagcaagc

SEQ ID NO: 5068 - RNA, 20 nt, Artificial Sequence
  source: /note="Description of Artificial Sequence: Synthetic oligonucleotide"
caagucauauaaaacaaguu

SEQ ID NO: 5069 - RNA, 20 nt, Artificial Sequence
  source: /note="Description of Artificial Sequence: Synthetic oligonucleotide"
agauuccaaacauuaauaua

SEQ ID NO: 5070 - RNA, 20 nt, Artificial Sequence
  source: /note="Description of Artificial Sequence: Synthetic oligonucleotide"
uacauaaauuuuacuagaag

SEQ ID NO: 5071 - RNA, 20 nt, Artificial Sequence
  source: /note="Description of Artificial Sequence: Synthetic oligonucleotide"
ucaaaaagaucucaaaucuu

SEQ ID NO: 5072 - RNA, 20 nt, Artificial Sequence
  source: /note="Description of Artificial Sequence: Synthetic oligonucleotide"
caaaaagaucucaaaucuua

SEQ ID NO: 5073 - RNA, 20 nt, Artificial Sequence
  source: /note="Description of Artificial Sequence: Synthetic oligonucleotide"
ggacuaauauuguaaguaua

SEQ ID NO: 5074 - RNA, 20 nt, Artificial Sequence
  source: /note="Description of Artificial Sequence: Synthetic oligonucleotide"
gacuaauauuguaaguauac

SEQ ID NO: 5075 - RNA, 20 nt, Artificial Sequence
  source: /note="Description of Artificial Sequence: Synthetic oligonucleotide"
acuaauauuguaaguauacg

SEQ ID NO: 5076 - RNA, 20 nt, Artificial Sequence
  source: /note="Description of Artificial Sequence: Synthetic oligonucleotide"
uaucuugugaguuuuuaguu

SEQ ID NO: 5077 - RNA, 20 nt, Artificial Sequence
  source: /note="Description of Artificial Sequence: Synthetic oligonucleotide"
acucuccuuuugaaguacaa

SEQ ID NO: 5078 - RNA, 20 nt, Artificial Sequence
  source: /note="Description of Artificial Sequence: Synthetic oligonucleotide"
cucuccuuuugaaguacaaa

SEQ ID NO: 5079 - RNA, 20 nt, Artificial Sequence
  source: /note="Description of Artificial Sequence: Synthetic oligonucleotide"
cuaaagugaauaacucaaac

SEQ ID NO: 5080 - RNA, 20 nt, Artificial Sequence
  source: /note="Description of Artificial Sequence: Synthetic oligonucleotide"
guuuuauugcauaguuucuu

SEQ ID NO: 5081 - RNA, 20 nt, Artificial Sequence
  source: /note="Description of Artificial Sequence: Synthetic oligonucleotide"
uuuuauugcauaguuucuuu

SEQ ID NO: 5082 - RNA, 20 nt, Artificial Sequence
  source: /note="Description of Artificial Sequence: Synthetic oligonucleotide"
uucuuugggauauacauuga

SEQ ID NO: 5083 - RNA, 20 nt, Artificial Sequence
  source: /note="Description of Artificial Sequence: Synthetic oligonucleotide"
ggauauacauugaaggagaa

SEQ ID NO: 5084 - RNA, 20 nt, Artificial Sequence
  source: /note="Description of Artificial Sequence: Synthetic oligonucleotide"
uauacauugaaggagaaagg

SEQ ID NO: 5085 - RNA, 20 nt, Artificial Sequence
  source: /note="Description of Artificial Sequence: Synthetic oligonucleotide"
acauugaaggagaaaggagg

SEQ ID NO: 5086 - RNA, 20 nt, Artificial Sequence
  source: /note="Description of Artificial Sequence: Synthetic oligonucleotide"
cauugaaggagaaaggagga

SEQ ID NO: 5087 - RNA, 20 nt, Artificial Sequence
  source: /note="Description of Artificial Sequence: Synthetic oligonucleotide"
agggaguuuuaaaagacaag

SEQ ID NO: 5088 - RNA, 20 nt, Artificial Sequence
  source: /note="Description of Artificial Sequence: Synthetic oligonucleotide"
aaagcccuuucugcuuguuu

SEQ ID NO: 5089 - RNA, 20 nt, Artificial Sequence
  source: /note="Description of Artificial Sequence: Synthetic oligonucleotide"
cuuucugcuuguuuuggcua

SEQ ID NO: 5090 - RNA, 20 nt, Artificial Sequence
  source: /note="Description of Artificial Sequence: Synthetic oligonucleotide"
cauuucagugucuguauuua

SEQ ID NO: 5091 - RNA, 20 nt, Artificial Sequence
  source: /note="Description of Artificial Sequence: Synthetic oligonucleotide"
auuucagugucuguauuuaa

SEQ ID NO: 5092 - RNA, 20 nt, Artificial Sequence
  source: /note="Description of Artificial Sequence: Synthetic oligonucleotide"
uguauuuaagggaucauaaa

SEQ ID NO: 5093 - RNA, 20 nt, Artificial Sequence
  source: /note="Description of Artificial Sequence: Synthetic oligonucleotide"
uaagggaucauaaaaggaac

SEQ ID NO: 5094 - RNA, 20 nt, Artificial Sequence
  source: /note="Description of Artificial Sequence: Synthetic oligonucleotide"
auaaaaggaacuggaaagac

SEQ ID NO: 5095 - RNA, 20 nt, Artificial Sequence
  source: /note="Description of Artificial Sequence: Synthetic oligonucleotide"
acuggaaagacuggucacaa

SEQ ID NO: 5096 - RNA, 20 nt, Artificial Sequence
  source: /note="Description of Artificial Sequence: Synthetic oligonucleotide"
gcucuguaccuguaugauuu

SEQ ID NO: 5097 - RNA, 20 nt, Artificial Sequence
  source: /note="Description of Artificial Sequence: Synthetic oligonucleotide"
cuuguuaaccuauacugcug

SEQ ID NO: 5098 - RNA, 20 nt, Artificial Sequence
  source: /note="Description of Artificial Sequence: Synthetic oligonucleotide"
aagucauucauuaugcaguu

SEQ ID NO: 5099 - RNA, 20 nt, Artificial Sequence
  source: /note="Description of Artificial Sequence: Synthetic oligonucleotide"
caaauaaaguucacagcucu

SEQ ID NO: 5100 - RNA, 20 nt, Artificial Sequence
  source: /note="Description of Artificial Sequence: Synthetic oligonucleotide"
aagaagauagaaucaauacu

SEQ ID NO: 5101 - RNA, 20 nt, Artificial Sequence
  source: /note="Description of Artificial Sequence: Synthetic oligonucleotide"
aucaauacuuggugauugau

SEQ ID NO: 5102 - RNA, 20 nt, Artificial Sequence
  source: /note="Description of Artificial Sequence: Synthetic oligonucleotide"
uugauagguuauuuuuuaaa

SEQ ID NO: 5103 - RNA, 20 nt, Artificial Sequence
  source: /note="Description of Artificial Sequence: Synthetic oligonucleotide"
ugauagguuauuuuuuaaaa

SEQ ID NO: 5104 - RNA, 20 nt, Artificial Sequence
  source: /note="Description of Artificial Sequence: Synthetic oligonucleotide"
aagaaagaauuaaacaucca

SEQ ID NO: 5105 - RNA, 20 nt, Artificial Sequence
  source: /note="Description of Artificial Sequence: Synthetic oligonucleotide"
augguuucuucuuaaguaac

SEQ ID NO: 5106 - RNA, 20 nt, Artificial Sequence
  source: /note="Description of Artificial Sequence: Synthetic oligonucleotide"
ugguuucuucuuaaguaacu

SEQ ID NO: 5107 - RNA, 20 nt, Artificial Sequence
  source: /note="Description of Artificial Sequence: Synthetic oligonucleotide"
gguuucuucuuaaguaacug

SEQ ID NO: 5108 - RNA, 20 nt, Artificial Sequence
  source: /note="Description of Artificial Sequence: Synthetic oligonucleotide"
guuucuucuuaaguaacugg

SEQ ID NO: 5109 - RNA, 20 nt, Artificial Sequence
  source: /note="Description of Artificial Sequence: Synthetic oligonucleotide"
uuucuucuuaaguaacuggg

SEQ ID NO: 5110 - RNA, 20 nt, Artificial Sequence
  source: /note="Description of Artificial Sequence: Synthetic oligonucleotide"
gauaguaucccucacaccaa

SEQ ID NO: 5111 - RNA, 20 nt, Artificial Sequence
  source: /note="Description of Artificial Sequence: Synthetic oligonucleotide"
auaguaucccucacaccaau

SEQ ID NO: 5112 - RNA, 20 nt, Artificial Sequence
  source: /note="Description of Artificial Sequence: Synthetic oligonucleotide"
uaguaucccucacaccaaug

SEQ ID NO: 5113 - RNA, 20 nt, Artificial Sequence
  source: /note="Description of Artificial Sequence: Synthetic oligonucleotide"
caauggggaguauagaugac

SEQ ID NO: 5114 - RNA, 20 nt, Artificial Sequence
  source: /note="Description of Artificial Sequence: Synthetic oligonucleotide"
gggaguauagaugacagguu

SEQ ID NO: 5115 - RNA, 20 nt, Artificial Sequence
  source: /note="Description of Artificial Sequence: Synthetic oligonucleotide"
aaagacagugaauuccauuu

SEQ ID NO: 5116 - RNA, 20 nt, Artificial Sequence
  source: /note="Description of Artificial Sequence: Synthetic oligonucleotide"
aguugaauuugaagugccua

SEQ ID NO: 5117 - RNA, 20 nt, Artificial Sequence
  source: /note="Description of Artificial Sequence: Synthetic oligonucleotide"
guugaauuugaagugccuau

SEQ ID NO: 5118 - RNA, 20 nt, Artificial Sequence
  source: /note="Description of Artificial Sequence: Synthetic oligonucleotide"
gaagugccuaugggacauac

SEQ ID NO: 5119 - RNA, 20 nt, Artificial Sequence
  source: /note="Description of Artificial Sequence: Synthetic oligonucleotide"
acauacagguacagaugacu

SEQ ID NO: 5120 - RNA, 20 nt, Artificial Sequence
  source: /note="Description of Artificial Sequence: Synthetic oligonucleotide"
uaaauugcuacuugaguuca

SEQ ID NO: 5121 - RNA, 20 nt, Artificial Sequence
  source: /note="Description of Artificial Sequence: Synthetic oligonucleotide"
aaauugcuacuugaguucau

SEQ ID NO: 5122 - RNA, 20 nt, Artificial Sequence
  source: /note="Description of Artificial Sequence: Synthetic oligonucleotide"
ugaguucaugggaauaaaau

SEQ ID NO: 5123 - RNA, 20 nt, Artificial Sequence
  source: /note="Description of Artificial Sequence: Synthetic oligonucleotide"
aaaauaggucauucugcaaa

SEQ ID NO: 5124 - RNA, 20 nt, Artificial Sequence
  source: /note="Description of Artificial Sequence: Synthetic oligonucleotide"
ugguuaucucaauaucuucc

SEQ ID NO: 5125 - RNA, 20 nt, Artificial Sequence
  source: /note="Description of Artificial Sequence: Synthetic oligonucleotide"
auaucuuccuggccaucucu

SEQ ID NO: 5126 - RNA, 20 nt, Artificial Sequence
  source: /note="Description of Artificial Sequence: Synthetic oligonucleotide"
uaucuuccuggccaucucuu

SEQ ID NO: 5127 - RNA, 20 nt, Artificial Sequence
  source: /note="Description of Artificial Sequence: Synthetic oligonucleotide"
ucuaaauucucauguuuuua

SEQ ID NO: 5128 - RNA, 20 nt, Artificial Sequence
  source: /note="Description of Artificial Sequence: Synthetic oligonucleotide"
guuuuuaaggcucucaucuu

SEQ ID NO: 5129 - RNA, 20 nt, Artificial Sequence
  source: /note="Description of Artificial Sequence: Synthetic oligonucleotide"
caucuuaggccaacuuaucu

SEQ ID NO: 5130 - RNA, 20 nt, Artificial Sequence
  source: /note="Description of Artificial Sequence: Synthetic oligonucleotide"
aucuuaggccaacuuaucuu

SEQ ID NO: 5131 - RNA, 20 nt, Artificial Sequence
  source: /note="Description of Artificial Sequence: Synthetic oligonucleotide"
ucucuaaauuugugcuuuua

SEQ ID NO: 5132 - RNA, 20 nt, Artificial Sequence
  source: /note="Description of Artificial Sequence: Synthetic oligonucleotide"
uuaaggccccauucucaagc

SEQ ID NO: 5133 - RNA, 20 nt, Artificial Sequence
  source: /note="Description of Artificial Sequence: Synthetic oligonucleotide"
ucaagcuggcuucucuguuu

SEQ ID NO: 5134 - RNA, 20 nt, Artificial Sequence
  source: /note="Description of Artificial Sequence: Synthetic oligonucleotide"
agcuggcuucucuguuuugg

SEQ ID NO: 5135 - RNA, 20 nt, Artificial Sequence
  source: /note="Description of Artificial Sequence: Synthetic oligonucleotide"
gcuggcuucucuguuuuggu

SEQ ID NO: 5136 - RNA, 20 nt, Artificial Sequence
  source: /note="Description of Artificial Sequence: Synthetic oligonucleotide"
uucucuguuuuggugggaac

SEQ ID NO: 5137 - RNA, 20 nt, Artificial Sequence
  source: /note="Description of Artificial Sequence: Synthetic oligonucleotide"
ucauuuguaaacaacccaaa

SEQ ID NO: 5138 - RNA, 20 nt, Artificial Sequence
  source: /note="Description of Artificial Sequence: Synthetic oligonucleotide"
ccaaauggcuagcauugagc

SEQ ID NO: 5139 - RNA, 20 nt, Artificial Sequence
  source: /note="Description of Artificial Sequence: Synthetic oligonucleotide"
uuacauuuugaguuaucuga

SEQ ID NO: 5140 - RNA, 20 nt, Artificial Sequence
  source: /note="Description of Artificial Sequence: Synthetic oligonucleotide"
aaggaucaauaucucaaacu

SEQ ID NO: 5141 - RNA, 20 nt, Artificial Sequence
  source: /note="Description of Artificial Sequence: Synthetic oligonucleotide"
uuuucuugccuuuaaguaua

SEQ ID NO: 5142 - RNA, 20 nt, Artificial Sequence
  source: /note="Description of Artificial Sequence: Synthetic oligonucleotide"
uuucuugccuuuaaguauaa

SEQ ID NO: 5143 - RNA, 20 nt, Artificial Sequence
  source: /note="Description of Artificial Sequence: Synthetic oligonucleotide"
acaaguuaaaaaauuuaauu

SEQ ID NO: 5144 - RNA, 20 nt, Artificial Sequence
  source: /note="Description of Artificial Sequence: Synthetic oligonucleotide"
agcaugaagaagaguaaaau

SEQ ID NO: 5145 - RNA, 20 nt, Artificial Sequence
  source: /note="Description of Artificial Sequence: Synthetic oligonucleotide"
gaagaagaguaaaauaggag

SEQ ID NO: 5146 - RNA, 20 nt, Artificial Sequence
  source: /note="Description of Artificial Sequence: Synthetic oligonucleotide"
aguaaaauaggaguggauaa

SEQ ID NO: 5147 - RNA, 20 nt, Artificial Sequence
  source: /note="Description of Artificial Sequence: Synthetic oligonucleotide"
aggaguggauaaaggcacag

SEQ ID NO: 5148 - RNA, 20 nt, Artificial Sequence
  source: /note="Description of Artificial Sequence: Synthetic oligonucleotide"
uccaauuaaucucaaaguuu

SEQ ID NO: 5149 - RNA, 20 nt, Artificial Sequence
  source: /note="Description of Artificial Sequence: Synthetic oligonucleotide"
ugucuuccugcuuuuugacg

SEQ ID NO: 5150 - RNA, 20 nt, Artificial Sequence
  source: /note="Description of Artificial Sequence: Synthetic oligonucleotide"
ugguaaccugccauaacaaa

SEQ ID NO: 5151 - RNA, 20 nt, Artificial Sequence
  source: /note="Description of Artificial Sequence: Synthetic oligonucleotide"
ccauaacaaaaggaaacagc

SEQ ID NO: 5152 - RNA, 20 nt, Artificial Sequence
  source: /note="Description of Artificial Sequence: Synthetic oligonucleotide"
aaaggaaacagcaggaaacu

SEQ ID NO: 5153 - RNA, 20 nt, Artificial Sequence
  source: /note="Description of Artificial Sequence: Synthetic oligonucleotide"
aaguguuuuagagugaaaca

SEQ ID NO: 5154 - RNA, 20 nt, Artificial Sequence
  source: /note="Description of Artificial Sequence: Synthetic oligonucleotide"
gaaacaaggauaaagagaca

SEQ ID NO: 5155 - RNA, 20 nt, Artificial Sequence
  source: /note="Description of Artificial Sequence: Synthetic oligonucleotide"
uauuaaauuuuaacaucugc

SEQ ID NO: 5156 - RNA, 20 nt, Artificial Sequence
  source: /note="Description of Artificial Sequence: Synthetic oligonucleotide"
caugccaguagaauuaaguu

SEQ ID NO: 5157 - RNA, 20 nt, Artificial Sequence
  source: /note="Description of Artificial Sequence: Synthetic oligonucleotide"
gaaaugaaauagaugccuca

SEQ ID NO: 5158 - RNA, 20 nt, Artificial Sequence
  source: /note="Description of Artificial Sequence: Synthetic oligonucleotide"
gaaauagaugccucaaggca

SEQ ID NO: 5159 - RNA, 20 nt, Artificial Sequence
  source: /note="Description of Artificial Sequence: Synthetic oligonucleotide"
uauauauauauguuugagcg

SEQ ID NO: 5160 - RNA, 20 nt, Artificial Sequence
  source: /note="Description of Artificial Sequence: Synthetic oligonucleotide"
auauauauauguuugagcga

SEQ ID NO: 5161 - RNA, 20 nt, Artificial Sequence
  source: /note="Description of Artificial Sequence: Synthetic oligonucleotide"
uauauauauguuugagcgag

SEQ ID NO: 5162 - RNA, 20 nt, Artificial Sequence
  source: /note="Description of Artificial Sequence: Synthetic oligonucleotide"
ucuagcaaaacugaauacac

SEQ ID NO: 5163 - RNA, 20 nt, Artificial Sequence
  source: /note="Description of Artificial Sequence: Synthetic oligonucleotide"
uuuuuuuauccauucacuuu

SEQ ID NO: 5164 - RNA, 20 nt, Artificial Sequence
  source: /note="Description of Artificial Sequence: Synthetic oligonucleotide"
cagcugugaguuauucaacc

SEQ ID NO: 5165 - RNA, 20 nt, Artificial Sequence
  source: /note="Description of Artificial Sequence: Synthetic oligonucleotide"
agucugauuaauaacguuua

SEQ ID NO: 5166 - RNA, 20 nt, Artificial Sequence
  source: /note="Description of Artificial Sequence: Synthetic oligonucleotide"
aaaugaauuuccauccaaau

SEQ ID NO: 5167 - RNA, 20 nt, Artificial Sequence
  source: /note="Description of Artificial Sequence: Synthetic oligonucleotide"
aaugaauuuccauccaaaua

SEQ ID NO: 5168 - RNA, 20 nt, Artificial Sequence
  source: /note="Description of Artificial Sequence: Synthetic oligonucleotide"
gaauuuccauccaaauaggg

SEQ ID NO: 5169 - RNA, 20 nt, Artificial Sequence
  source: /note="Description of Artificial Sequence: Synthetic oligonucleotide"
caguguugacugagaugcuc

SEQ ID NO: 5170 - RNA, 20 nt, Artificial Sequence
  source: /note="Description of Artificial Sequence: Synthetic oligonucleotide"
ugagaugcucuggaugagcc

SEQ ID NO: 5171 - RNA, 20 nt, Artificial Sequence
  source: /note="Description of Artificial Sequence: Synthetic oligonucleotide"
gacucagagcucaccaacuu

SEQ ID NO: 5172 - RNA, 20 nt, Artificial Sequence
  source: /note="Description of Artificial Sequence: Synthetic oligonucleotide"
ucuuuauguuaaguagucag

SEQ ID NO: 5173 - RNA, 20 nt, Artificial Sequence
  source: /note="Description of Artificial Sequence: Synthetic oligonucleotide"
cuuuauguuaaguagucagu

SEQ ID NO: 5174 - RNA, 20 nt, Artificial Sequence
  source: /note="Description of Artificial Sequence: Synthetic oligonucleotide"
uuuauguuaaguagucagug

SEQ ID NO: 5175 - RNA, 20 nt, Artificial Sequence
  source: /note="Description of Artificial Sequence: Synthetic oligonucleotide"
uguucuacaccucuugauau

SEQ ID NO: 5176 - RNA, 20 nt, Artificial Sequence
  source: /note="Description of Artificial Sequence: Synthetic oligonucleotide"
caccucuugauauaggucag

SEQ ID NO: 5177 - RNA, 20 nt, Artificial Sequence
  source: /note="Description of Artificial Sequence: Synthetic oligonucleotide"
aaacaguacauauaccaagu

SEQ ID NO: 5178 - RNA, 20 nt, Artificial Sequence
  source: /note="Description of Artificial Sequence: Synthetic oligonucleotide"
accaaguugguuugucacaa

SEQ ID NO: 5179 - RNA, 20 nt, Artificial Sequence
  source: /note="Description of Artificial Sequence: Synthetic oligonucleotide"
ccaaguugguuugucacaau

SEQ ID NO: 5180 - RNA, 20 nt, Artificial Sequence
  source: /note="Description of Artificial Sequence: Synthetic oligonucleotide"
uuuguguguauguuucugaa

SEQ ID NO: 5181 - RNA, 20 nt, Artificial Sequence
  source: /note="Description of Artificial Sequence: Synthetic oligonucleotide"
uuguguguauguuucugaau

SEQ ID NO: 5182 - RNA, 20 nt, Artificial Sequence
  source: /note="Description of Artificial Sequence: Synthetic oligonucleotide"
uacauaauuuuacucuuccu

SEQ ID NO: 5183 - RNA, 20 nt, Artificial Sequence
  source: /note="Description of Artificial Sequence: Synthetic oligonucleotide"
ggugaagaugcuuuuauaag

SEQ ID NO: 5184 - RNA, 20 nt, Artificial Sequence
  source: /note="Description of Artificial Sequence: Synthetic oligonucleotide"
agaaaauuaagaaauguugu

SEQ ID NO: 5185 - RNA, 20 nt, Artificial Sequence
  source: /note="Description of Artificial Sequence: Synthetic oligonucleotide"
uuuaaacagaauuaguauag

SEQ ID NO: 5186 - RNA, 20 nt, Artificial Sequence
  source: /note="Description of Artificial Sequence: Synthetic oligonucleotide"
gaggugugaagaucuacuga

SEQ ID NO: 5187 - RNA, 20 nt, Artificial Sequence
  source: /note="Description of Artificial Sequence: Synthetic oligonucleotide"
aggugugaagaucuacugaa

SEQ ID NO: 5188 - RNA, 20 nt, Artificial Sequence
  source: /note="Description of Artificial Sequence: Synthetic oligonucleotide"
ugaagggugauaaguaagug

SEQ ID NO: 5189 - RNA, 20 nt, Artificial Sequence
  source: /note="Description of Artificial Sequence: Synthetic oligonucleotide"
auaaguaaguguggaagaga

SEQ ID NO: 5190 - RNA, 20 nt, Artificial Sequence
  source: /note="Description of Artificial Sequence: Synthetic oligonucleotide"
gaagagaugguguucagcau

SEQ ID NO: 5191 - RNA, 20 nt, Artificial Sequence
  source: /note="Description of Artificial Sequence: Synthetic oligonucleotide"
aagagaugguguucagcauu

SEQ ID NO: 5192 - RNA, 20 nt, Artificial Sequence
  source: /note="Description of Artificial Sequence: Synthetic oligonucleotide"
cauugggcuucaguaugaau

SEQ ID NO: 5193 - RNA, 20 nt, Artificial Sequence
  source: /note="Description of Artificial Sequence: Synthetic oligonucleotide"
gaauagguagaagaugagca

SEQ ID NO: 5194 - RNA, 20 nt, Artificial Sequence
  source: /note="Description of Artificial Sequence: Synthetic oligonucleotide"
agacaagaaguucauucaau

SEQ ID NO: 5195 - RNA, 20 nt, Artificial Sequence
  source: /note="Description of Artificial Sequence: Synthetic oligonucleotide"
guucauucaauaggcuguug

SEQ ID NO: 5196 - RNA, 20 nt, Artificial Sequence
  source: /note="Description of Artificial Sequence: Synthetic oligonucleotide"
gcgguuauccagcaaugaga

SEQ ID NO: 5197 - RNA, 20 nt, Artificial Sequence
  source: /note="Description of Artificial Sequence: Synthetic oligonucleotide"
gauggugacagcaugagcca

SEQ ID NO: 5198 - RNA, 20 nt, Artificial Sequence
  source: /note="Description of Artificial Sequence: Synthetic oligonucleotide"
gagccaugguaguaaaagua

SEQ ID NO: 5199 - RNA, 20 nt, Artificial Sequence
  source: /note="Description of Artificial Sequence: Synthetic oligonucleotide"
ugguaguaaaaguaaggaca

SEQ ID NO: 5200 - RNA, 20 nt, Artificial Sequence
  source: /note="Description of Artificial Sequence: Synthetic oligonucleotide"
guaaggacauggauaauuug

SEQ ID NO: 5201 - RNA, 20 nt, Artificial Sequence
  source: /note="Description of Artificial Sequence: Synthetic oligonucleotide"
uaaggacauggauaauuugu

SEQ ID NO: 5202 - RNA, 20 nt, Artificial Sequence
  source: /note="Description of Artificial Sequence: Synthetic oligonucleotide"
aauaagaacauagaaccgau

SEQ ID NO: 5203 - RNA, 20 nt, Artificial Sequence
  source: /note="Description of Artificial Sequence: Synthetic oligonucleotide"
ccgauagguuauuuuuuaaa

SEQ ID NO: 5204 - RNA, 20 nt, Artificial Sequence
  source: /note="Description of Artificial Sequence: Synthetic oligonucleotide"
cgauagguuauuuuuuaaac

SEQ ID NO: 5205 - RNA, 20 nt, Artificial Sequence
  source: /note="Description of Artificial Sequence: Synthetic oligonucleotide"
aagaaagaauuaaacaucca

SEQ ID NO: 5206 - RNA, 20 nt, Artificial Sequence
  source: /note="Description of Artificial Sequence: Synthetic oligonucleotide"
uuucuucuuaaguaacugcg

SEQ ID NO: 5207 - RNA, 20 nt, Artificial Sequence
  source: /note="Description of Artificial Sequence: Synthetic oligonucleotide"
gauaguaccccucacacuga

SEQ ID NO: 5208 - RNA, 20 nt, Artificial Sequence
  source: /note="Description of Artificial Sequence: Synthetic oligonucleotide"
auaguaccccucacacugau

SEQ ID NO: 5209 - RNA, 20 nt, Artificial Sequence
  source: /note="Description of Artificial Sequence: Synthetic oligonucleotide"
uaguaccccucacacugaug

SEQ ID NO: 5210 - RNA, 20 nt, Artificial Sequence
  source: /note="Description of Artificial Sequence: Synthetic oligonucleotide"
ugauggggaauguagaugac

SEQ ID NO: 5211 - RNA, 20 nt, Artificial Sequence
  source: /note="Description of Artificial Sequence: Synthetic oligonucleotide"
gggaauguagaugacagguu

SEQ ID NO: 5212 - RNA, 20 nt, Artificial Sequence
  source: /note="Description of Artificial Sequence: Synthetic oligonucleotide"
ugaaagaaugaauuccauuu

SEQ ID NO: 5213 - RNA, 20 nt, Artificial Sequence
  source: /note="Description of Artificial Sequence: Synthetic oligonucleotide"
aguagaguuugaagugccua

SEQ ID NO: 5214 - RNA, 20 nt, Artificial Sequence
  source: /note="Description of Artificial Sequence: Synthetic oligonucleotide"
guagaguuugaagugccuau

SEQ ID NO: 5215 - RNA, 20 nt, Artificial Sequence
  source: /note="Description of Artificial Sequence: Synthetic oligonucleotide"
gaagugccuaugggacauac

SEQ ID NO: 5216 - RNA, 20 nt, Artificial Sequence
  source: /note="Description of Artificial Sequence: Synthetic oligonucleotide"
acauacagguacagaugacu

SEQ ID NO: 5217 - RNA, 20 nt, Artificial Sequence
  source: /note="Description of Artificial Sequence: Synthetic oligonucleotide"
caaauugugaacucugcuga

SEQ ID NO: 5218 - RNA, 20 nt, Artificial Sequence
  source: /note="Description of Artificial Sequence: Synthetic oligonucleotide"
ugaauugcuacuugaguuca

SEQ ID NO: 5219 - RNA, 20 nt, Artificial Sequence
  source: /note="Description of Artificial Sequence: Synthetic oligonucleotide"
gaauugcuacuugaguucau

SEQ ID NO: 5220 - RNA, 20 nt, Artificial Sequence
  source: /note="Description of Artificial Sequence: Synthetic oligonucleotide"
ugaguucaugggaauaaaau

SEQ ID NO: 5221 - RNA, 20 nt, Artificial Sequence
  source: /note="Description of Artificial Sequence: Synthetic oligonucleotide"
uuguuaucucaauaucuucc

SEQ ID NO: 5222 - RNA, 20 nt, Artificial Sequence
  source: /note="Description of Artificial Sequence: Synthetic oligonucleotide"
auaucuuccuggccaucucu

SEQ ID NO: 5223 - RNA, 20 nt, Artificial Sequence
  source: /note="Description of Artificial Sequence: Synthetic oligonucleotide"
uaucuuccuggccaucucuu

SEQ ID NO: 5224 - RNA, 20 nt, Artificial Sequence
  source: /note="Description of Artificial Sequence: Synthetic oligonucleotide"
ucuuuacaaugucaaaauuc

SEQ ID NO: 5225 - RNA, 20 nt, Artificial Sequence
  source: /note="Description of Artificial Sequence: Synthetic oligonucleotide"
ucaaaauucugguguuuuua

SEQ ID NO: 5226 - RNA, 20 nt, Artificial Sequence
  source: /note="Description of Artificial Sequence: Synthetic oligonucleotide"
guuuuuaaggccccaaucuc

SEQ ID NO: 5227 - RNA, 20 nt, Artificial Sequence
  source: /note="Description of Artificial Sequence: Synthetic oligonucleotide"
uuaaggccccaaucucaggc

SEQ ID NO: 5228 - RNA, 20 nt, Artificial Sequence
  source: /note="Description of Artificial Sequence: Synthetic oligonucleotide"
ucuccaacuguacucuuacu

SEQ ID NO: 5229 - RNA, 20 nt, Artificial Sequence
  source: /note="Description of Artificial Sequence: Synthetic oligonucleotide"
cuccaacuguacucuuacuu

SEQ ID NO: 5230 - RNA, 20 nt, Artificial Sequence
  source: /note="Description of Artificial Sequence: Synthetic oligonucleotide"
gggaugaucuuaucuaguca

SEQ ID NO: 5231 - RNA, 20 nt, Artificial Sequence
  source: /note="Description of Artificial Sequence: Synthetic oligonucleotide"
ggaugaucuuaucuagucau

SEQ ID NO: 5232 - RNA, 20 nt, Artificial Sequence
  source: /note="Description of Artificial Sequence: Synthetic oligonucleotide"
gaugaucuuaucuagucaug

SEQ ID NO: 5233 - RNA, 20 nt, Artificial Sequence
  source: /note="Description of Artificial Sequence: Synthetic oligonucleotide"
cauggggcauuaaauaccau

SEQ ID NO: 5234 - RNA, 20 nt, Artificial Sequence
  source: /note="Description of Artificial Sequence: Synthetic oligonucleotide"
gggcauuaaauaccauuggu

SEQ ID NO: 5235 - RNA, 20 nt, Artificial Sequence
  source: /note="Description of Artificial Sequence: Synthetic oligonucleotide"
uuagcucaagacaaaacucu

SEQ ID NO: 5236 - RNA, 20 nt, Artificial Sequence
  source: /note="Description of Artificial Sequence: Synthetic oligonucleotide"
ccacugcuauucucuaguuc

SEQ ID NO: 5237 - RNA, 20 nt, Artificial Sequence
  source: /note="Description of Artificial Sequence: Synthetic oligonucleotide"
uccuuucucuuguauuacug

SEQ ID NO: 5238 - RNA, 20 nt, Artificial Sequence
  source: /note="Description of Artificial Sequence: Synthetic oligonucleotide"
cuaccagagugaucuuuuaa

SEQ ID NO: 5239 - RNA, 20 nt, Artificial Sequence
  source: /note="Description of Artificial Sequence: Synthetic oligonucleotide"
cuuuauauauaaugcaccua

SEQ ID NO: 5240 - RNA, 20 nt, Artificial Sequence
  source: /note="Description of Artificial Sequence: Synthetic oligonucleotide"
augcaccuauggcuucccac

SEQ ID NO: 5241 - RNA, 20 nt, Artificial Sequence
  source: /note="Description of Artificial Sequence: Synthetic oligonucleotide"
cuuaacacuuuacuccucca

SEQ ID NO: 5242 - RNA, 20 nt, Artificial Sequence
  source: /note="Description of Artificial Sequence: Synthetic oligonucleotide"
ucuagcugaaucauucuucc

SEQ ID NO: 5243 - RNA, 20 nt, Artificial Sequence
  source: /note="Description of Artificial Sequence: Synthetic oligonucleotide"
cuuccaggucauucuaucau

SEQ ID NO: 5244 - RNA, 20 nt, Artificial Sequence
  source: /note="Description of Artificial Sequence: Synthetic oligonucleotide"
ucugaaauuguuuguuuauu

SEQ ID NO: 5245 - RNA, 20 nt, Artificial Sequence
  source: /note="Description of Artificial Sequence: Synthetic oligonucleotide"
uuugucuagauaaacuucac

SEQ ID NO: 5246 - RNA, 20 nt, Artificial Sequence
  source: /note="Description of Artificial Sequence: Synthetic oligonucleotide"
uagauaaacuucacugguga

SEQ ID NO: 5247 - RNA, 20 nt, Artificial Sequence
  source: /note="Description of Artificial Sequence: Synthetic oligonucleotide"
gaaagaauguugaagagaag

SEQ ID NO: 5248 - RNA, 20 nt, Artificial Sequence
  source: /note="Description of Artificial Sequence: Synthetic oligonucleotide"
aaagaauguugaagagaaga

SEQ ID NO: 5249 - RNA, 20 nt, Artificial Sequence
  source: /note="Description of Artificial Sequence: Synthetic oligonucleotide"
ggguccaguccagcccccug

SEQ ID NO: 5250 - RNA, 20 nt, Artificial Sequence
  source: /note="Description of Artificial Sequence: Synthetic oligonucleotide"
cccugaggugaccagcauuu

SEQ ID NO: 5251 - RNA, 20 nt, Artificial Sequence
  source: /note="Description of Artificial Sequence: Synthetic oligonucleotide"
ccugaggugaccagcauuua

SEQ ID NO: 5252 - RNA, 20 nt, Artificial Sequence
  source: /note="Description of Artificial Sequence: Synthetic oligonucleotide"
agcauuuagggaauaagccg

SEQ ID NO: 5253 - RNA, 20 nt, Artificial Sequence
  source: /note="Description of Artificial Sequence: Synthetic oligonucleotide"
uagggaauaagccgaggcag

SEQ ID NO: 5254 - RNA, 20 nt, Artificial Sequence
  source: /note="Description of Artificial Sequence: Synthetic oligonucleotide"
ggaauaagccgaggcagagg

SEQ ID NO: 5255 - RNA, 20 nt, Artificial Sequence
  source: /note="Description of Artificial Sequence: Synthetic oligonucleotide"
gaauaagccgaggcagagga

SEQ ID NO: 5256 - RNA, 20 nt, Artificial Sequence
  source: /note="Description of Artificial Sequence: Synthetic oligonucleotide"
gcagaggagggccauuaaga

SEQ ID NO: 5257 - RNA, 20 nt, Artificial Sequence
  source: /note="Description of Artificial Sequence: Synthetic oligonucleotide"
gaaggagcaaugagagauag

SEQ ID NO: 5258 - RNA, 20 nt, Artificial Sequence
  source: /note="Description of Artificial Sequence: Synthetic oligonucleotide"
auagaggaaaacuaagaaca

SEQ ID NO: 5259 - RNA, 20 nt, Artificial Sequence
  source: /note="Description of Artificial Sequence: Synthetic oligonucleotide"
aagugagaguguccuaacac

SEQ ID NO: 5260 - RNA, 20 nt, Artificial Sequence
  source: /note="Description of Artificial Sequence: Synthetic oligonucleotide"
cuaacacaggucuaaaugaa

SEQ ID NO: 5261 - RNA, 20 nt, Artificial Sequence
  source: /note="Description of Artificial Sequence: Synthetic oligonucleotide"
augaaaggauaguucagaag

SEQ ID NO: 5262 - RNA, 20 nt, Artificial Sequence
  source: /note="Description of Artificial Sequence: Synthetic oligonucleotide"
ugaaaggauaguucagaaga

SEQ ID NO: 5263 - RNA, 20 nt, Artificial Sequence
  source: /note="Description of Artificial Sequence: Synthetic oligonucleotide"
ucagaagagggcacugcagc

SEQ ID NO: 5264 - RNA, 20 nt, Artificial Sequence
  source: /note="Description of Artificial Sequence: Synthetic oligonucleotide"
uggcugaaagagaacaagaa

SEQ ID NO: 5265 - RNA, 20 nt, Artificial Sequence
  source: /note="Description of Artificial Sequence: Synthetic oligonucleotide"
agagaacaagaaaggcugua

SEQ ID NO: 5266 - RNA, 20 nt, Artificial Sequence
  source: /note="Description of Artificial Sequence: Synthetic oligonucleotide"
gaacaagaaaggcuguaagg

SEQ ID NO: 5267 - RNA, 20 nt, Artificial Sequence
  source: /note="Description of Artificial Sequence: Synthetic oligonucleotide"
caagaaaggcuguaaggugg

SEQ ID NO: 5268 - RNA, 20 nt, Artificial Sequence
  source: /note="Description of Artificial Sequence: Synthetic oligonucleotide"
uuaauugagccgugaaagau

SEQ ID NO: 5269 - RNA, 20 nt, Artificial Sequence
  source: /note="Description of Artificial Sequence: Synthetic oligonucleotide"
uaauugagccgugaaagaua

SEQ ID NO: 5270 - RNA, 20 nt, Artificial Sequence
  source: /note="Description of Artificial Sequence: Synthetic oligonucleotide"
gauagggaaauucuguauga

SEQ ID NO: 5271 - RNA, 20 nt, Artificial Sequence
  source: /note="Description of Artificial Sequence: Synthetic oligonucleotide"
auucuguaugaaggaguaaa

SEQ ID NO: 5272 - RNA, 20 nt, Artificial Sequence
  source: /note="Description of Artificial Sequence: Synthetic oligonucleotide"
cuguaugaaggaguaaaugg

SEQ ID NO: 5273 - RNA, 20 nt, Artificial Sequence
  source: /note="Description of Artificial Sequence: Synthetic oligonucleotide"
aggaguaaauggaggcauag

SEQ ID NO: 5274 - RNA, 20 nt, Artificial Sequence
  source: /note="Description of Artificial Sequence: Synthetic oligonucleotide"
auggaggcauagaggcauag

SEQ ID NO: 5275 - RNA, 20 nt, Artificial Sequence
  source: /note="Description of Artificial Sequence: Synthetic oligonucleotide"
gcagaagaugcaugccuguu

SEQ ID NO: 5276 - RNA, 20 nt, Artificial Sequence
  source: /note="Description of Artificial Sequence: Synthetic oligonucleotide"
cagaagaugcaugccuguuu

SEQ ID NO: 5277 - RNA, 20 nt, Artificial Sequence
  source: /note="Description of Artificial Sequence: Synthetic oligonucleotide"
agaagaugcaugccuguuug

SEQ ID NO: 5278 - RNA, 20 nt, Artificial Sequence
  source: /note="Description of Artificial Sequence: Synthetic oligonucleotide"
gucacuagauuaaaaaacaa

SEQ ID NO: 5279 - RNA, 20 nt, Artificial Sequence
  source: /note="Description of Artificial Sequence: Synthetic oligonucleotide"
uaaaaaacaaaggcuccauc

SEQ ID NO: 5280 - RNA, 20 nt, Artificial Sequence
  source: /note="Description of Artificial Sequence: Synthetic oligonucleotide"
acacaguaaacagaagaaua

SEQ ID NO: 5281 - RNA, 20 nt, Artificial Sequence
  source: /note="Description of Artificial Sequence: Synthetic oligonucleotide"
cagaagaauauggauuuaaa

SEQ ID NO: 5282 - RNA, 20 nt, Artificial Sequence
  source: /note="Description of Artificial Sequence: Synthetic oligonucleotide"
uaagucauugagauuccuua

SEQ ID NO: 5283 - RNA, 20 nt, Artificial Sequence
  source: /note="Description of Artificial Sequence: Synthetic oligonucleotide"
auauaacaguaugccaaugu

SEQ ID NO: 5284 - RNA, 20 nt, Artificial Sequence
  source: /note="Description of Artificial Sequence: Synthetic oligonucleotide"
aguaugccaauguaggaaug

SEQ ID NO: 5285 - RNA, 20 nt, Artificial Sequence
  source: /note="Description of Artificial Sequence: Synthetic oligonucleotide"
ggaaugaggcgugaauaagc

SEQ ID NO: 5286 - RNA, 20 nt, Artificial Sequence
  source: /note="Description of Artificial Sequence: Synthetic oligonucleotide"
gaaugaggcgugaauaagca

SEQ ID NO: 5287 - RNA, 20 nt, Artificial Sequence
  source: /note="Description of Artificial Sequence: Synthetic oligonucleotide"
ucucaccuugauuauuccuu

SEQ ID NO: 5288 - RNA, 20 nt, Artificial Sequence
  source: /note="Description of Artificial Sequence: Synthetic oligonucleotide"
uuauuccuuugguagcuuca

SEQ ID NO: 5289 - RNA, 20 nt, Artificial Sequence
  source: /note="Description of Artificial Sequence: Synthetic oligonucleotide"
uauuccuuugguagcuucaa

SEQ ID NO: 5290 - RNA, 20 nt, Artificial Sequence
  source: /note="Description of Artificial Sequence: Synthetic oligonucleotide"
uucaagggaaauugaguuug

SEQ ID NO: 5291 - RNA, 20 nt, Artificial Sequence
  source: /note="Description of Artificial Sequence: Synthetic oligonucleotide"
gcaguuuuuaucuagucaga

SEQ ID NO: 5292 - RNA, 20 nt, Artificial Sequence
  source: /note="Description of Artificial Sequence: Synthetic oligonucleotide"
gucagaugguugagaagucc

SEQ ID NO: 5293 - RNA, 20 nt, Artificial Sequence
  source: /note="Description of Artificial Sequence: Synthetic oligonucleotide"
ucaguguaccuuucagauug

SEQ ID NO: 5294 - RNA, 20 nt, Artificial Sequence
  source: /note="Description of Artificial Sequence: Synthetic oligonucleotide"
aauaagcucauguuaguuuc

SEQ ID NO: 5295 - RNA, 20 nt, Artificial Sequence
  source: /note="Description of Artificial Sequence: Synthetic oligonucleotide"
uaauauuuacauauaaugac

SEQ ID NO: 5296 - RNA, 20 nt, Artificial Sequence
  source: /note="Description of Artificial Sequence: Synthetic oligonucleotide"
ccuguauuugccuuuauuug

SEQ ID NO: 5297 - RNA, 20 nt, Artificial Sequence
  source: /note="Description of Artificial Sequence: Synthetic oligonucleotide"
cuguauuugccuuuauuugu

SEQ ID NO: 5298 - RNA, 20 nt, Artificial Sequence
  source: /note="Description of Artificial Sequence: Synthetic oligonucleotide"
caaaauuuucaaauugugua

SEQ ID NO: 5299 - RNA, 20 nt, Artificial Sequence
  source: /note="Description of Artificial Sequence: Synthetic oligonucleotide"
auuuucaaauuguguauggc

SEQ ID NO: 5300 - RNA, 20 nt, Artificial Sequence
  source: /note="Description of Artificial Sequence: Synthetic oligonucleotide"
auggcuggucuauauuuucu

SEQ ID NO: 5301 - RNA, 20 nt, Artificial Sequence
  source: /note="Description of Artificial Sequence: Synthetic oligonucleotide"
uuuucuaggacuguccuuuc

SEQ ID NO: 5302 - RNA, 20 nt, Artificial Sequence
  source: /note="Description of Artificial Sequence: Synthetic oligonucleotide"
aaaaauauuaauuuccagcc

SEQ ID NO: 5303 - RNA, 20 nt, Artificial Sequence
  source: /note="Description of Artificial Sequence: Synthetic oligonucleotide"
uauuaauuuccagccaggug

SEQ ID NO: 5304 - RNA, 20 nt, Artificial Sequence
  source: /note="Description of Artificial Sequence: Synthetic oligonucleotide"
cgccuguaaucccagcacuu

SEQ ID NO: 5305 - RNA, 20 nt, Artificial Sequence
  source: /note="Description of Artificial Sequence: Synthetic oligonucleotide"
gccuguaaucccagcacuuu

SEQ ID NO: 5306 - RNA, 20 nt, Artificial Sequence
  source: /note="Description of Artificial Sequence: Synthetic oligonucleotide"
uguaaucccagcacuuuggg

SEQ ID NO: 5307 - RNA, 20 nt, Artificial Sequence
  source: /note="Description of Artificial Sequence: Synthetic oligonucleotide"
cccagcacuuugggaggcug

SEQ ID NO: 5308 - RNA, 20 nt, Artificial Sequence
  source: /note="Description of Artificial Sequence: Synthetic oligonucleotide"
agcacuuugggaggcugagg

SEQ ID NO: 5309 - RNA, 20 nt, Artificial Sequence
  source: /note="Description of Artificial Sequence: Synthetic oligonucleotide"
gcacuuugggaggcugaggc

SEQ ID NO: 5310 - RNA, 20 nt, Artificial Sequence
  source: /note="Description of Artificial Sequence: Synthetic oligonucleotide"
cuuugggaggcugaggcggg

SEQ ID NO: 5311 - RNA, 20 nt, Artificial Sequence
  source: /note="Description of Artificial Sequence: Synthetic oligonucleotide"
cggguggaucaccugaaguc

SEQ ID NO: 5312 - RNA, 20 nt, Artificial Sequence
  source: /note="Description of Artificial Sequence: Synthetic oligonucleotide"
ucaggaguucaaaaccagcc

SEQ ID NO: 5313 - RNA, 20 nt, Artificial Sequence
  source: /note="Description of Artificial Sequence: Synthetic oligonucleotide"
caaaaccagccuggccaaca

SEQ ID NO: 5314 - RNA, 20 nt, Artificial Sequence
  source: /note="Description of Artificial Sequence: Synthetic oligonucleotide"
uaaaaauacaaaaacuagcc

SEQ ID NO: 5315 - RNA, 20 nt, Artificial Sequence
  source: /note="Description of Artificial Sequence: Synthetic oligonucleotide"
auacaaaaacuagccaggca

SEQ ID NO: 5316 - RNA, 20 nt, Artificial Sequence
  source: /note="Description of Artificial Sequence: Synthetic oligonucleotide"
caaaaacuagccaggcaugg

SEQ ID NO: 5317 - RNA, 20 nt, Artificial Sequence
  source: /note="Description of Artificial Sequence: Synthetic oligonucleotide"
ugccuguagucccagauacu

SEQ ID NO: 5318 - RNA, 20 nt, Artificial Sequence
  source: /note="Description of Artificial Sequence: Synthetic oligonucleotide"
uguagucccagauacuugga

SEQ ID NO: 5319 - RNA, 20 nt, Artificial Sequence
  source: /note="Description of Artificial Sequence: Synthetic oligonucleotide"
cccagauacuuggauggcug

SEQ ID NO: 5320 - RNA, 20 nt, Artificial Sequence
  source: /note="Description of Artificial Sequence: Synthetic oligonucleotide"
gauacuuggauggcugaggc

SEQ ID NO: 5321 - RNA, 20 nt, Artificial Sequence
  source: /note="Description of Artificial Sequence: Synthetic oligonucleotide"
caggagaaucacuugaaccc

SEQ ID NO: 5322 - RNA, 20 nt, Artificial Sequence
  source: /note="Description of Artificial Sequence: Synthetic oligonucleotide"
gagaaucacuugaacccagg

SEQ ID NO: 5323 - RNA, 20 nt, Artificial Sequence
  source: /note="Description of Artificial Sequence: Synthetic oligonucleotide"
aaucacuugaacccaggagg

SEQ ID NO: 5324 - RNA, 20 nt, Artificial Sequence
  source: /note="Description of Artificial Sequence: Synthetic oligonucleotide"
cacuugaacccaggaggcgg

SEQ ID NO: 5325 - RNA, 20 nt, Artificial Sequence
  source: /note="Description of Artificial Sequence: Synthetic oligonucleotide"
ugugccacugcacucuagcc

SEQ ID NO: 5326 - RNA, 20 nt, Artificial Sequence
  source: /note="Description of Artificial Sequence: Synthetic oligonucleotide"
agagugagaaucugucucag

SEQ ID NO: 5327 - RNA, 20 nt, Artificial Sequence
  source: /note="Description of Artificial Sequence: Synthetic oligonucleotide"
cacccaccaaaagacuccau

SEQ ID NO: 5328 - RNA, 20 nt, Artificial Sequence
  source: /note="Description of Artificial Sequence: Synthetic oligonucleotide"
uuucugacauagaaauauac

SEQ ID NO: 5329 - RNA, 20 nt, Artificial Sequence
  source: /note="Description of Artificial Sequence: Synthetic oligonucleotide"
gcuaauagugacuauuuucu

SEQ ID NO: 5330 - RNA, 20 nt, Artificial Sequence
  source: /note="Description of Artificial Sequence: Synthetic oligonucleotide"
cuaauagugacuauuuucua

SEQ ID NO: 5331 - RNA, 20 nt, Artificial Sequence
  source: /note="Description of Artificial Sequence: Synthetic oligonucleotide"
uuuguuauucuaagucauaa

SEQ ID NO: 5332 - RNA, 20 nt, Artificial Sequence
  source: /note="Description of Artificial Sequence: Synthetic oligonucleotide"
uaagucauaaaggcagaauu

SEQ ID NO: 5333 - RNA, 20 nt, Artificial Sequence
  source: /note="Description of Artificial Sequence: Synthetic oligonucleotide"
gcuuuucaaauaugcagaag

SEQ ID NO: 5334 - RNA, 20 nt, Artificial Sequence
  source: /note="Description of Artificial Sequence: Synthetic oligonucleotide"
gcagaagaggaaaaauugag

SEQ ID NO: 5335 - RNA, 20 nt, Artificial Sequence
  source: /note="Description of Artificial Sequence: Synthetic oligonucleotide"
aaauugaguuugaaacuuac

SEQ ID NO: 5336 - RNA, 20 nt, Artificial Sequence
  source: /note="Description of Artificial Sequence: Synthetic oligonucleotide"
uauaccuaugcuugaccaaa

SEQ ID NO: 5337 - RNA, 20 nt, Artificial Sequence
  source: /note="Description of Artificial Sequence: Synthetic oligonucleotide"
ucaagcauuucccuuuaccu

SEQ ID NO: 5338 - RNA, 20 nt, Artificial Sequence
  source: /note="Description of Artificial Sequence: Synthetic oligonucleotide"
acuaccaaaagcccuucauu

SEQ ID NO: 5339 - RNA, 20 nt, Artificial Sequence
  source: /note="Description of Artificial Sequence: Synthetic oligonucleotide"
cuccauaguugcaugucuga

SEQ ID NO: 5340 - RNA, 20 nt, Artificial Sequence
  source: /note="Description of Artificial Sequence: Synthetic oligonucleotide"
aauugucauucuguuuccca

SEQ ID NO: 5341 - RNA, 20 nt, Artificial Sequence
  source: /note="Description of Artificial Sequence: Synthetic oligonucleotide"
uaguacaguacucugcucac

SEQ ID NO: 5342 - RNA, 20 nt, Artificial Sequence
  source: /note="Description of Artificial Sequence: Synthetic oligonucleotide"
aguugagcuacguuuuuuua

SEQ ID NO: 5343 - RNA, 20 nt, Artificial Sequence
  source: /note="Description of Artificial Sequence: Synthetic oligonucleotide"
agagucucccucugucgccc

SEQ ID NO: 5344 - RNA, 20 nt, Artificial Sequence
  source: /note="Description of Artificial Sequence: Synthetic oligonucleotide"
gagucucccucugucgccca

SEQ ID NO: 5345 - RNA, 20 nt, Artificial Sequence
  source: /note="Description of Artificial Sequence: Synthetic oligonucleotide"
ucucccucugucgcccaggg

SEQ ID NO: 5346 - RNA, 20 nt, Artificial Sequence
  source: /note="Description of Artificial Sequence: Synthetic oligonucleotide"
ucgcccaggguggaguacag

SEQ ID NO: 5347 - RNA, 20 nt, Artificial Sequence
  source: /note="Description of Artificial Sequence: Synthetic oligonucleotide"
cucacugcaaccucugcugc

SEQ ID NO: 5348 - RNA, 20 nt, Artificial Sequence
  source: /note="Description of Artificial Sequence: Synthetic oligonucleotide"
ucacugcaaccucugcugcu

SEQ ID NO: 5349 - RNA, 20 nt, Artificial Sequence
  source: /note="Description of Artificial Sequence: Synthetic oligonucleotide"
gucucagacucccgaguagc

SEQ ID NO: 5350 - RNA, 20 nt, Artificial Sequence
  source: /note="Description of Artificial Sequence: Synthetic oligonucleotide"
ucucagacucccgaguagcu

SEQ ID NO: 5351 - RNA, 20 nt, Artificial Sequence
  source: /note="Description of Artificial Sequence: Synthetic oligonucleotide"
uaccaccaugccaccaugcc

SEQ ID NO: 5352 - RNA, 20 nt, Artificial Sequence
  source: /note="Description of Artificial Sequence: Synthetic oligonucleotide"
gcuaacuuuuaguagaaaca

SEQ ID NO: 5353 - RNA, 20 nt, Artificial Sequence
  source: /note="Description of Artificial Sequence: Synthetic oligonucleotide"
gaaacaagguuucaccaugu

SEQ ID NO: 5354 - RNA, 20 nt, Artificial Sequence
  source: /note="Description of Artificial Sequence: Synthetic oligonucleotide"
aagguuucaccauguuggcc

SEQ ID NO: 5355 - RNA, 20 nt, Artificial Sequence
  source: /note="Description of Artificial Sequence: Synthetic oligonucleotide"
uuucaccauguuggccaggc

SEQ ID NO: 5356 - RNA, 20 nt, Artificial Sequence
  source: /note="Description of Artificial Sequence: Synthetic oligonucleotide"
ccaggcuggucuccaacucc

SEQ ID NO: 5357 - RNA, 20 nt, Artificial Sequence
  source: /note="Description of Artificial Sequence: Synthetic oligonucleotide"
cucaagugauccaccugccu

SEQ ID NO: 5358 - RNA, 20 nt, Artificial Sequence
  source: /note="Description of Artificial Sequence: Synthetic oligonucleotide"
ccuuggccucauaaagugcu

SEQ ID NO: 5359 - RNA, 20 nt, Artificial Sequence
  source: /note="Description of Artificial Sequence: Synthetic oligonucleotide"
ugucauguuacgauauauau

SEQ ID NO: 5360 - RNA, 20 nt, Artificial Sequence
  source: /note="Description of Artificial Sequence: Synthetic oligonucleotide"
uauauauugguuuuugucca

SEQ ID NO: 5361 - RNA, 20 nt, Artificial Sequence
  source: /note="Description of Artificial Sequence: Synthetic oligonucleotide"
ugguuuuuguccaugguuuc

SEQ ID NO: 5362 - RNA, 20 nt, Artificial Sequence
  source: /note="Description of Artificial Sequence: Synthetic oligonucleotide"
uacagucuuuuguuagaaug

SEQ ID NO: 5363 - RNA, 20 nt, Artificial Sequence
  source: /note="Description of Artificial Sequence: Synthetic oligonucleotide"
acagucuuuuguuagaaugu

SEQ ID NO: 5364 - RNA, 20 nt, Artificial Sequence
  source: /note="Description of Artificial Sequence: Synthetic oligonucleotide"
cagucuuuuguuagaaugug

SEQ ID NO: 5365 - RNA, 20 nt, Artificial Sequence
  source: /note="Description of Artificial Sequence: Synthetic oligonucleotide"
uguuagaauguggggugugu

SEQ ID NO: 5366 - RNA, 20 nt, Artificial Sequence
  source: /note="Description of Artificial Sequence: Synthetic oligonucleotide"
augugggguguguuggaccu

SEQ ID NO: 5367 - RNA, 20 nt, Artificial Sequence
  source: /note="Description of Artificial Sequence: Synthetic oligonucleotide"
ugugggguguguuggaccuc

SEQ ID NO: 5368 - RNA, 20 nt, Artificial Sequence
  source: /note="Description of Artificial Sequence: Synthetic oligonucleotide"
gugggguguguuggaccucg

SEQ ID NO: 5369 - RNA, 20 nt, Artificial Sequence
  source: /note="Description of Artificial Sequence: Synthetic oligonucleotide"
gguguguuggaccucggggc

SEQ ID NO: 5370 - RNA, 20 nt, Artificial Sequence
  source: /note="Description of Artificial Sequence: Synthetic oligonucleotide"
uuccuuucacuugucccccg

SEQ ID NO: 5371 - RNA, 20 nt, Artificial Sequence
  source: /note="Description of Artificial Sequence: Synthetic oligonucleotide"
uccuuucacuugucccccga

SEQ ID NO: 5372 - RNA, 20 nt, Artificial Sequence
  source: /note="Description of Artificial Sequence: Synthetic oligonucleotide"
aagacuucccugugucaccc

SEQ ID NO: 5373 - RNA, 20 nt, Artificial Sequence
  source: /note="Description of Artificial Sequence: Synthetic oligonucleotide"
cuucccugugucacccaggc

SEQ ID NO: 5374 - RNA, 20 nt, Artificial Sequence
  source: /note="Description of Artificial Sequence: Synthetic oligonucleotide"
ucacccaggcuggagugcag

SEQ ID NO: 5375 - RNA, 20 nt, Artificial Sequence
  source: /note="Description of Artificial Sequence: Synthetic oligonucleotide"
caccgcagccucagccuccu

SEQ ID NO: 5376 - RNA, 20 nt, Artificial Sequence
  source: /note="Description of Artificial Sequence: Synthetic oligonucleotide"
aucucagccucccaaguacc

SEQ ID NO: 5377 - RNA, 20 nt, Artificial Sequence
  source: /note="Description of Artificial Sequence: Synthetic oligonucleotide"
ucucagccucccaaguaccu

SEQ ID NO: 5378 - RNA, 20 nt, Artificial Sequence
  source: /note="Description of Artificial Sequence: Synthetic oligonucleotide"
ucccaaguaccugggacuac

SEQ ID NO: 5379 - RNA, 20 nt, Artificial Sequence
  source: /note="Description of Artificial Sequence: Synthetic oligonucleotide"
caggcacaugccaccacacc

SEQ ID NO: 5380 - RNA, 20 nt, Artificial Sequence
  source: /note="Description of Artificial Sequence: Synthetic oligonucleotide"
uuuuuuuuuuuuuuguagag

SEQ ID NO: 5381 - RNA, 20 nt, Artificial Sequence
  source: /note="Description of Artificial Sequence: Synthetic oligonucleotide"
uuucgccauguugcccaguc

SEQ ID NO: 5382 - RNA, 20 nt, Artificial Sequence
  source: /note="Description of Artificial Sequence: Synthetic oligonucleotide"
ccagucuggccuccagcucc

SEQ ID NO: 5383 - RNA, 20 nt, Artificial Sequence
  source: /note="Description of Artificial Sequence: Synthetic oligonucleotide"
cagucuggccuccagcuccu

SEQ ID NO: 5384 - RNA, 20 nt, Artificial Sequence
  source: /note="Description of Artificial Sequence: Synthetic oligonucleotide"
cucaagugauccacccaccu

SEQ ID NO: 5385 - RNA, 20 nt, Artificial Sequence
  source: /note="Description of Artificial Sequence: Synthetic oligonucleotide"
aaccaccacacccaacccug

SEQ ID NO: 5386 - RNA, 20 nt, Artificial Sequence
  source: /note="Description of Artificial Sequence: Synthetic oligonucleotide"
accaccacacccaacccuga

SEQ ID NO: 5387 - RNA, 20 nt, Artificial Sequence
  source: /note="Description of Artificial Sequence: Synthetic oligonucleotide"
gagucuuaaaaccccagaga

SEQ ID NO: 5388 - RNA, 20 nt, Artificial Sequence
  source: /note="Description of Artificial Sequence: Synthetic oligonucleotide"
gaaggucccacccuuugcac

SEQ ID NO: 5389 - RNA, 20 nt, Artificial Sequence
  source: /note="Description of Artificial Sequence: Synthetic oligonucleotide"
aaggucccacccuuugcacu

SEQ ID NO: 5390 - RNA, 20 nt, Artificial Sequence
  source: /note="Description of Artificial Sequence: Synthetic oligonucleotide"
aggucccacccuuugcacug

SEQ ID NO: 5391 - RNA, 20 nt, Artificial Sequence
  source: /note="Description of Artificial Sequence: Synthetic oligonucleotide"
ccacccuuugcacuggggaa

SEQ ID NO: 5392 - RNA, 20 nt, Artificial Sequence
  source: /note="Description of Artificial Sequence: Synthetic oligonucleotide"
ugaagccuccauaaaaacuc

SEQ ID NO: 5393 - RNA, 20 nt, Artificial Sequence
  source: /note="Description of Artificial Sequence: Synthetic oligonucleotide"
agccuccauaaaaacucagg

SEQ ID NO: 5394 - RNA, 20 nt, Artificial Sequence
  source: /note="Description of Artificial Sequence: Synthetic oligonucleotide"
aaacucaggaggauugaguc

SEQ ID NO: 5395 - RNA, 20 nt, Artificial Sequence
  source: /note="Description of Artificial Sequence: Synthetic oligonucleotide"
aacucaggaggauugagucu

SEQ ID NO: 5396 - RNA, 20 nt, Artificial Sequence
  source: /note="Description of Artificial Sequence: Synthetic oligonucleotide"
acucaggaggauugagucug

SEQ ID NO: 5397 - RNA, 20 nt, Artificial Sequence
  source: /note="Description of Artificial Sequence: Synthetic oligonucleotide"
gauugagucuggggagcuuc

SEQ ID NO: 5398 - RNA, 20 nt, Artificial Sequence
  source: /note="Description of Artificial Sequence: Synthetic oligonucleotide"
cuucuggauagcugaaccag

SEQ ID NO: 5399 - RNA, 20 nt, Artificial Sequence
  source: /note="Description of Artificial Sequence: Synthetic oligonucleotide"
cuggauagcugaaccagugg

SEQ ID NO: 5400 - RNA, 20 nt, Artificial Sequence
  source: /note="Description of Artificial Sequence: Synthetic oligonucleotide"
gcugaaccaguggagguucc

SEQ ID NO: 5401 - RNA, 20 nt, Artificial Sequence
  source: /note="Description of Artificial Sequence: Synthetic oligonucleotide"
aaccaguggagguuccugga

SEQ ID NO: 5402 - RNA, 20 nt, Artificial Sequence
  source: /note="Description of Artificial Sequence: Synthetic oligonucleotide"
caguggagguuccuggaagg

SEQ ID NO: 5403 - RNA, 20 nt, Artificial Sequence
  source: /note="Description of Artificial Sequence: Synthetic oligonucleotide"
uccuggaagguggcucaucc

SEQ ID NO: 5404 - RNA, 20 nt, Artificial Sequence
  source: /note="Description of Artificial Sequence: Synthetic oligonucleotide"
ccuggaagguggcucaucca

SEQ ID NO: 5405 - RNA, 20 nt, Artificial Sequence
  source: /note="Description of Artificial Sequence: Synthetic oligonucleotide"
ggaagguggcucauccaggg

SEQ ID NO: 5406 - RNA, 20 nt, Artificial Sequence
  source: /note="Description of Artificial Sequence: Synthetic oligonucleotide"
caaacguauugaacccaaag

SEQ ID NO: 5407 - RNA, 20 nt, Artificial Sequence
  source: /note="Description of Artificial Sequence: Synthetic oligonucleotide"
aaacguauugaacccaaaga

SEQ ID NO: 5408 - RNA, 20 nt, Artificial Sequence
  source: /note="Description of Artificial Sequence: Synthetic oligonucleotide"
ugaacccaaagaggguguug

SEQ ID NO: 5409 - RNA, 20 nt, Artificial Sequence
  source: /note="Description of Artificial Sequence: Synthetic oligonucleotide"
gaacccaaagaggguguugu

SEQ ID NO: 5410 - RNA, 20 nt, Artificial Sequence
  source: /note="Description of Artificial Sequence: Synthetic oligonucleotide"
ugggaaccccaacucgaagc

SEQ ID NO: 5411 - RNA, 20 nt, Artificial Sequence
  source: /note="Description of Artificial Sequence: Synthetic oligonucleotide"
aaccccaacucgaagcuggu

SEQ ID NO: 5412 - RNA, 20 nt, Artificial Sequence
  source: /note="Description of Artificial Sequence: Synthetic oligonucleotide"
agcugguuggucagaaguuc

SEQ ID NO: 5413 - RNA, 20 nt, Artificial Sequence
  source: /note="Description of Artificial Sequence: Synthetic oligonucleotide"
ugguuggucagaaguucugg

SEQ ID NO: 5414 - RNA, 20 nt, Artificial Sequence
  source: /note="Description of Artificial Sequence: Synthetic oligonucleotide"
ggucagaaguucuggaggcc

SEQ ID NO: 5415 - RNA, 20 nt, Artificial Sequence
  source: /note="Description of Artificial Sequence: Synthetic oligonucleotide"
ggauuugugacuugugucug

SEQ ID NO: 5416 - RNA, 20 nt, Artificial Sequence
  source: /note="Description of Artificial Sequence: Synthetic oligonucleotide"
uugugacuugugucuguggc

SEQ ID NO: 5417 - RNA, 20 nt, Artificial Sequence
  source: /note="Description of Artificial Sequence: Synthetic oligonucleotide"
ugucuguggcaggagcaucu

SEQ ID NO: 5418 - RNA, 20 nt, Artificial Sequence
  source: /note="Description of Artificial Sequence: Synthetic oligonucleotide"
gucuguggcaggagcaucuu

SEQ ID NO: 5419 - RNA, 20 nt, Artificial Sequence
  source: /note="Description of Artificial Sequence: Synthetic oligonucleotide"
ggaacugagcguuuaaucua

SEQ ID NO: 5420 - RNA, 20 nt, Artificial Sequence
  source: /note="Description of Artificial Sequence: Synthetic oligonucleotide"
gaacugagcguuuaaucuac

SEQ ID NO: 5421 - RNA, 20 nt, Artificial Sequence
  source: /note="Description of Artificial Sequence: Synthetic oligonucleotide"
aacugagcguuuaaucuacg

SEQ ID NO: 5422 - RNA, 20 nt, Artificial Sequence
  source: /note="Description of Artificial Sequence: Synthetic oligonucleotide"
acggggucugacacugucuc

SEQ ID NO: 5423 - RNA, 20 nt, Artificial Sequence
  source: /note="Description of Artificial Sequence: Synthetic oligonucleotide"
cggggucugacacugucucc

SEQ ID NO: 5424 - RNA, 20 nt, Artificial Sequence
  source: /note="Description of Artificial Sequence: Synthetic oligonucleotide"
acugucuccgggaauuaaau

SEQ ID NO: 5425 - RNA, 20 nt, Artificial Sequence
  source: /note="Description of Artificial Sequence: Synthetic oligonucleotide"
gucuccgggaauuaaauugg

SEQ ID NO: 5426 - RNA, 20 nt, Artificial Sequence
  source: /note="Description of Artificial Sequence: Synthetic oligonucleotide"
uagugucugcugcuuguuau

SEQ ID NO: 5427 - RNA, 20 nt, Artificial Sequence
  source: /note="Description of Artificial Sequence: Synthetic oligonucleotide"
agugucugcugcuuguuauu

SEQ ID NO: 5428 - RNA, 20 nt, Artificial Sequence
  source: /note="Description of Artificial Sequence: Synthetic oligonucleotide"
gugucugcugcuuguuauug

SEQ ID NO: 5429 - RNA, 20 nt, Artificial Sequence
  source: /note="Description of Artificial Sequence: Synthetic oligonucleotide"
gggagaaacccucacacauu

SEQ ID NO: 5430 - RNA, 20 nt, Artificial Sequence
  source: /note="Description of Artificial Sequence: Synthetic oligonucleotide"
uuguugugaugugagagcag

SEQ ID NO: 5431 - RNA, 20 nt, Artificial Sequence
  source: /note="Description of Artificial Sequence: Synthetic oligonucleotide"
agcagaggaaaaaugcauuu

SEQ ID NO: 5432 - RNA, 20 nt, Artificial Sequence
  source: /note="Description of Artificial Sequence: Synthetic oligonucleotide"
aggaaaaaugcauuuuggag

SEQ ID NO: 5433 - RNA, 20 nt, Artificial Sequence
  source: /note="Description of Artificial Sequence: Synthetic oligonucleotide"
guuuuuuccuacacagccau

SEQ ID NO: 5434 - RNA, 20 nt, Artificial Sequence
  source: /note="Description of Artificial Sequence: Synthetic oligonucleotide"
gcauuuaaacuaaaaagaau

SEQ ID NO: 5435 - RNA, 20 nt, Artificial Sequence
  source: /note="Description of Artificial Sequence: Synthetic oligonucleotide"
cuuguaaauguuuauaagau

SEQ ID NO: 5436 - RNA, 20 nt, Artificial Sequence
  source: /note="Description of Artificial Sequence: Synthetic oligonucleotide"
uuauaagauugguagcugug

SEQ ID NO: 5437 - RNA, 20 nt, Artificial Sequence
  source: /note="Description of Artificial Sequence: Synthetic oligonucleotide"
uauaagauugguagcugugu

SEQ ID NO: 5438 - RNA, 20 nt, Artificial Sequence
  source: /note="Description of Artificial Sequence: Synthetic oligonucleotide"
uuuugaaaaaagaaacagaa

SEQ ID NO: 5439 - RNA, 20 nt, Artificial Sequence
  source: /note="Description of Artificial Sequence: Synthetic oligonucleotide"
acaaagagaacauugaaaca

SEQ ID NO: 5440 - RNA, 20 nt, Artificial Sequence
  source: /note="Description of Artificial Sequence: Synthetic oligonucleotide"
caaagagaacauugaaacau

SEQ ID NO: 5441 - RNA, 20 nt, Artificial Sequence
  source: /note="Description of Artificial Sequence: Synthetic oligonucleotide"
ccagaaugccaacucauuuc

SEQ ID NO: 5442 - RNA, 20 nt, Artificial Sequence
  source: /note="Description of Artificial Sequence: Synthetic oligonucleotide"
cagaaugccaacucauuucu

SEQ ID NO: 5443 - RNA, 20 nt, Artificial Sequence
  source: /note="Description of Artificial Sequence: Synthetic oligonucleotide"
agaaugccaacucauuucug

SEQ ID NO: 5444 - RNA, 20 nt, Artificial Sequence
  source: /note="Description of Artificial Sequence: Synthetic oligonucleotide"
uuuuuauacgauaccauaaa

SEQ ID NO: 5445 - RNA, 20 nt, Artificial Sequence
  source: /note="Description of Artificial Sequence: Synthetic oligonucleotide"
uauacgauaccauaaauggu

SEQ ID NO: 5446 - RNA, 20 nt, Artificial Sequence
  source: /note="Description of Artificial Sequence: Synthetic oligonucleotide"
augaucuugauuacuaacug

SEQ ID NO: 5447 - RNA, 20 nt, Artificial Sequence
  source: /note="Description of Artificial Sequence: Synthetic oligonucleotide"
ugaucuugauuacuaacugu

SEQ ID NO: 5448 - RNA, 20 nt, Artificial Sequence
  source: /note="Description of Artificial Sequence: Synthetic oligonucleotide"
aauauuagagcuaguauacu

SEQ ID NO: 5449 - RNA, 20 nt, Artificial Sequence
  source: /note="Description of Artificial Sequence: Synthetic oligonucleotide"
gagcuaguauacuuggaguu

SEQ ID NO: 5450 - RNA, 20 nt, Artificial Sequence
  source: /note="Description of Artificial Sequence: Synthetic oligonucleotide"
uggaguuuggcuaguauuuc

SEQ ID NO: 5451 - RNA, 20 nt, Artificial Sequence
  source: /note="Description of Artificial Sequence: Synthetic oligonucleotide"
ggaguuuggcuaguauuucu

SEQ ID NO: 5452 - RNA, 20 nt, Artificial Sequence
  source: /note="Description of Artificial Sequence: Synthetic oligonucleotide"
gaguuuggcuaguauuucug

SEQ ID NO: 5453 - RNA, 20 nt, Artificial Sequence
  source: /note="Description of Artificial Sequence: Synthetic oligonucleotide"
aguuuggcuaguauuucugg

SEQ ID NO: 5454 - RNA, 20 nt, Artificial Sequence
  source: /note="Description of Artificial Sequence: Synthetic oligonucleotide"
uuggcuaguauuucuggggg

SEQ ID NO: 5455 - RNA, 20 nt, Artificial Sequence
  source: /note="Description of Artificial Sequence: Synthetic oligonucleotide"
auuucugggggagguagaag

SEQ ID NO: 5456 - RNA, 20 nt, Artificial Sequence
  source: /note="Description of Artificial Sequence: Synthetic oligonucleotide"
gccacgcugacuaaaacaaa

SEQ ID NO: 5457 - RNA, 20 nt, Artificial Sequence
  source: /note="Description of Artificial Sequence: Synthetic oligonucleotide"
ucauaguacuucuuugaaac

SEQ ID NO: 5458 - RNA, 20 nt, Artificial Sequence
  source: /note="Description of Artificial Sequence: Synthetic oligonucleotide"
aguacuucuuugaaacaggu

SEQ ID NO: 5459 - RNA, 20 nt, Artificial Sequence
  source: /note="Description of Artificial Sequence: Synthetic oligonucleotide"
guacuucuuugaaacagguc

SEQ ID NO: 5460 - RNA, 20 nt, Artificial Sequence
  source: /note="Description of Artificial Sequence: Synthetic oligonucleotide"
uacuucuuugaaacaggucg

SEQ ID NO: 5461 - RNA, 20 nt, Artificial Sequence
  source: /note="Description of Artificial Sequence: Synthetic oligonucleotide"
acuucuuugaaacaggucgg

SEQ ID NO: 5462 - RNA, 20 nt, Artificial Sequence
  source: /note="Description of Artificial Sequence: Synthetic oligonucleotide"
cuucuuugaaacaggucggg

SEQ ID NO: 5463 - RNA, 20 nt, Artificial Sequence
  source: /note="Description of Artificial Sequence: Synthetic oligonucleotide"
cuuugaaacaggucgggggg

SEQ ID NO: 5464 - RNA, 20 nt, Artificial Sequence
  source: /note="Description of Artificial Sequence: Synthetic oligonucleotide"
uuuuaaucaaaguucuuuca

SEQ ID NO: 5465 - RNA, 20 nt, Artificial Sequence
  source: /note="Description of Artificial Sequence: Synthetic oligonucleotide"
aaguucuuucauggaauugu

SEQ ID NO: 5466 - RNA, 20 nt, Artificial Sequence
  source: /note="Description of Artificial Sequence: Synthetic oligonucleotide"
cauggaauuguuggugcuuc

SEQ ID NO: 5467 - RNA, 20 nt, Artificial Sequence
  source: /note="Description of Artificial Sequence: Synthetic oligonucleotide"
aauucagugcuugucuuaac

SEQ ID NO: 5468 - RNA, 20 nt, Artificial Sequence
  source: /note="Description of Artificial Sequence: Synthetic oligonucleotide"
ucagugcuugucuuaacugg

SEQ ID NO: 5469 - RNA, 20 nt, Artificial Sequence
  source: /note="Description of Artificial Sequence: Synthetic oligonucleotide"
uaacugguggacuuauuuua

SEQ ID NO: 5470 - RNA, 20 nt, Artificial Sequence
  source: /note="Description of Artificial Sequence: Synthetic oligonucleotide"
augguauuauguuuauaaga

SEQ ID NO: 5471 - RNA, 20 nt, Artificial Sequence
  source: /note="Description of Artificial Sequence: Synthetic oligonucleotide"
uuuuuuauacuccuaaaaga

SEQ ID NO: 5472 - RNA, 20 nt, Artificial Sequence
  source: /note="Description of Artificial Sequence: Synthetic oligonucleotide"
cuaaaagauggauacgauag

SEQ ID NO: 5473 - RNA, 20 nt, Artificial Sequence
  source: /note="Description of Artificial Sequence: Synthetic oligonucleotide"
uaaaagauggauacgauaga

SEQ ID NO: 5474 - RNA, 20 nt, Artificial Sequence
  source: /note="Description of Artificial Sequence: Synthetic oligonucleotide"
aaaagauggauacgauagag

SEQ ID NO: 5475 - RNA, 20 nt, Artificial Sequence
  source: /note="Description of Artificial Sequence: Synthetic oligonucleotide"
auggauacgauagaggggaa

SEQ ID NO: 5476 - RNA, 20 nt, Artificial Sequence
  source: /note="Description of Artificial Sequence: Synthetic oligonucleotide"
uggauacgauagaggggaaa

SEQ ID NO: 5477 - RNA, 20 nt, Artificial Sequence
  source: /note="Description of Artificial Sequence: Synthetic oligonucleotide"
ggauacgauagaggggaaag

SEQ ID NO: 5478 - RNA, 20 nt, Artificial Sequence
  source: /note="Description of Artificial Sequence: Synthetic oligonucleotide"
gauacgauagaggggaaagg

SEQ ID NO: 5479 - RNA, 20 nt, Artificial Sequence
  source: /note="Description of Artificial Sequence: Synthetic oligonucleotide"
ggggguaagcuacaacuuuu

SEQ ID NO: 5480 - RNA, 20 nt, Artificial Sequence
  source: /note="Description of Artificial Sequence: Synthetic oligonucleotide"
agcuacaacuuuuagguugu

SEQ ID NO: 5481 - RNA, 20 nt, Artificial Sequence
  source: /note="Description of Artificial Sequence: Synthetic oligonucleotide"
uaaaaguaaugauuugccac

SEQ ID NO: 5482 - RNA, 20 nt, Artificial Sequence
  source: /note="Description of Artificial Sequence: Synthetic oligonucleotide"
uaugaaaaaugccauaaacu

SEQ ID NO: 5483 - RNA, 20 nt, Artificial Sequence
  source: /note="Description of Artificial Sequence: Synthetic oligonucleotide"
aaagcuaauucaucuuuuag

SEQ ID NO: 5484 - RNA, 20 nt, Artificial Sequence
  source: /note="Description of Artificial Sequence: Synthetic oligonucleotide"
agauguauagcuaagucugu

SEQ ID NO: 5485 - RNA, 20 nt, Artificial Sequence
  source: /note="Description of Artificial Sequence: Synthetic oligonucleotide"
aagucuguuggacaaacugu

SEQ ID NO: 5486 - RNA, 20 nt, Artificial Sequence
  source: /note="Description of Artificial Sequence: Synthetic oligonucleotide"
gugaauuuaugauauuuccu

SEQ ID NO: 5487 - RNA, 20 nt, Artificial Sequence
  source: /note="Description of Artificial Sequence: Synthetic oligonucleotide"
auauuuccuagguaauguua

SEQ ID NO: 5488 - RNA, 20 nt, Artificial Sequence
  source: /note="Description of Artificial Sequence: Synthetic oligonucleotide"
uagguaauguuaagguuaua

SEQ ID NO: 5489 - RNA, 20 nt, Artificial Sequence
  source: /note="Description of Artificial Sequence: Synthetic oligonucleotide"
uuauauggaaauuucuuugc

SEQ ID NO: 5490 - RNA, 20 nt, Artificial Sequence
  source: /note="Description of Artificial Sequence: Synthetic oligonucleotide"
uguuauuuucaauacauacg

SEQ ID NO: 5491 - RNA, 20 nt, Artificial Sequence
  source: /note="Description of Artificial Sequence: Synthetic oligonucleotide"
gaccuuucucuucauuucaa

SEQ ID NO: 5492 - RNA, 20 nt, Artificial Sequence
  source: /note="Description of Artificial Sequence: Synthetic oligonucleotide"
uucauuucaaaggcauaacu

SEQ ID NO: 5493 - RNA, 20 nt, Artificial Sequence
  source: /note="Description of Artificial Sequence: Synthetic oligonucleotide"
uuucaaaggcauaacuugga

SEQ ID NO: 5494 - RNA, 20 nt, Artificial Sequence
  source: /note="Description of Artificial Sequence: Synthetic oligonucleotide"
uggauggucuguuuagcuca

SEQ ID NO: 5495 - RNA, 20 nt, Artificial Sequence
  source: /note="Description of Artificial Sequence: Synthetic oligonucleotide"
aaaaguuaugauuuuguauu

SEQ ID NO: 5496 - RNA, 20 nt, Artificial Sequence
  source: /note="Description of Artificial Sequence: Synthetic oligonucleotide"
aaaguuaugauuuuguauuu

SEQ ID NO: 5497 - RNA, 20 nt, Artificial Sequence
  source: /note="Description of Artificial Sequence: Synthetic oligonucleotide"
uuuguauuugggcaaaguac

SEQ ID NO: 5498 - RNA, 20 nt, Artificial Sequence
  source: /note="Description of Artificial Sequence: Synthetic oligonucleotide"
cauuagaacagcaauauaac

SEQ ID NO: 5499 - RNA, 20 nt, Artificial Sequence
  source: /note="Description of Artificial Sequence: Synthetic oligonucleotide"
agcuaaagcaaaacuugcau

SEQ ID NO: 5500 - RNA, 20 nt, Artificial Sequence
  source: /note="Description of Artificial Sequence: Synthetic oligonucleotide"
cucagaacucuacaucugag

SEQ ID NO: 5501 - RNA, 20 nt, Artificial Sequence
  source: /note="Description of Artificial Sequence: Synthetic oligonucleotide"
uuuauacucuccuaguccac

SEQ ID NO: 5502 - RNA, 20 nt, Artificial Sequence
  source: /note="Description of Artificial Sequence: Synthetic oligonucleotide"
ucauauacuacaucugaauu

SEQ ID NO: 5503 - RNA, 20 nt, Artificial Sequence
  source: /note="Description of Artificial Sequence: Synthetic oligonucleotide"
cauauacuacaucugaauua

SEQ ID NO: 5504 - RNA, 20 nt, Artificial Sequence
  source: /note="Description of Artificial Sequence: Synthetic oligonucleotide"
uuccaaaguaugcuauucca

SEQ ID NO: 5505 - RNA, 20 nt, Artificial Sequence
  source: /note="Description of Artificial Sequence: Synthetic oligonucleotide"
cauggaaauacuguuuauuc

SEQ ID NO: 5506 - RNA, 20 nt, Artificial Sequence
  source: /note="Description of Artificial Sequence: Synthetic oligonucleotide"
auggaaauacuguuuauuca

SEQ ID NO: 5507 - RNA, 20 nt, Artificial Sequence
  source: /note="Description of Artificial Sequence: Synthetic oligonucleotide"
uccuguguuucauuaugucc

SEQ ID NO: 5508 - RNA, 20 nt, Artificial Sequence
  source: /note="Description of Artificial Sequence: Synthetic oligonucleotide"
ucaucauauuaaagacuuug

SEQ ID NO: 5509 - RNA, 20 nt, Artificial Sequence
  source: /note="Description of Artificial Sequence: Synthetic oligonucleotide"
acagaacuuuauuuuuucuc

SEQ ID NO: 5510 - RNA, 20 nt, Artificial Sequence
  source: /note="Description of Artificial Sequence: Synthetic oligonucleotide"
aacuuuauuuuuucucaggc

SEQ ID NO: 5511 - RNA, 20 nt, Artificial Sequence
  source: /note="Description of Artificial Sequence: Synthetic oligonucleotide"
augauaagaaucuguuucaa

SEQ ID NO: 5512 - RNA, 20 nt, Artificial Sequence
  source: /note="Description of Artificial Sequence: Synthetic oligonucleotide"
agaaucuguuucaauggugu

SEQ ID NO: 5513 - RNA, 20 nt, Artificial Sequence
  source: /note="Description of Artificial Sequence: Synthetic oligonucleotide"
guugguguacauguguguuc

SEQ ID NO: 5514 - RNA, 20 nt, Artificial Sequence
  source: /note="Description of Artificial Sequence: Synthetic oligonucleotide"
uguucagguaccuacacauu

SEQ ID NO: 5515 - RNA, 20 nt, Artificial Sequence
  source: /note="Description of Artificial Sequence: Synthetic oligonucleotide"
acugcacuuauaaagagaca

SEQ ID NO: 5516 - RNA, 20 nt, Artificial Sequence
  source: /note="Description of Artificial Sequence: Synthetic oligonucleotide"
caucaagaagacaucauuuu

SEQ ID NO: 5517 - RNA, 20 nt, Artificial Sequence
  source: /note="Description of Artificial Sequence: Synthetic oligonucleotide"
aucaagaagacaucauuuua

SEQ ID NO: 5518 - RNA, 20 nt, Artificial Sequence
  source: /note="Description of Artificial Sequence: Synthetic oligonucleotide"
aagaagacaucauuuuaggg

SEQ ID NO: 5519 - RNA, 20 nt, Artificial Sequence
  source: /note="Description of Artificial Sequence: Synthetic oligonucleotide"
uaggguggacaccauugccu

SEQ ID NO: 5520 - RNA, 20 nt, Artificial Sequence
  source: /note="Description of Artificial Sequence: Synthetic oligonucleotide"
cgcagaguugacucgaguga

SEQ ID NO: 5521 - RNA, 20 nt, Artificial Sequence
  source: /note="Description of Artificial Sequence: Synthetic oligonucleotide"
auuauuuauguccacugucc

SEQ ID NO: 5522 - RNA, 20 nt, Artificial Sequence
  source: /note="Description of Artificial Sequence: Synthetic oligonucleotide"
uuauuuauguccacugucca

SEQ ID NO: 5523 - RNA, 20 nt, Artificial Sequence
  source: /note="Description of Artificial Sequence: Synthetic oligonucleotide"
uguccaggguacuugcuuua

SEQ ID NO: 5524 - RNA, 20 nt, Artificial Sequence
  source: /note="Description of Artificial Sequence: Synthetic oligonucleotide"
guccaggguacuugcuuuaa

SEQ ID NO: 5525 - RNA, 20 nt, Artificial Sequence
  source: /note="Description of Artificial Sequence: Synthetic oligonucleotide"
ucuugaagaugaagagucuu

SEQ ID NO: 5526 - RNA, 20 nt, Artificial Sequence
  source: /note="Description of Artificial Sequence: Synthetic oligonucleotide"
uccuagugaugugaucauau

SEQ ID NO: 5527 - RNA, 20 nt, Artificial Sequence
  source: /note="Description of Artificial Sequence: Synthetic oligonucleotide"
aauccaguguuucuuuucca

SEQ ID NO: 5528 - RNA, 20 nt, Artificial Sequence
  source: /note="Description of Artificial Sequence: Synthetic oligonucleotide"
uuccaaggacaguacugaua

SEQ ID NO: 5529 - RNA, 20 nt, Artificial Sequence
  source: /note="Description of Artificial Sequence: Synthetic oligonucleotide"
aucuccaucuauucauaguu

SEQ ID NO: 5530 - RNA, 20 nt, Artificial Sequence
  source: /note="Description of Artificial Sequence: Synthetic oligonucleotide"
ucauaguuuggcucagaagu

SEQ ID NO: 5531 - RNA, 20 nt, Artificial Sequence
  source: /note="Description of Artificial Sequence: Synthetic oligonucleotide"
uuuggcucagaaguuggaca

SEQ ID NO: 5532 - RNA, 20 nt, Artificial Sequence
  source: /note="Description of Artificial Sequence: Synthetic oligonucleotide"
uaucuacuucuuccucaugu

SEQ ID NO: 5533 - RNA, 20 nt, Artificial Sequence
  source: /note="Description of Artificial Sequence: Synthetic oligonucleotide"
guuuacuuauguguaaaaug

SEQ ID NO: 5534 - RNA, 20 nt, Artificial Sequence
  source: /note="Description of Artificial Sequence: Synthetic oligonucleotide"
uacacccuucaaaccgaaag

SEQ ID NO: 5535 - RNA, 20 nt, Artificial Sequence
  source: /note="Description of Artificial Sequence: Synthetic oligonucleotide"
aauuuuuaaaaauugagaug

SEQ ID NO: 5536 - RNA, 20 nt, Artificial Sequence
  source: /note="Description of Artificial Sequence: Synthetic oligonucleotide"
auuuuuaaaaauugagaugu

SEQ ID NO: 5537 - RNA, 20 nt, Artificial Sequence
  source: /note="Description of Artificial Sequence: Synthetic oligonucleotide"
uuuuuaaaaauugagaugug

SEQ ID NO: 5538 - RNA, 20 nt, Artificial Sequence
  source: /note="Description of Artificial Sequence: Synthetic oligonucleotide"
uuaaaaauugagaugugggg

SEQ ID NO: 5539 - RNA, 20 nt, Artificial Sequence
  source: /note="Description of Artificial Sequence: Synthetic oligonucleotide"
ugacugugucuauguccugu

SEQ ID NO: 5540 - RNA, 20 nt, Artificial Sequence
  source: /note="Description of Artificial Sequence: Synthetic oligonucleotide"
accauauuuuaugcaacuuc

SEQ ID NO: 5541 - RNA, 20 nt, Artificial Sequence
  source: /note="Description of Artificial Sequence: Synthetic oligonucleotide"
aaaacaugcuauauaauuuu

SEQ ID NO: 5542 - RNA, 20 nt, Artificial Sequence
  source: /note="Description of Artificial Sequence: Synthetic oligonucleotide"
agaguaaucuucaucaugua

SEQ ID NO: 5543 - RNA, 20 nt, Artificial Sequence
  source: /note="Description of Artificial Sequence: Synthetic oligonucleotide"
gaguaaucuucaucauguau

SEQ ID NO: 5544 - RNA, 20 nt, Artificial Sequence
  source: /note="Description of Artificial Sequence: Synthetic oligonucleotide"
guauuuuucugaugaacaca

SEQ ID NO: 5545 - RNA, 20 nt, Artificial Sequence
  source: /note="Description of Artificial Sequence: Synthetic oligonucleotide"
uacucuuucuucugauagac

SEQ ID NO: 5546 - RNA, 20 nt, Artificial Sequence
  source: /note="Description of Artificial Sequence: Synthetic oligonucleotide"
uuuauguuaugaaauaaugu

SEQ ID NO: 5547 - RNA, 20 nt, Artificial Sequence
  source: /note="Description of Artificial Sequence: Synthetic oligonucleotide"
uuucuuaaauugauagcuca

SEQ ID NO: 5548 - RNA, 20 nt, Artificial Sequence
  source: /note="Description of Artificial Sequence: Synthetic oligonucleotide"
auagcucauggaugugcagu

SEQ ID NO: 5549 - RNA, 20 nt, Artificial Sequence
  source: /note="Description of Artificial Sequence: Synthetic oligonucleotide"
uggaugugcaguugguuuaa

SEQ ID NO: 5550 - RNA, 20 nt, Artificial Sequence
  source: /note="Description of Artificial Sequence: Synthetic oligonucleotide"
auugcuaguuguuccaaaau

SEQ ID NO: 5551 - RNA, 20 nt, Artificial Sequence
  source: /note="Description of Artificial Sequence: Synthetic oligonucleotide"
uaaaaaugaccagauuguua

SEQ ID NO: 5552 - RNA, 20 nt, Artificial Sequence
  source: /note="Description of Artificial Sequence: Synthetic oligonucleotide"
uugauuaagacuagaucaau

SEQ ID NO: 5553 - RNA, 20 nt, Artificial Sequence
  source: /note="Description of Artificial Sequence: Synthetic oligonucleotide"
aaacuucuccaaaacauaga

SEQ ID NO: 5554 - RNA, 20 nt, Artificial Sequence
  source: /note="Description of Artificial Sequence: Synthetic oligonucleotide"
cauagauggcaugccuuuug

SEQ ID NO: 5555 - RNA, 20 nt, Artificial Sequence
  source: /note="Description of Artificial Sequence: Synthetic oligonucleotide"
uggcaugccuuuugaggcaa

SEQ ID NO: 5556 - RNA, 20 nt, Artificial Sequence
  source: /note="Description of Artificial Sequence: Synthetic oligonucleotide"
augccuuuugaggcaauggu

SEQ ID NO: 5557 - RNA, 20 nt, Artificial Sequence
  source: /note="Description of Artificial Sequence: Synthetic oligonucleotide"
ugccuuuugaggcaauggua

SEQ ID NO: 5558 - RNA, 20 nt, Artificial Sequence
  source: /note="Description of Artificial Sequence: Synthetic oligonucleotide"
ggaacaaaauauuuuugaga

SEQ ID NO: 5559 - RNA, 20 nt, Artificial Sequence
  source: /note="Description of Artificial Sequence: Synthetic oligonucleotide"
uuugagaaggagcagauuuu

SEQ ID NO: 5560 - RNA, 20 nt, Artificial Sequence
  source: /note="Description of Artificial Sequence: Synthetic oligonucleotide"
uugagaaggagcagauuuua

SEQ ID NO: 5561 - RNA, 20 nt, Artificial Sequence
  source: /note="Description of Artificial Sequence: Synthetic oligonucleotide"
gccaaaaugcuuguguuaca

SEQ ID NO: 5562 - RNA, 20 nt, Artificial Sequence
  source: /note="Description of Artificial Sequence: Synthetic oligonucleotide"
gcuuguguuacaaggauucc

SEQ ID NO: 5563 - RNA, 20 nt, Artificial Sequence
  source: /note="Description of Artificial Sequence: Synthetic oligonucleotide"
gaguuuuuaaauaaaaugcu

SEQ ID NO: 5564 - RNA, 20 nt, Artificial Sequence
  source: /note="Description of Artificial Sequence: Synthetic oligonucleotide"
auuaauauuguagagucccc

SEQ ID NO: 5565 - RNA, 20 nt, Artificial Sequence
  source: /note="Description of Artificial Sequence: Synthetic oligonucleotide"
uuaauauuguagaguccccu

SEQ ID NO: 5566 - RNA, 20 nt, Artificial Sequence
  source: /note="Description of Artificial Sequence: Synthetic oligonucleotide"
uaauauuguagaguccccug

SEQ ID NO: 5567 - RNA, 20 nt, Artificial Sequence
  source: /note="Description of Artificial Sequence: Synthetic oligonucleotide"
ucuaccuuuugauagcuuug

SEQ ID NO: 5568 - RNA, 20 nt, Artificial Sequence
  source: /note="Description of Artificial Sequence: Synthetic oligonucleotide"
cuaccuuuugauagcuuugu

SEQ ID NO: 5569 - RNA, 20 nt, Artificial Sequence
  source: /note="Description of Artificial Sequence: Synthetic oligonucleotide"
uaccuuuugauagcuuugug

SEQ ID NO: 5570 - RNA, 20 nt, Artificial Sequence
  source: /note="Description of Artificial Sequence: Synthetic oligonucleotide"
guuuugccauucuugauuuu

SEQ ID NO: 5571 - RNA, 20 nt, Artificial Sequence
  source: /note="Description of Artificial Sequence: Synthetic oligonucleotide"
uuuugccauucuugauuuua

SEQ ID NO: 5572 - RNA, 20 nt, Artificial Sequence
  source: /note="Description of Artificial Sequence: Synthetic oligonucleotide"
ugcauugauuaagaucaucu

SEQ ID NO: 5573 - RNA, 20 nt, Artificial Sequence
  source: /note="Description of Artificial Sequence: Synthetic oligonucleotide"
cucauuauauaguauuuaau

SEQ ID NO: 5574 - RNA, 20 nt, Artificial Sequence
  source: /note="Description of Artificial Sequence: Synthetic oligonucleotide"
ucauuauauaguauuuaaua

SEQ ID NO: 5575 - RNA, 20 nt, Artificial Sequence
  source: /note="Description of Artificial Sequence: Synthetic oligonucleotide"
uuucuccucauuagaauauc

SEQ ID NO: 5576 - RNA, 20 nt, Artificial Sequence
  source: /note="Description of Artificial Sequence: Synthetic oligonucleotide"
aauaucagguccaagaagac

SEQ ID NO: 5577 - RNA, 20 nt, Artificial Sequence
  source: /note="Description of Artificial Sequence: Synthetic oligonucleotide"
uauuuaucucuuuuguucag

SEQ ID NO: 5578 - RNA, 20 nt, Artificial Sequence
  source: /note="Description of Artificial Sequence: Synthetic oligonucleotide"
uuuguucagugguguguuac

SEQ ID NO: 5579 - RNA, 20 nt, Artificial Sequence
  source: /note="Description of Artificial Sequence: Synthetic oligonucleotide"
uauuauuagaacccauuugu

SEQ ID NO: 5580 - RNA, 20 nt, Artificial Sequence
  source: /note="Description of Artificial Sequence: Synthetic oligonucleotide"
cauuuguuggccuuauguaa

SEQ ID NO: 5581 - RNA, 20 nt, Artificial Sequence
  source: /note="Description of Artificial Sequence: Synthetic oligonucleotide"
gccuuauguaaugguucuau

SEQ ID NO: 5582 - RNA, 20 nt, Artificial Sequence
  source: /note="Description of Artificial Sequence: Synthetic oligonucleotide"
ccauuaaugucuucuugacc

SEQ ID NO: 5583 - RNA, 20 nt, Artificial Sequence
  source: /note="Description of Artificial Sequence: Synthetic oligonucleotide"
auaauuuuuacagcaccuuu

SEQ ID NO: 5584 - RNA, 20 nt, Artificial Sequence
  source: /note="Description of Artificial Sequence: Synthetic oligonucleotide"
cccagcacaaacuuaaacac

SEQ ID NO: 5585 - RNA, 20 nt, Artificial Sequence
  source: /note="Description of Artificial Sequence: Synthetic oligonucleotide"
uaaacacuggcuccaacccu

SEQ ID NO: 5586 - RNA, 20 nt, Artificial Sequence
  source: /note="Description of Artificial Sequence: Synthetic oligonucleotide"
caacccuuggaguugaaagu

SEQ ID NO: 5587 - RNA, 20 nt, Artificial Sequence
  source: /note="Description of Artificial Sequence: Synthetic oligonucleotide"
aacccuuggaguugaaagua

SEQ ID NO: 5588 - RNA, 20 nt, Artificial Sequence
  source: /note="Description of Artificial Sequence: Synthetic oligonucleotide"
acccuuggaguugaaaguag

SEQ ID NO: 5589 - RNA, 20 nt, Artificial Sequence
  source: /note="Description of Artificial Sequence: Synthetic oligonucleotide"
uaccgugagcaccagugccu

SEQ ID NO: 5590 - RNA, 20 nt, Artificial Sequence
  source: /note="Description of Artificial Sequence: Synthetic oligonucleotide"
agcaccagugccuaggagau

SEQ ID NO: 5591 - RNA, 20 nt, Artificial Sequence
  source: /note="Description of Artificial Sequence: Synthetic oligonucleotide"
gcaccagugccuaggagauu

SEQ ID NO: 5592 - RNA, 20 nt, Artificial Sequence
  source: /note="Description of Artificial Sequence: Synthetic oligonucleotide"
cagugccuaggagauugggc

SEQ ID NO: 5593 - RNA, 20 nt, Artificial Sequence
  source: /note="Description of Artificial Sequence: Synthetic oligonucleotide"
uaggagauugggcaggacug

SEQ ID NO: 5594 - RNA, 20 nt, Artificial Sequence
  source: /note="Description of Artificial Sequence: Synthetic oligonucleotide"
agauugggcaggacugagga

SEQ ID NO: 5595 - RNA, 20 nt, Artificial Sequence
  source: /note="Description of Artificial Sequence: Synthetic oligonucleotide"
aggacugaggaaggaugaaa

SEQ ID NO: 5596 - RNA, 20 nt, Artificial Sequence
  source: /note="Description of Artificial Sequence: Synthetic oligonucleotide"
ggaaggaugaaaaggagcuc

SEQ ID NO: 5597 - RNA, 20 nt, Artificial Sequence
  source: /note="Description of Artificial Sequence: Synthetic oligonucleotide"
gaaggaugaaaaggagcuca

SEQ ID NO: 5598 - RNA, 20 nt, Artificial Sequence
  source: /note="Description of Artificial Sequence: Synthetic oligonucleotide"
cuuaagcaccugaacaagac

SEQ ID NO: 5599 - RNA, 20 nt, Artificial Sequence
  source: /note="Description of Artificial Sequence: Synthetic oligonucleotide"
aagcaccugaacaagacugg

SEQ ID NO: 5600 - RNA, 20 nt, Artificial Sequence
  source: /note="Description of Artificial Sequence: Synthetic oligonucleotide"
ugaacaagacuggaggacuu

SEQ ID NO: 5601 - RNA, 20 nt, Artificial Sequence
  source: /note="Description of Artificial Sequence: Synthetic oligonucleotide"
gauguugcuauuuuucugcc

SEQ ID NO: 5602 - RNA, 20 nt, Artificial Sequence
  source: /note="Description of Artificial Sequence: Synthetic oligonucleotide"
uuuuucugccuggcauugac

SEQ ID NO: 5603 - RNA, 20 nt, Artificial Sequence
  source: /note="Description of Artificial Sequence: Synthetic oligonucleotide"
gccuggcauugacuggcuau

SEQ ID NO: 5604 - RNA, 20 nt, Artificial Sequence
  source: /note="Description of Artificial Sequence: Synthetic oligonucleotide"
gcuauuggacgcccucugug

SEQ ID NO: 5605 - RNA, 20 nt, Artificial Sequence
  source: /note="Description of Artificial Sequence: Synthetic oligonucleotide"
uuggacgcccucugugaggc

SEQ ID NO: 5606 - RNA, 20 nt, Artificial Sequence
  source: /note="Description of Artificial Sequence: Synthetic oligonucleotide"
ugaggcaggcauccgaauac

SEQ ID NO: 5607 - RNA, 20 nt, Artificial Sequence
  source: /note="Description of Artificial Sequence: Synthetic oligonucleotide"
acuggcuuucuugacauaua

SEQ ID NO: 5608 - RNA, 20 nt, Artificial Sequence
  source: /note="Description of Artificial Sequence: Synthetic oligonucleotide"
auauggagcguucuuuagag

SEQ ID NO: 5609 - RNA, 20 nt, Artificial Sequence
  source: /note="Description of Artificial Sequence: Synthetic oligonucleotide"
guucuuuagagaggccuaca

SEQ ID NO: 5610 - RNA, 20 nt, Artificial Sequence
  source: /note="Description of Artificial Sequence: Synthetic oligonucleotide"
uucuuuagagaggccuacaa

SEQ ID NO: 5611 - RNA, 20 nt, Artificial Sequence
  source: /note="Description of Artificial Sequence: Synthetic oligonucleotide"
ucacugcacaguacccugau

SEQ ID NO: 5612 - RNA, 20 nt, Artificial Sequence
  source: /note="Description of Artificial Sequence: Synthetic oligonucleotide"
accccacagucucuuucugc

SEQ ID NO: 5613 - RNA, 20 nt, Artificial Sequence
  source: /note="Description of Artificial Sequence: Synthetic oligonucleotide"
ccccacagucucuuucugcu

SEQ ID NO: 5614 - RNA, 20 nt, Artificial Sequence
  source: /note="Description of Artificial Sequence: Synthetic oligonucleotide"
cccacagucucuuucugcug

SEQ ID NO: 5615 - RNA, 20 nt, Artificial Sequence
  source: /note="Description of Artificial Sequence: Synthetic oligonucleotide"
cugcuggggcauccuugccc

SEQ ID NO: 5616 - RNA, 20 nt, Artificial Sequence
  source: /note="Description of Artificial Sequence: Synthetic oligonucleotide"
uaauugaaaguuucaagcau

SEQ ID NO: 5617 - RNA, 20 nt, Artificial Sequence
  source: /note="Description of Artificial Sequence: Synthetic oligonucleotide"
uccuagacaguguuccagua

SEQ ID NO: 5618 - RNA, 20 nt, Artificial Sequence
  source: /note="Description of Artificial Sequence: Synthetic oligonucleotide"
acaauuauccauucuaauaa

SEQ ID NO: 5619 - RNA, 20 nt, Artificial Sequence
  source: /note="Description of Artificial Sequence: Synthetic oligonucleotide"
caauuauccauucuaauaau

SEQ ID NO: 5620 - RNA, 20 nt, Artificial Sequence
  source: /note="Description of Artificial Sequence: Synthetic oligonucleotide"
uccuucaguacacacuaguu

SEQ ID NO: 5621 - RNA, 20 nt, Artificial Sequence
  source: /note="Description of Artificial Sequence: Synthetic oligonucleotide"
cacacuaguuuggugagacu

SEQ ID NO: 5622 - RNA, 20 nt, Artificial Sequence
  source: /note="Description of Artificial Sequence: Synthetic oligonucleotide"
guuuggugagacuuggagaa

SEQ ID NO: 5623 - RNA, 20 nt, Artificial Sequence
  source: /note="Description of Artificial Sequence: Synthetic oligonucleotide"
gugagacuuggagaaaggcc

SEQ ID NO: 5624 - RNA, 20 nt, Artificial Sequence
  source: /note="Description of Artificial Sequence: Synthetic oligonucleotide"
caaauucaaaaaacaauucc

SEQ ID NO: 5625 - RNA, 20 nt, Artificial Sequence
  source: /note="Description of Artificial Sequence: Synthetic oligonucleotide"
uuccaggauuaacagauaag

SEQ ID NO: 5626 - RNA, 20 nt, Artificial Sequence
  source: /note="Description of Artificial Sequence: Synthetic oligonucleotide"
ucauuuuaccaauaagaaac

SEQ ID NO: 5627 - RNA, 20 nt, Artificial Sequence
  source: /note="Description of Artificial Sequence: Synthetic oligonucleotide"
uuuaccaauaagaaacuggu

SEQ ID NO: 5628 - RNA, 20 nt, Artificial Sequence
  source: /note="Description of Artificial Sequence: Synthetic oligonucleotide"
aagaaacugguugguuaacu

SEQ ID NO: 5629 - RNA, 20 nt, Artificial Sequence
  source: /note="Description of Artificial Sequence: Synthetic oligonucleotide"
agaaacugguugguuaacuu

SEQ ID NO: 5630 - RNA, 20 nt, Artificial Sequence
  source: /note="Description of Artificial Sequence: Synthetic oligonucleotide"
aaagcagauuuauacuaaac

SEQ ID NO: 5631 - RNA, 20 nt, Artificial Sequence
  source: /note="Description of Artificial Sequence: Synthetic oligonucleotide"
cagauuuauacuaaacuggc

SEQ ID NO: 5632 - RNA, 20 nt, Artificial Sequence
  source: /note="Description of Artificial Sequence: Synthetic oligonucleotide"
aaucugccucucaucuucaa

SEQ ID NO: 5633 - RNA, 20 nt, Artificial Sequence
  source: /note="Description of Artificial Sequence: Synthetic oligonucleotide"
agauuuuaaaacuuuaaaca

SEQ ID NO: 5634 - RNA, 20 nt, Artificial Sequence
  source: /note="Description of Artificial Sequence: Synthetic oligonucleotide"
gauuuuaaaacuuuaaacau

SEQ ID NO: 5635 - RNA, 20 nt, Artificial Sequence
  source: /note="Description of Artificial Sequence: Synthetic oligonucleotide"
uuuaaacaugggaauuaaau

SEQ ID NO: 5636 - RNA, 20 nt, Artificial Sequence
  source: /note="Description of Artificial Sequence: Synthetic oligonucleotide"
gaauuaaauaggcccuacug

SEQ ID NO: 5637 - RNA, 20 nt, Artificial Sequence
  source: /note="Description of Artificial Sequence: Synthetic oligonucleotide"
cuaugcacaugauuuagauu

SEQ ID NO: 5638 - RNA, 20 nt, Artificial Sequence
  source: /note="Description of Artificial Sequence: Synthetic oligonucleotide"
aauuaacaccuuuucagaaa

SEQ ID NO: 5639 - RNA, 20 nt, Artificial Sequence
  source: /note="Description of Artificial Sequence: Synthetic oligonucleotide"
uaacaccuuuucagaaaugg

SEQ ID NO: 5640 - RNA, 20 nt, Artificial Sequence
  source: /note="Description of Artificial Sequence: Synthetic oligonucleotide"
aaauggaggaacuuucucug

SEQ ID NO: 5641 - RNA, 20 nt, Artificial Sequence
  source: /note="Description of Artificial Sequence: Synthetic oligonucleotide"
auuauuauacuuuaaguuuu

SEQ ID NO: 5642 - RNA, 20 nt, Artificial Sequence
  source: /note="Description of Artificial Sequence: Synthetic oligonucleotide"
uuauuauacuuuaaguuuua

SEQ ID NO: 5643 - RNA, 20 nt, Artificial Sequence
  source: /note="Description of Artificial Sequence: Synthetic oligonucleotide"
acuuuaaguuuuaggguaca

SEQ ID NO: 5644 - RNA, 20 nt, Artificial Sequence
  source: /note="Description of Artificial Sequence: Synthetic oligonucleotide"
cuuuaaguuuuaggguacau

SEQ ID NO: 5645 - RNA, 20 nt, Artificial Sequence
  source: /note="Description of Artificial Sequence: Synthetic oligonucleotide"
gguacaugggcacaaugugc

SEQ ID NO: 5646 - RNA, 20 nt, Artificial Sequence
  source: /note="Description of Artificial Sequence: Synthetic oligonucleotide"
uauguauacaugugccaugc

SEQ ID NO: 5647 - RNA, 20 nt, Artificial Sequence
  source: /note="Description of Artificial Sequence: Synthetic oligonucleotide"
cuaacucgucaucuagcauu

SEQ ID NO: 5648 - RNA, 20 nt, Artificial Sequence
  source: /note="Description of Artificial Sequence: Synthetic oligonucleotide"
caccuaugagugagaauaug

SEQ ID NO: 5649 - RNA, 20 nt, Artificial Sequence
  source: /note="Description of Artificial Sequence: Synthetic oligonucleotide"
gagugagaauaugcgguguu

SEQ ID NO: 5650 - RNA, 20 nt, Artificial Sequence
  source: /note="Description of Artificial Sequence: Synthetic oligonucleotide"
uuucauccaugucccuacaa

SEQ ID NO: 5651 - RNA, 20 nt, Artificial Sequence
  source: /note="Description of Artificial Sequence: Synthetic oligonucleotide"
caugaacucaucauuuuuua

SEQ ID NO: 5652 - RNA, 20 nt, Artificial Sequence
  source: /note="Description of Artificial Sequence: Synthetic oligonucleotide"
uauggcugcauaguauucca

SEQ ID NO: 5653 - RNA, 20 nt, Artificial Sequence
  source: /note="Description of Artificial Sequence: Synthetic oligonucleotide"
uuaauccagucuaucauugu

SEQ ID NO: 5654 - RNA, 20 nt, Artificial Sequence
  source: /note="Description of Artificial Sequence: Synthetic oligonucleotide"
gucuaucauuguuggacauu

SEQ ID NO: 5655 - RNA, 20 nt, Artificial Sequence
  source: /note="Description of Artificial Sequence: Synthetic oligonucleotide"
ucuaucauuguuggacauua

SEQ ID NO: 5656 - RNA, 20 nt, Artificial Sequence
  source: /note="Description of Artificial Sequence: Synthetic oligonucleotide"
ucauuguuggacauuagggu

SEQ ID NO: 5657 - RNA, 20 nt, Artificial Sequence
  source: /note="Description of Artificial Sequence: Synthetic oligonucleotide"
cagcaugauuuauaguccuu

SEQ ID NO: 5658 - RNA, 20 nt, Artificial Sequence
  source: /note="Description of Artificial Sequence: Synthetic oligonucleotide"
agcaugauuuauaguccuuu

SEQ ID NO: 5659 - RNA, 20 nt, Artificial Sequence
  source: /note="Description of Artificial Sequence: Synthetic oligonucleotide"
uuuggguauaaacccaguaa

SEQ ID NO: 5660 - RNA, 20 nt, Artificial Sequence
  source: /note="Description of Artificial Sequence: Synthetic oligonucleotide"
uuggguauaaacccaguaau

SEQ ID NO: 5661 - RNA, 20 nt, Artificial Sequence
  source: /note="Description of Artificial Sequence: Synthetic oligonucleotide"
guauaaacccaguaauggga

SEQ ID NO: 5662 - RNA, 20 nt, Artificial Sequence
  source: /note="Description of Artificial Sequence: Synthetic oligonucleotide"
aaugggauggcucagucaaa

SEQ ID NO: 5663 - RNA, 20 nt, Artificial Sequence
  source: /note="Description of Artificial Sequence: Synthetic oligonucleotide"
uuucuaguucuagaucccug

SEQ ID NO: 5664 - RNA, 20 nt, Artificial Sequence
  source: /note="Description of Artificial Sequence: Synthetic oligonucleotide"
cgccacacugacuuccacaa

SEQ ID NO: 5665 - RNA, 20 nt, Artificial Sequence
  source: /note="Description of Artificial Sequence: Synthetic oligonucleotide"
uuaaugaucgccauucuaac

SEQ ID NO: 5666 - RNA, 20 nt, Artificial Sequence
  source: /note="Description of Artificial Sequence: Synthetic oligonucleotide"
ugugagaugauaucucauug

SEQ ID NO: 5667 - RNA, 20 nt, Artificial Sequence
  source: /note="Description of Artificial Sequence: Synthetic oligonucleotide"
uuugauuuucauuucucuga

SEQ ID NO: 5668 - RNA, 20 nt, Artificial Sequence
  source: /note="Description of Artificial Sequence: Synthetic oligonucleotide"
auuucucugauggccaguga

SEQ ID NO: 5669 - RNA, 20 nt, Artificial Sequence
  source: /note="Description of Artificial Sequence: Synthetic oligonucleotide"
gcauuuuuucaugugucuuu

SEQ ID NO: 5670 - RNA, 20 nt, Artificial Sequence
  source: /note="Description of Artificial Sequence: Synthetic oligonucleotide"
gugcuucgcccacuuuuuga

SEQ ID NO: 5671 - RNA, 20 nt, Artificial Sequence
  source: /note="Description of Artificial Sequence: Synthetic oligonucleotide"
ugcuucgcccacuuuuugau

SEQ ID NO: 5672 - RNA, 20 nt, Artificial Sequence
  source: /note="Description of Artificial Sequence: Synthetic oligonucleotide"
uuugaguucuuuguagauuc

SEQ ID NO: 5673 - RNA, 20 nt, Artificial Sequence
  source: /note="Description of Artificial Sequence: Synthetic oligonucleotide"
uagcccuuugucagaugagu

SEQ ID NO: 5674 - RNA, 20 nt, Artificial Sequence
  source: /note="Description of Artificial Sequence: Synthetic oligonucleotide"
gaaaauuuucugccauuuug

SEQ ID NO: 5675 - RNA, 20 nt, Artificial Sequence
  source: /note="Description of Artificial Sequence: Synthetic oligonucleotide"
aaaauuuucugccauuuugu

SEQ ID NO: 5676 - RNA, 20 nt, Artificial Sequence
  source: /note="Description of Artificial Sequence: Synthetic oligonucleotide"
ggguugccuguucacucuga

SEQ ID NO: 5677 - RNA, 20 nt, Artificial Sequence
  source: /note="Description of Artificial Sequence: Synthetic oligonucleotide"
uagaucccauuugucaauuu

SEQ ID NO: 5678 - RNA, 20 nt, Artificial Sequence
  source: /note="Description of Artificial Sequence: Synthetic oligonucleotide"
gcuuuuguugccauugcuuu

SEQ ID NO: 5679 - RNA, 20 nt, Artificial Sequence
  source: /note="Description of Artificial Sequence: Synthetic oligonucleotide"
gcccgugccuaugucgugaa

SEQ ID NO: 5680 - RNA, 20 nt, Artificial Sequence
  source: /note="Description of Artificial Sequence: Synthetic oligonucleotide"
ugucgugaaugguguugccu

SEQ ID NO: 5681 - RNA, 20 nt, Artificial Sequence
  source: /note="Description of Artificial Sequence: Synthetic oligonucleotide"
uguugccuagguuuucuucu

SEQ ID NO: 5682 - RNA, 20 nt, Artificial Sequence
  source: /note="Description of Artificial Sequence: Synthetic oligonucleotide"
guugccuagguuuucuucua

SEQ ID NO: 5683 - RNA, 20 nt, Artificial Sequence
  source: /note="Description of Artificial Sequence: Synthetic oligonucleotide"
guuuucuucuaggguuuuua

SEQ ID NO: 5684 - RNA, 20 nt, Artificial Sequence
  source: /note="Description of Artificial Sequence: Synthetic oligonucleotide"
ucuaggguuuuuaugguuuu

SEQ ID NO: 5685 - RNA, 20 nt, Artificial Sequence
  source: /note="Description of Artificial Sequence: Synthetic oligonucleotide"
cuugaauugauuuuuguaua

SEQ ID NO: 5686 - RNA, 20 nt, Artificial Sequence
  source: /note="Description of Artificial Sequence: Synthetic oligonucleotide"
ugauuuuuguauaaggugua

SEQ ID NO: 5687 - RNA, 20 nt, Artificial Sequence
  source: /note="Description of Artificial Sequence: Synthetic oligonucleotide"
uuuuguauaagguguaagga

SEQ ID NO: 5688 - RNA, 20 nt, Artificial Sequence
  source: /note="Description of Artificial Sequence: Synthetic oligonucleotide"
uuuguauaagguguaaggaa

SEQ ID NO: 5689 - RNA, 20 nt, Artificial Sequence
  source: /note="Description of Artificial Sequence: Synthetic oligonucleotide"
caguuucagcuuuccacaua

SEQ ID NO: 5690 - RNA, 20 nt, Artificial Sequence
  source: /note="Description of Artificial Sequence: Synthetic oligonucleotide"
cccagcaccauuuauuaaau

SEQ ID NO: 5691 - RNA, 20 nt, Artificial Sequence
  source: /note="Description of Artificial Sequence: Synthetic oligonucleotide"
ccagcaccauuuauuaaaua

SEQ ID NO: 5692 - RNA, 20 nt, Artificial Sequence
  source: /note="Description of Artificial Sequence: Synthetic oligonucleotide"
ccccauuucuuguuuuucuc

SEQ ID NO: 5693 - RNA, 20 nt, Artificial Sequence
  source: /note="Description of Artificial Sequence: Synthetic oligonucleotide"
aucagauaguuguagauaug

SEQ ID NO: 5694 - RNA, 20 nt, Artificial Sequence
  source: /note="Description of Artificial Sequence: Synthetic oligonucleotide"
gauauguggccuuauuucug

SEQ ID NO: 5695 - RNA, 20 nt, Artificial Sequence
  source: /note="Description of Artificial Sequence: Synthetic oligonucleotide"
auauguggccuuauuucuga

SEQ ID NO: 5696 - RNA, 20 nt, Artificial Sequence
  source: /note="Description of Artificial Sequence: Synthetic oligonucleotide"
auugaucuauaucucuguuu

SEQ ID NO: 5697 - RNA, 20 nt, Artificial Sequence
  source: /note="Description of Artificial Sequence: Synthetic oligonucleotide"
ucuguuuugguaccagcacc

SEQ ID NO: 5698 - RNA, 20 nt, Artificial Sequence
  source: /note="Description of Artificial Sequence: Synthetic oligonucleotide"
ucuccauacuuaauccauau

SEQ ID NO: 5699 - RNA, 20 nt, Artificial Sequence
  source: /note="Description of Artificial Sequence: Synthetic oligonucleotide"
uauaggaaacauuauauucc

SEQ ID NO: 5700 - RNA, 20 nt, Artificial Sequence
  source: /note="Description of Artificial Sequence: Synthetic oligonucleotide"
uauauuccaggucuaacaug

SEQ ID NO: 5701 - RNA, 20 nt, Artificial Sequence
  source: /note="Description of Artificial Sequence: Synthetic oligonucleotide"
cuguugaaaaauauauguuu

SEQ ID NO: 5702 - RNA, 20 nt, Artificial Sequence
  source: /note="Description of Artificial Sequence: Synthetic oligonucleotide"
uuuaccucaagagugagacu

SEQ ID NO: 5703 - RNA, 20 nt, Artificial Sequence
  source: /note="Description of Artificial Sequence: Synthetic oligonucleotide"
aauuuuaaagucaaacgaaa

SEQ ID NO: 5704 - RNA, 20 nt, Artificial Sequence
  source: /note="Description of Artificial Sequence: Synthetic oligonucleotide"
auuuaaacuaacauuuugcu

SEQ ID NO: 5705 - RNA, 20 nt, Artificial Sequence
  source: /note="Description of Artificial Sequence: Synthetic oligonucleotide"
uuuaaacuaacauuuugcuc

SEQ ID NO: 5706 - RNA, 20 nt, Artificial Sequence
  source: /note="Description of Artificial Sequence: Synthetic oligonucleotide"
gauuuuagaacacuauacag

SEQ ID NO: 5707 - RNA, 20 nt, Artificial Sequence
  source: /note="Description of Artificial Sequence: Synthetic oligonucleotide"
auuuuagaacacuauacaga

SEQ ID NO: 5708 - RNA, 20 nt, Artificial Sequence
  source: /note="Description of Artificial Sequence: Synthetic oligonucleotide"
aagcuaugucccauguugau

SEQ ID NO: 5709 - RNA, 20 nt, Artificial Sequence
  source: /note="Description of Artificial Sequence: Synthetic oligonucleotide"
ggaagaauccaaaauaguuu

SEQ ID NO: 5710 - RNA, 20 nt, Artificial Sequence
  source: /note="Description of Artificial Sequence: Synthetic oligonucleotide"
gagaauaaugccaucuaugc

SEQ ID NO: 5711 - RNA, 20 nt, Artificial Sequence
  source: /note="Description of Artificial Sequence: Synthetic oligonucleotide"
aauaaugccaucuaugcagg

SEQ ID NO: 5712 - RNA, 20 nt, Artificial Sequence
  source: /note="Description of Artificial Sequence: Synthetic oligonucleotide"
ugccaucuaugcaggaggug

SEQ ID NO: 5713 - RNA, 20 nt, Artificial Sequence
  source: /note="Description of Artificial Sequence: Synthetic oligonucleotide"
acacucugaauuacuaauag

SEQ ID NO: 5714 - RNA, 20 nt, Artificial Sequence
  source: /note="Description of Artificial Sequence: Synthetic oligonucleotide"
auagaggugaagccugucag

SEQ ID NO: 5715 - RNA, 20 nt, Artificial Sequence
  source: /note="Description of Artificial Sequence: Synthetic oligonucleotide"
aucugaauguauaaauaaac

SEQ ID NO: 5716 - RNA, 20 nt, Artificial Sequence
  source: /note="Description of Artificial Sequence: Synthetic oligonucleotide"
uaaauaaacaggauucauga

SEQ ID NO: 5717 - RNA, 20 nt, Artificial Sequence
  source: /note="Description of Artificial Sequence: Synthetic oligonucleotide"
uuauauauacuuguaguauu

SEQ ID NO: 5718 - RNA, 20 nt, Artificial Sequence
  source: /note="Description of Artificial Sequence: Synthetic oligonucleotide"
gacaugcaaaacuuauuuua

SEQ ID NO: 5719 - RNA, 20 nt, Artificial Sequence
  source: /note="Description of Artificial Sequence: Synthetic oligonucleotide"
uaauuuacuaccuuauagua

SEQ ID NO: 5720 - RNA, 20 nt, Artificial Sequence
  source: /note="Description of Artificial Sequence: Synthetic oligonucleotide"
agcauaucuacagcuuuaug

SEQ ID NO: 5721 - RNA, 20 nt, Artificial Sequence
  source: /note="Description of Artificial Sequence: Synthetic oligonucleotide"
gaguaauccgaagagucaaa

SEQ ID NO: 5722 - RNA, 20 nt, Artificial Sequence
  source: /note="Description of Artificial Sequence: Synthetic oligonucleotide"
auccgaagagucaaauggua

SEQ ID NO: 5723 - RNA, 20 nt, Artificial Sequence
  source: /note="Description of Artificial Sequence: Synthetic oligonucleotide"
uuacaguccuaaaugcauau

SEQ ID NO: 5724 - RNA, 20 nt, Artificial Sequence
  source: /note="Description of Artificial Sequence: Synthetic oligonucleotide"
gcaucauagcaucuucaaag

SEQ ID NO: 5725 - RNA, 20 nt, Artificial Sequence
  source: /note="Description of Artificial Sequence: Synthetic oligonucleotide"
gaggccugucauaauuauga

SEQ ID NO: 5726 - RNA, 20 nt, Artificial Sequence
  source: /note="Description of Artificial Sequence: Synthetic oligonucleotide"
auaauaaauuauuuucagag

SEQ ID NO: 5727 - RNA, 20 nt, Artificial Sequence
  source: /note="Description of Artificial Sequence: Synthetic oligonucleotide"
auaaauuauuuucagagagg

SEQ ID NO: 5728 - RNA, 20 nt, Artificial Sequence
  source: /note="Description of Artificial Sequence: Synthetic oligonucleotide"
uaaauuauuuucagagaggc

SEQ ID NO: 5729 - RNA, 20 nt, Artificial Sequence
  source: /note="Description of Artificial Sequence: Synthetic oligonucleotide"
auuuucagagaggcgggaga

SEQ ID NO: 5730 - RNA, 20 nt, Artificial Sequence
  source: /note="Description of Artificial Sequence: Synthetic oligonucleotide"
gggagaaggaacaaaaucaa

SEQ ID NO: 5731 - RNA, 20 nt, Artificial Sequence
  source: /note="Description of Artificial Sequence: Synthetic oligonucleotide"
aaaucaaaggaaaacugcug

SEQ ID NO: 5732 - RNA, 20 nt, Artificial Sequence
  source: /note="Description of Artificial Sequence: Synthetic oligonucleotide"
gcuguggcuaaaaccuguuu

SEQ ID NO: 5733 - RNA, 20 nt, Artificial Sequence
  source: /note="Description of Artificial Sequence: Synthetic oligonucleotide"
cuaaaaccuguuuuggucuu

SEQ ID NO: 5734 - RNA, 20 nt, Artificial Sequence
  source: /note="Description of Artificial Sequence: Synthetic oligonucleotide"
aauguuagcuaguagucaaa

SEQ ID NO: 5735 - RNA, 20 nt, Artificial Sequence
  source: /note="Description of Artificial Sequence: Synthetic oligonucleotide"
gccucugacauagaagauaa

SEQ ID NO: 5736 - RNA, 20 nt, Artificial Sequence
  source: /note="Description of Artificial Sequence: Synthetic oligonucleotide"
uagcuuaugaaaauuuauuc

SEQ ID NO: 5737 - RNA, 20 nt, Artificial Sequence
  source: /note="Description of Artificial Sequence: Synthetic oligonucleotide"
agcuuaugaaaauuuauucu

SEQ ID NO: 5738 - RNA, 20 nt, Artificial Sequence
  source: /note="Description of Artificial Sequence: Synthetic oligonucleotide"
gcuuaugaaaauuuauucug

SEQ ID NO: 5739 - RNA, 20 nt, Artificial Sequence
  source: /note="Description of Artificial Sequence: Synthetic oligonucleotide"
cauuagcugaaauuauugag

SEQ ID NO: 5740 - RNA, 20 nt, Artificial Sequence
  source: /note="Description of Artificial Sequence: Synthetic oligonucleotide"
ucuauuuauguuaaauugcc

SEQ ID NO: 5741 - RNA, 20 nt, Artificial Sequence
  source: /note="Description of Artificial Sequence: Synthetic oligonucleotide"
uuuagaauuucugaaaaaaa

SEQ ID NO: 5742 - RNA, 20 nt, Artificial Sequence
  source: /note="Description of Artificial Sequence: Synthetic oligonucleotide"
agaauuucugaaaaaaaugg

SEQ ID NO: 5743 - RNA, 20 nt, Artificial Sequence
  source: /note="Description of Artificial Sequence: Synthetic oligonucleotide"
guaaauagaaauauucuuuu

SEQ ID NO: 5744 - RNA, 20 nt, Artificial Sequence
  source: /note="Description of Artificial Sequence: Synthetic oligonucleotide"
aaauauucuuuuugguuccu

SEQ ID NO: 5745 - RNA, 20 nt, Artificial Sequence
  source: /note="Description of Artificial Sequence: Synthetic oligonucleotide"
uacaaagaacauuagauuau

SEQ ID NO: 5746 - RNA, 20 nt, Artificial Sequence
  source: /note="Description of Artificial Sequence: Synthetic oligonucleotide"
cauuagauuauuggaauaaa

SEQ ID NO: 5747 - RNA, 20 nt, Artificial Sequence
  source: /note="Description of Artificial Sequence: Synthetic oligonucleotide"
gacauacauaauaugacuag

SEQ ID NO: 5748 - RNA, 20 nt, Artificial Sequence
  source: /note="Description of Artificial Sequence: Synthetic oligonucleotide"
acauacauaauaugacuagu

SEQ ID NO: 5749 - RNA, 20 nt, Artificial Sequence
  source: /note="Description of Artificial Sequence: Synthetic oligonucleotide"
auuuaauuagucugucauuu

SEQ ID NO: 5750 - RNA, 20 nt, Artificial Sequence
  source: /note="Description of Artificial Sequence: Synthetic oligonucleotide"
aauucacuuuguugccuuuu

SEQ ID NO: 5751 - RNA, 20 nt, Artificial Sequence
  source: /note="Description of Artificial Sequence: Synthetic oligonucleotide"
aacaugccauguauuuuccu

SEQ ID NO: 5752 - RNA, 20 nt, Artificial Sequence
  source: /note="Description of Artificial Sequence: Synthetic oligonucleotide"
ccauguauuuuccuagguua

SEQ ID NO: 5753 - RNA, 20 nt, Artificial Sequence
  source: /note="Description of Artificial Sequence: Synthetic oligonucleotide"
cauguauuuuccuagguuaa

SEQ ID NO: 5754 - RNA, 20 nt, Artificial Sequence
  source: /note="Description of Artificial Sequence: Synthetic oligonucleotide"
cgcucuaugaguuuuuuaug

SEQ ID NO: 5755 - RNA, 20 nt, Artificial Sequence
  source: /note="Description of Artificial Sequence: Synthetic oligonucleotide"
acugaugcacauuucuccuu

SEQ ID NO: 5756 - RNA, 20 nt, Artificial Sequence
  source: /note="Description of Artificial Sequence: Synthetic oligonucleotide"
cacauuucuccuuaggucac

SEQ ID NO: 5757 - RNA, 20 nt, Artificial Sequence
  source: /note="Description of Artificial Sequence: Synthetic oligonucleotide"
uccucccucagcaauguugu

SEQ ID NO: 5758 - RNA, 20 nt, Artificial Sequence
  source: /note="Description of Artificial Sequence: Synthetic oligonucleotide"
aguguuuuucucucauacua

SEQ ID NO: 5759 - RNA, 20 nt, Artificial Sequence
  source: /note="Description of Artificial Sequence: Synthetic oligonucleotide"
uaaauuuuacaagagugacu

SEQ ID NO: 5760 - RNA, 20 nt, Artificial Sequence
  source: /note="Description of Artificial Sequence: Synthetic oligonucleotide"
aaauuuuacaagagugacuu

SEQ ID NO: 5761 - RNA, 20 nt, Artificial Sequence
  source: /note="Description of Artificial Sequence: Synthetic oligonucleotide"
uuuuacaagagugacuuggg

SEQ ID NO: 5762 - RNA, 20 nt, Artificial Sequence
  source: /note="Description of Artificial Sequence: Synthetic oligonucleotide"
gcugauaugcccacauugac

SEQ ID NO: 5763 - RNA, 20 nt, Artificial Sequence
  source: /note="Description of Artificial Sequence: Synthetic oligonucleotide"
cugauaugcccacauugaca

SEQ ID NO: 5764 - RNA, 20 nt, Artificial Sequence
  source: /note="Description of Artificial Sequence: Synthetic oligonucleotide"
uccccucuccuguauuccca

SEQ ID NO: 5765 - RNA, 20 nt, Artificial Sequence
  source: /note="Description of Artificial Sequence: Synthetic oligonucleotide"
ccucaacauaaccacaguuc

SEQ ID NO: 5766 - RNA, 20 nt, Artificial Sequence
  source: /note="Description of Artificial Sequence: Synthetic oligonucleotide"
cucaacauaaccacaguuca

SEQ ID NO: 5767 - RNA, 20 nt, Artificial Sequence
  source: /note="Description of Artificial Sequence: Synthetic oligonucleotide"
accacaguucagggcaguag

SEQ ID NO: 5768 - RNA, 20 nt, Artificial Sequence
  source: /note="Description of Artificial Sequence: Synthetic oligonucleotide"
uuuguguuagcuccaugcca

SEQ ID NO: 5769 - RNA, 20 nt, Artificial Sequence
  source: /note="Description of Artificial Sequence: Synthetic oligonucleotide"
cauggcaacugcacugagug

SEQ ID NO: 5770 - RNA, 20 nt, Artificial Sequence
  source: /note="Description of Artificial Sequence: Synthetic oligonucleotide"
aggauucaacucagugcagc

SEQ ID NO: 5771 - RNA, 20 nt, Artificial Sequence
  source: /note="Description of Artificial Sequence: Synthetic oligonucleotide"
auucucugagugacauuauc

SEQ ID NO: 5772 - RNA, 20 nt, Artificial Sequence
  source: /note="Description of Artificial Sequence: Synthetic oligonucleotide"
uucucugagugacauuauca

SEQ ID NO: 5773 - RNA, 20 nt, Artificial Sequence
  source: /note="Description of Artificial Sequence: Synthetic oligonucleotide"
ucucugagugacauuaucag

SEQ ID NO: 5774 - RNA, 20 nt, Artificial Sequence
  source: /note="Description of Artificial Sequence: Synthetic oligonucleotide"
ccagcauugcaaagauaauc

SEQ ID NO: 5775 - RNA, 20 nt, Artificial Sequence
  source: /note="Description of Artificial Sequence: Synthetic oligonucleotide"
cagcauugcaaagauaaucu

SEQ ID NO: 5776 - RNA, 20 nt, Artificial Sequence
  source: /note="Description of Artificial Sequence: Synthetic oligonucleotide"
auugcaaagauaaucuggga

SEQ ID NO: 5777 - RNA, 20 nt, Artificial Sequence
  source: /note="Description of Artificial Sequence: Synthetic oligonucleotide"
gcaaagauaaucugggaagg

SEQ ID NO: 5778 - RNA, 20 nt, Artificial Sequence
  source: /note="Description of Artificial Sequence: Synthetic oligonucleotide"
aucugggaagguggcaaaga

SEQ ID NO: 5779 - RNA, 20 nt, Artificial Sequence
  source: /note="Description of Artificial Sequence: Synthetic oligonucleotide"
ucugggaagguggcaaagaa

SEQ ID NO: 5780 - RNA, 20 nt, Artificial Sequence
  source: /note="Description of Artificial Sequence: Synthetic oligonucleotide"
aagggaucagaauaacucug

SEQ ID NO: 5781 - RNA, 20 nt, Artificial Sequence
  source: /note="Description of Artificial Sequence: Synthetic oligonucleotide"
cacauaaagaaaugauuugu

SEQ ID NO: 5782 - RNA, 20 nt, Artificial Sequence
  source: /note="Description of Artificial Sequence: Synthetic oligonucleotide"
aaaaaaaaagcuuaaauugu

SEQ ID NO: 5783 - RNA, 20 nt, Artificial Sequence
  source: /note="Description of Artificial Sequence: Synthetic oligonucleotide"
gcacuugucuuaguauugug

SEQ ID NO: 5784 - RNA, 20 nt, Artificial Sequence
  source: /note="Description of Artificial Sequence: Synthetic oligonucleotide"
cuugucuuaguauugugugg

SEQ ID NO: 5785 - RNA, 20 nt, Artificial Sequence
  source: /note="Description of Artificial Sequence: Synthetic oligonucleotide"
uugucuuaguauuguguggu

SEQ ID NO: 5786 - RNA, 20 nt, Artificial Sequence
  source: /note="Description of Artificial Sequence: Synthetic oligonucleotide"
agagagcugccagagugcuu

SEQ ID NO: 5787 - RNA, 20 nt, Artificial Sequence
  source: /note="Description of Artificial Sequence: Synthetic oligonucleotide"
gugcuuaggccuagucccug

SEQ ID NO: 5788 - RNA, 20 nt, Artificial Sequence
  source: /note="Description of Artificial Sequence: Synthetic oligonucleotide"
ugcuuaggccuagucccugu

SEQ ID NO: 5789 - RNA, 20 nt, Artificial Sequence
  source: /note="Description of Artificial Sequence: Synthetic oligonucleotide"
cccugugggagccucuguuu

SEQ ID NO: 5790 - RNA, 20 nt, Artificial Sequence
  source: /note="Description of Artificial Sequence: Synthetic oligonucleotide"
ucuguuuuggugcuucacca

SEQ ID NO: 5791 - RNA, 20 nt, Artificial Sequence
  source: /note="Description of Artificial Sequence: Synthetic oligonucleotide"
cuguuuuggugcuucaccau

SEQ ID NO: 5792 - RNA, 20 nt, Artificial Sequence
  source: /note="Description of Artificial Sequence: Synthetic oligonucleotide"
acaucuuuaaaaugagaaaa

SEQ ID NO: 5793 - RNA, 20 nt, Artificial Sequence
  source: /note="Description of Artificial Sequence: Synthetic oligonucleotide"
ugaaauguuuauacauuguu

SEQ ID NO: 5794 - RNA, 20 nt, Artificial Sequence
  source: /note="Description of Artificial Sequence: Synthetic oligonucleotide"
aauuucuuagccgugugaua

SEQ ID NO: 5795 - RNA, 20 nt, Artificial Sequence
  source: /note="Description of Artificial Sequence: Synthetic oligonucleotide"
cuuagccgugugauaugguu

SEQ ID NO: 5796 - RNA, 20 nt, Artificial Sequence
  source: /note="Description of Artificial Sequence: Synthetic oligonucleotide"
gugugauaugguuugguugu

SEQ ID NO: 5797 - RNA, 20 nt, Artificial Sequence
  source: /note="Description of Artificial Sequence: Synthetic oligonucleotide"
ugaaauauaauccccagugu

SEQ ID NO: 5798 - RNA, 20 nt, Artificial Sequence
  source: /note="Description of Artificial Sequence: Synthetic oligonucleotide"
aauauaauccccaguguugg

SEQ ID NO: 5799 - RNA, 20 nt, Artificial Sequence
  source: /note="Description of Artificial Sequence: Synthetic oligonucleotide"
auaauccccaguguuggagg

SEQ ID NO: 5800 - RNA, 20 nt, Artificial Sequence
  source: /note="Description of Artificial Sequence: Synthetic oligonucleotide"
uaauccccaguguuggaggu

SEQ ID NO: 5801 - RNA, 20 nt, Artificial Sequence
  source: /note="Description of Artificial Sequence: Synthetic oligonucleotide"
aauccccaguguuggaggug

SEQ ID NO: 5802 - RNA, 20 nt, Artificial Sequence
  source: /note="Description of Artificial Sequence: Synthetic oligonucleotide"
auccccaguguuggaggugg

SEQ ID NO: 5803 - RNA, 20 nt, Artificial Sequence
  source: /note="Description of Artificial Sequence: Synthetic oligonucleotide"
caguguuggaggugggggcc

SEQ ID NO: 5804 - RNA, 20 nt, Artificial Sequence
  source: /note="Description of Artificial Sequence: Synthetic oligonucleotide"
uguuggaggugggggccugg

SEQ ID NO: 5805 - RNA, 20 nt, Artificial Sequence
  source: /note="Description of Artificial Sequence: Synthetic oligonucleotide"
guuggaggugggggccuggu

SEQ ID NO: 5806 - RNA, 20 nt, Artificial Sequence
  source: /note="Description of Artificial Sequence: Synthetic oligonucleotide"
ggggccuggugggaaguguu

SEQ ID NO: 5807 - RNA, 20 nt, Artificial Sequence
  source: /note="Description of Artificial Sequence: Synthetic oligonucleotide"
gugggaaguguuuggauuau

SEQ ID NO: 5808 - RNA, 20 nt, Artificial Sequence
  source: /note="Description of Artificial Sequence: Synthetic oligonucleotide"
ugggaaguguuuggauuauu

SEQ ID NO: 5809 - RNA, 20 nt, Artificial Sequence
  source: /note="Description of Artificial Sequence: Synthetic oligonucleotide"
gggaaguguuuggauuauug

SEQ ID NO: 5810 - RNA, 20 nt, Artificial Sequence
  source: /note="Description of Artificial Sequence: Synthetic oligonucleotide"
uuauuggggcagaucccuca

SEQ ID NO: 5811 - RNA, 20 nt, Artificial Sequence
  source: /note="Description of Artificial Sequence: Synthetic oligonucleotide"
ggggcagaucccucauggca

SEQ ID NO: 5812 - RNA, 20 nt, Artificial Sequence
  source: /note="Description of Artificial Sequence: Synthetic oligonucleotide"
uagugaguucucaagagauc

SEQ ID NO: 5813 - RNA, 20 nt, Artificial Sequence
  source: /note="Description of Artificial Sequence: Synthetic oligonucleotide"
guucucaagagaucugguua

SEQ ID NO: 5814 - RNA, 20 nt, Artificial Sequence
  source: /note="Description of Artificial Sequence: Synthetic oligonucleotide"
uucucaagagaucugguuaa

SEQ ID NO: 5815 - RNA, 20 nt, Artificial Sequence
  source: /note="Description of Artificial Sequence: Synthetic oligonucleotide"
gagaucugguuaagggugug

SEQ ID NO: 5816 - RNA, 20 nt, Artificial Sequence
  source: /note="Description of Artificial Sequence: Synthetic oligonucleotide"
ccaugauuauaaguuuugua

SEQ ID NO: 5817 - RNA, 20 nt, Artificial Sequence
  source: /note="Description of Artificial Sequence: Synthetic oligonucleotide"
agccuaacauaccuuucaaa

SEQ ID NO: 5818 - RNA, 20 nt, Artificial Sequence
  source: /note="Description of Artificial Sequence: Synthetic oligonucleotide"
gaucucuuuguccagaauuc

SEQ ID NO: 5819 - RNA, 20 nt, Artificial Sequence
  source: /note="Description of Artificial Sequence: Synthetic oligonucleotide"
auaaagaugccaaaauaaua

SEQ ID NO: 5820 - RNA, 20 nt, Artificial Sequence
  source: /note="Description of Artificial Sequence: Synthetic oligonucleotide"
uauggcauguauuugaucuc

SEQ ID NO: 5821 - RNA, 20 nt, Artificial Sequence
  source: /note="Description of Artificial Sequence: Synthetic oligonucleotide"
auggcauguauuugaucuca

SEQ ID NO: 5822 - RNA, 20 nt, Artificial Sequence
  source: /note="Description of Artificial Sequence: Synthetic oligonucleotide"
ggaauuuucauuuuuucaaa

SEQ ID NO: 5823 - RNA, 20 nt, Artificial Sequence
  source: /note="Description of Artificial Sequence: Synthetic oligonucleotide"
auuuucauuuuuucaaaagg

SEQ ID NO: 5824 - RNA, 20 nt, Artificial Sequence
  source: /note="Description of Artificial Sequence: Synthetic oligonucleotide"
aauauaauuuuuuaauauuu

SEQ ID NO: 5825 - RNA, 20 nt, Artificial Sequence
  source: /note="Description of Artificial Sequence: Synthetic oligonucleotide"
gagcacauugugaaacuuuc

SEQ ID NO: 5826 - RNA, 20 nt, Artificial Sequence
  source: /note="Description of Artificial Sequence: Synthetic oligonucleotide"
ucaggaauugcaugagcugu

SEQ ID NO: 5827 - RNA, 20 nt, Artificial Sequence
  source: /note="Description of Artificial Sequence: Synthetic oligonucleotide"
acccauaagagcaucuccug

SEQ ID NO: 5828 - RNA, 20 nt, Artificial Sequence
  source: /note="Description of Artificial Sequence: Synthetic oligonucleotide"
gacaucaugaaaaucauccc

SEQ ID NO: 5829 - RNA, 20 nt, Artificial Sequence
  source: /note="Description of Artificial Sequence: Synthetic oligonucleotide"
acaucaugaaaaucaucccu

SEQ ID NO: 5830 - RNA, 20 nt, Artificial Sequence
  source: /note="Description of Artificial Sequence: Synthetic oligonucleotide"
gguaaacaauuagucacucc

SEQ ID NO: 5831 - RNA, 20 nt, Artificial Sequence
  source: /note="Description of Artificial Sequence: Synthetic oligonucleotide"
gucacuccagguuuucccaa

SEQ ID NO: 5832 - RNA, 20 nt, Artificial Sequence
  source: /note="Description of Artificial Sequence: Synthetic oligonucleotide"
caguuuaacaaccccaaaaa

SEQ ID NO: 5833 - RNA, 20 nt, Artificial Sequence
  source: /note="Description of Artificial Sequence: Synthetic oligonucleotide"
aaaaaggccuuaauuuugau

SEQ ID NO: 5834 - RNA, 20 nt, Artificial Sequence
  source: /note="Description of Artificial Sequence: Synthetic oligonucleotide"
ugauuggccagcauccucuu

SEQ ID NO: 5835 - RNA, 20 nt, Artificial Sequence
  source: /note="Description of Artificial Sequence: Synthetic oligonucleotide"
aauaagaauuguuuccaucu

SEQ ID NO: 5836 - RNA, 20 nt, Artificial Sequence
  source: /note="Description of Artificial Sequence: Synthetic oligonucleotide"
auaagaauuguuuccaucua

SEQ ID NO: 5837 - RNA, 20 nt, Artificial Sequence
  source: /note="Description of Artificial Sequence: Synthetic oligonucleotide"
aucuagggaaugauuuuuau

SEQ ID NO: 5838 - RNA, 20 nt, Artificial Sequence
  source: /note="Description of Artificial Sequence: Synthetic oligonucleotide"
uuuauagguagaaucuuauu

SEQ ID NO: 5839 - RNA, 20 nt, Artificial Sequence
  source: /note="Description of Artificial Sequence: Synthetic oligonucleotide"
agguagaaucuuauuuggca

SEQ ID NO: 5840 - RNA, 20 nt, Artificial Sequence
  source: /note="Description of Artificial Sequence: Synthetic oligonucleotide"
uguguagaccuucaauagca

SEQ ID NO: 5841 - RNA, 20 nt, Artificial Sequence
  source: /note="Description of Artificial Sequence: Synthetic oligonucleotide"
cauauuaauuuuguguucuc

SEQ ID NO: 5842 - RNA, 20 nt, Artificial Sequence
  source: /note="Description of Artificial Sequence: Synthetic oligonucleotide"
cugguguaagaaaaaauaga

SEQ ID NO: 5843 - RNA, 20 nt, Artificial Sequence
  source: /note="Description of Artificial Sequence: Synthetic oligonucleotide"
cucuacuuucacugaauagc

SEQ ID NO: 5844 - RNA, 20 nt, Artificial Sequence
  source: /note="Description of Artificial Sequence: Synthetic oligonucleotide"
cugaauagcaggugaauagc

SEQ ID NO: 5845 - RNA, 20 nt, Artificial Sequence
  source: /note="Description of Artificial Sequence: Synthetic oligonucleotide"
cuacaaugagcaaaaugcau

SEQ ID NO: 5846 - RNA, 20 nt, Artificial Sequence
  source: /note="Description of Artificial Sequence: Synthetic oligonucleotide"
uugaaagaguacugugcaag

SEQ ID NO: 5847 - RNA, 20 nt, Artificial Sequence
  source: /note="Description of Artificial Sequence: Synthetic oligonucleotide"
ugaaagaguacugugcaagu

SEQ ID NO: 5848 - RNA, 20 nt, Artificial Sequence
  source: /note="Description of Artificial Sequence: Synthetic oligonucleotide"
guacugugcaaguggguuac

SEQ ID NO: 5849 - RNA, 20 nt, Artificial Sequence
  source: /note="Description of Artificial Sequence: Synthetic oligonucleotide"
uuacuggaucauaauauucc

SEQ ID NO: 5850 - RNA, 20 nt, Artificial Sequence
  source: /note="Description of Artificial Sequence: Synthetic oligonucleotide"
uacuggaucauaauauucca

SEQ ID NO: 5851 - RNA, 20 nt, Artificial Sequence
  source: /note="Description of Artificial Sequence: Synthetic oligonucleotide"
gcauuuuucuccuucuaaaa

SEQ ID NO: 5852 - RNA, 20 nt, Artificial Sequence
  source: /note="Description of Artificial Sequence: Synthetic oligonucleotide"
cauuaaacuuuucacacaaa

SEQ ID NO: 5853 - RNA, 20 nt, Artificial Sequence
  source: /note="Description of Artificial Sequence: Synthetic oligonucleotide"
ucacacaaaugguuguauaa

SEQ ID NO: 5854 - RNA, 20 nt, Artificial Sequence
  source: /note="Description of Artificial Sequence: Synthetic oligonucleotide"
uucuguauaauguuuaaaaa

SEQ ID NO: 5855 - RNA, 20 nt, Artificial Sequence
  source: /note="Description of Artificial Sequence: Synthetic oligonucleotide"
guagcuauuauuauacucaa

SEQ ID NO: 5856 - RNA, 20 nt, Artificial Sequence
  source: /note="Description of Artificial Sequence: Synthetic oligonucleotide"
aaagaauguccaaaauuaug

SEQ ID NO: 5857 - RNA, 20 nt, Artificial Sequence
  source: /note="Description of Artificial Sequence: Synthetic oligonucleotide"
auguccaaaauuauguggaa

SEQ ID NO: 5858 - RNA, 20 nt, Artificial Sequence
  source: /note="Description of Artificial Sequence: Synthetic oligonucleotide"
ugauugcucuguauaugaau

SEQ ID NO: 5859 - RNA, 20 nt, Artificial Sequence
  source: /note="Description of Artificial Sequence: Synthetic oligonucleotide"
aaaagaaaagugccuuuuuu

SEQ ID NO: 5860 - RNA, 20 nt, Artificial Sequence
  source: /note="Description of Artificial Sequence: Synthetic oligonucleotide"
ugccuuuuuuugguaguauc

SEQ ID NO: 5861 - RNA, 20 nt, Artificial Sequence
  source: /note="Description of Artificial Sequence: Synthetic oligonucleotide"
uuuuuugguaguaucuggac

SEQ ID NO: 5862 - RNA, 20 nt, Artificial Sequence
  source: /note="Description of Artificial Sequence: Synthetic oligonucleotide"
guaauugacuuucuuucugc

SEQ ID NO: 5863 - RNA, 20 nt, Artificial Sequence
  source: /note="Description of Artificial Sequence: Synthetic oligonucleotide"
aagugauaguguccugauuu

SEQ ID NO: 5864 - RNA, 20 nt, Artificial Sequence
  source: /note="Description of Artificial Sequence: Synthetic oligonucleotide"
aaaccuaaaguuucuuuauu

SEQ ID NO: 5865 - RNA, 20 nt, Artificial Sequence
  source: /note="Description of Artificial Sequence: Synthetic oligonucleotide"
gaaacauaauguaagccaca

SEQ ID NO: 5866 - RNA, 20 nt, Artificial Sequence
  source: /note="Description of Artificial Sequence: Synthetic oligonucleotide"
auagauaccacaucucaauu

SEQ ID NO: 5867 - RNA, 20 nt, Artificial Sequence
  source: /note="Description of Artificial Sequence: Synthetic oligonucleotide"
uuuggacuagacacauuuua

SEQ ID NO: 5868 - RNA, 20 nt, Artificial Sequence
  source: /note="Description of Artificial Sequence: Synthetic oligonucleotide"
uuggacuagacacauuuuaa

SEQ ID NO: 5869 - RNA, 20 nt, Artificial Sequence
  source: /note="Description of Artificial Sequence: Synthetic oligonucleotide"
uauaugugacuagucacugu

SEQ ID NO: 5870 - RNA, 20 nt, Artificial Sequence
  source: /note="Description of Artificial Sequence: Synthetic oligonucleotide"
cuagaccaucucuuaaugua

SEQ ID NO: 5871 - RNA, 20 nt, Artificial Sequence
  source: /note="Description of Artificial Sequence: Synthetic oligonucleotide"
accaucucuuaauguaugga

SEQ ID NO: 5872 - RNA, 20 nt, Artificial Sequence
  source: /note="Description of Artificial Sequence: Synthetic oligonucleotide"
cagagucucgcucuguugcc

SEQ ID NO: 5873 - RNA, 20 nt, Artificial Sequence
  source: /note="Description of Artificial Sequence: Synthetic oligonucleotide"
gucucgcucuguugccaggc

SEQ ID NO: 5874 - RNA, 20 nt, Artificial Sequence
  source: /note="Description of Artificial Sequence: Synthetic oligonucleotide"
guugccaggcuggagugcag

SEQ ID NO: 5875 - RNA, 20 nt, Artificial Sequence
  source: /note="Description of Artificial Sequence: Synthetic oligonucleotide"
ggagugcaguggcgcgaucu

SEQ ID NO: 5876 - RNA, 20 nt, Artificial Sequence
  source: /note="Description of Artificial Sequence: Synthetic oligonucleotide"
ucacugcaaccuccgccucc

SEQ ID NO: 5877 - RNA, 20 nt, Artificial Sequence
  source: /note="Description of Artificial Sequence: Synthetic oligonucleotide"
cacugcaaccuccgccuccu

SEQ ID NO: 5878 - RNA, 20 nt, Artificial Sequence
  source: /note="Description of Artificial Sequence: Synthetic oligonucleotide"
gccucagccucccaaguaac

SEQ ID NO: 5879 - RNA, 20 nt, Artificial Sequence
  source: /note="Description of Artificial Sequence: Synthetic oligonucleotide"
ccucagccucccaaguaacu

SEQ ID NO: 5880 - RNA, 20 nt, Artificial Sequence
  source: /note="Description of Artificial Sequence: Synthetic oligonucleotide"
ucccaaguaacugggacuac

SEQ ID NO: 5881 - RNA, 20 nt, Artificial Sequence
  source: /note="Description of Artificial Sequence: Synthetic oligonucleotide"
acuuuuuguauuuuuaguag

SEQ ID NO: 5882 - RNA, 20 nt, Artificial Sequence
  source: /note="Description of Artificial Sequence: Synthetic oligonucleotide"
uuuuguauuuuuaguagugg

SEQ ID NO: 5883 - RNA, 20 nt, Artificial Sequence
  source: /note="Description of Artificial Sequence: Synthetic oligonucleotide"
guggcgguguuugaccacgu

SEQ ID NO: 5884 - RNA, 20 nt, Artificial Sequence
  source: /note="Description of Artificial Sequence: Synthetic oligonucleotide"
uuugaccacguuggccaaga

SEQ ID NO: 5885 - RNA, 20 nt, Artificial Sequence
  source: /note="Description of Artificial Sequence: Synthetic oligonucleotide"
gccucagccucccaaagugc

SEQ ID NO: 5886 - RNA, 20 nt, Artificial Sequence
  source: /note="Description of Artificial Sequence: Synthetic oligonucleotide"
ccucagccucccaaagugcu

SEQ ID NO: 5887 - RNA, 20 nt, Artificial Sequence
  source: /note="Description of Artificial Sequence: Synthetic oligonucleotide"
ucccaaagugcugggacuac

SEQ ID NO: 5888 - RNA, 20 nt, Artificial Sequence
  source: /note="Description of Artificial Sequence: Synthetic oligonucleotide"
caggcgugagccaccgugcc

SEQ ID NO: 5889 - RNA, 20 nt, Artificial Sequence
  source: /note="Description of Artificial Sequence: Synthetic oligonucleotide"
uauuaaguaauacacaugcu

SEQ ID NO: 5890 - RNA, 20 nt, Artificial Sequence
  source: /note="Description of Artificial Sequence: Synthetic oligonucleotide"
guuauuuaaaaaaaaaaaaa

SEQ ID NO: 5891 - RNA, 20 nt, Artificial Sequence
  source: /note="Description of Artificial Sequence: Synthetic oligonucleotide"
agcugccccauuccuuuucc

SEQ ID NO: 5892 - RNA, 20 nt, Artificial Sequence
  source: /note="Description of Artificial Sequence: Synthetic oligonucleotide"
ugccccauuccuuuuccugg

SEQ ID NO: 5893 - RNA, 20 nt, Artificial Sequence
  source: /note="Description of Artificial Sequence: Synthetic oligonucleotide"
uuccuggaggcaaauuauua

SEQ ID NO: 5894 - RNA, 20 nt, Artificial Sequence
  source: /note="Description of Artificial Sequence: Synthetic oligonucleotide"
gauuuuuuuuuauuuuacaa

SEQ ID NO: 5895 - RNA, 20 nt, Artificial Sequence
  source: /note="Description of Artificial Sequence: Synthetic oligonucleotide"
uuuuuauuuuacaaagguau

SEQ ID NO: 5896 - RNA, 20 nt, Artificial Sequence
  source: /note="Description of Artificial Sequence: Synthetic oligonucleotide"
ccuuuauuccauuuaauuac

SEQ ID NO: 5897 - RNA, 20 nt, Artificial Sequence
  source: /note="Description of Artificial Sequence: Synthetic oligonucleotide"
cuuuauuccauuuaauuacu

SEQ ID NO: 5898 - RNA, 20 nt, Artificial Sequence
  source: /note="Description of Artificial Sequence: Synthetic oligonucleotide"
uacuaauuuuaauagcuaca

SEQ ID NO: 5899 - RNA, 20 nt, Artificial Sequence
  source: /note="Description of Artificial Sequence: Synthetic oligonucleotide"
cuacaugguauuauauugug

SEQ ID NO: 5900 - RNA, 20 nt, Artificial Sequence
  source: /note="Description of Artificial Sequence: Synthetic oligonucleotide"
aacauaacccuuauugaugu

SEQ ID NO: 5901 - RNA, 20 nt, Artificial Sequence
  source: /note="Description of Artificial Sequence: Synthetic oligonucleotide"
agugucucacucugucaccc

SEQ ID NO: 5902 - RNA, 20 nt, Artificial Sequence
  source: /note="Description of Artificial Sequence: Synthetic oligonucleotide"
ucucacucugucacccaggc

SEQ ID NO: 5903 - RNA, 20 nt, Artificial Sequence
  source: /note="Description of Artificial Sequence: Synthetic oligonucleotide"
ucacugcaguguccaccucc

SEQ ID NO: 5904 - RNA, 20 nt, Artificial Sequence
  source: /note="Description of Artificial Sequence: Synthetic oligonucleotide"
cacugcaguguccaccuccu

SEQ ID NO: 5905 - RNA, 20 nt, Artificial Sequence
  source: /note="Description of Artificial Sequence: Synthetic oligonucleotide"
aguguccaccuccuggguuc

SEQ ID NO: 5906 - RNA, 20 nt, Artificial Sequence
  source: /note="Description of Artificial Sequence: Synthetic oligonucleotide"
uccucagccucccaaguaac

SEQ ID NO: 5907 - RNA, 20 nt, Artificial Sequence
  source: /note="Description of Artificial Sequence: Synthetic oligonucleotide"
ccucagccucccaaguaacu

SEQ ID NO: 5908 - RNA, 20 nt, Artificial Sequence
  source: /note="Description of Artificial Sequence: Synthetic oligonucleotide"
ucccaaguaacugggauuac

SEQ ID NO: 5909 - RNA, 20 nt, Artificial Sequence
  source: /note="Description of Artificial Sequence: Synthetic oligonucleotide"
gcuaauuuuuguaucuuuuu

SEQ ID NO: 5910 - RNA, 20 nt, Artificial Sequence
  source: /note="Description of Artificial Sequence: Synthetic oligonucleotide"
uuguaucuuuuuaggagaga

SEQ ID NO: 5911 - RNA, 20 nt, Artificial Sequence
  source: /note="Description of Artificial Sequence: Synthetic oligonucleotide"
uguaucuuuuuaggagagac

SEQ ID NO: 5912 - RNA, 20 nt, Artificial Sequence
  source: /note="Description of Artificial Sequence: Synthetic oligonucleotide"
gagacgggauuucaccaugu

SEQ ID NO: 5913 - RNA, 20 nt, Artificial Sequence
  source: /note="Description of Artificial Sequence: Synthetic oligonucleotide"
gggauuucaccauguuggcc

SEQ ID NO: 5914 - RNA, 20 nt, Artificial Sequence
  source: /note="Description of Artificial Sequence: Synthetic oligonucleotide"
uuucaccauguuggccaggu

SEQ ID NO: 5915 - RNA, 20 nt, Artificial Sequence
  source: /note="Description of Artificial Sequence: Synthetic oligonucleotide"
ccagguuggucuagaacucc

SEQ ID NO: 5916 - RNA, 20 nt, Artificial Sequence
  source: /note="Description of Artificial Sequence: Synthetic oligonucleotide"
ggucuagaacuccuggccuc

SEQ ID NO: 5917 - RNA, 20 nt, Artificial Sequence
  source: /note="Description of Artificial Sequence: Synthetic oligonucleotide"
ccuggccucaggugauccac

SEQ ID NO: 5918 - RNA, 20 nt, Artificial Sequence
  source: /note="Description of Artificial Sequence: Synthetic oligonucleotide"
gccuuagcuucccaaagugc

SEQ ID NO: 5919 - RNA, 20 nt, Artificial Sequence
  source: /note="Description of Artificial Sequence: Synthetic oligonucleotide"
ccuuagcuucccaaagugcu

SEQ ID NO: 5920 - RNA, 20 nt, Artificial Sequence
  source: /note="Description of Artificial Sequence: Synthetic oligonucleotide"
ucccaaagugcugggauuau

SEQ ID NO: 5921 - RNA, 20 nt, Artificial Sequence
  source: /note="Description of Artificial Sequence: Synthetic oligonucleotide"
cugucagauaaauucuuaaa

SEQ ID NO: 5922 - RNA, 20 nt, Artificial Sequence
  source: /note="Description of Artificial Sequence: Synthetic oligonucleotide"
ugucagauaaauucuuaaaa

SEQ ID NO: 5923 - RNA, 20 nt, Artificial Sequence
  source: /note="Description of Artificial Sequence: Synthetic oligonucleotide"
auaaauucuuaaaaggguca

SEQ ID NO: 5924 - RNA, 20 nt, Artificial Sequence
  source: /note="Description of Artificial Sequence: Synthetic oligonucleotide"
gucauccuacaugauauuug

SEQ ID NO: 5925 - RNA, 20 nt, Artificial Sequence
  source: /note="Description of Artificial Sequence: Synthetic oligonucleotide"
gcuuacugaucuucacuaau

SEQ ID NO: 5926 - RNA, 20 nt, Artificial Sequence
  source: /note="Description of Artificial Sequence: Synthetic oligonucleotide"
cuuguccauuuuuuaguaug

SEQ ID NO: 5927 - RNA, 20 nt, Artificial Sequence
  source: /note="Description of Artificial Sequence: Synthetic oligonucleotide"
gugguuauucauuuauuugu

SEQ ID NO: 5928 - RNA, 20 nt, Artificial Sequence
  source: /note="Description of Artificial Sequence: Synthetic oligonucleotide"
cucuuuuuacauguuuauuu

SEQ ID NO: 5929 - RNA, 20 nt, Artificial Sequence
  source: /note="Description of Artificial Sequence: Synthetic oligonucleotide"
cucagauuguuuuuaacuuu

SEQ ID NO: 5930 - RNA, 20 nt, Artificial Sequence
  source: /note="Description of Artificial Sequence: Synthetic oligonucleotide"
ucagauuguuuuuaacuuuu

SEQ ID NO: 5931 - RNA, 20 nt, Artificial Sequence
  source: /note="Description of Artificial Sequence: Synthetic oligonucleotide"
cagauuguuuuuaacuuuug

SEQ ID NO: 5932 - RNA, 20 nt, Artificial Sequence
  source: /note="Description of Artificial Sequence: Synthetic oligonucleotide"
agauuguuuuuaacuuuugg

SEQ ID NO: 5933 - RNA, 20 nt, Artificial Sequence
  source: /note="Description of Artificial Sequence: Synthetic oligonucleotide"
gauuguuuuuaacuuuuggg

SEQ ID NO: 5934 - RNA, 20 nt, Artificial Sequence
  source: /note="Description of Artificial Sequence: Synthetic oligonucleotide"
auuguuuuuaacuuuugggg

SEQ ID NO: 5935 - RNA, 20 nt, Artificial Sequence
  source: /note="Description of Artificial Sequence: Synthetic oligonucleotide"
agaauuuaucuuaaagugua

SEQ ID NO: 5936 - RNA, 20 nt, Artificial Sequence
  source: /note="Description of Artificial Sequence: Synthetic oligonucleotide"
gaauuuaucuuaaaguguaa

SEQ ID NO: 5937 - RNA, 20 nt, Artificial Sequence
  source: /note="Description of Artificial Sequence: Synthetic oligonucleotide"
ucccacuuuaucauuuuuuc

SEQ ID NO: 5938 - RNA, 20 nt, Artificial Sequence
  source: /note="Description of Artificial Sequence: Synthetic oligonucleotide"
uaucuuguagcauauuucug

SEQ ID NO: 5939 - RNA, 20 nt, Artificial Sequence
  source: /note="Description of Artificial Sequence: Synthetic oligonucleotide"
uguagcauauuucugugguu

SEQ ID NO: 5940 - RNA, 20 nt, Artificial Sequence
  source: /note="Description of Artificial Sequence: Synthetic oligonucleotide"
guagcauauuucugugguuu

SEQ ID NO: 5941 - RNA, 20 nt, Artificial Sequence
  source: /note="Description of Artificial Sequence: Synthetic oligonucleotide"
cuuuuaaauaucuuuuaauu

SEQ ID NO: 5942 - RNA, 20 nt, Artificial Sequence
  source: /note="Description of Artificial Sequence: Synthetic oligonucleotide"
uaucuuuuaauuuggcuacu

SEQ ID NO: 5943 - RNA, 20 nt, Artificial Sequence
  source: /note="Description of Artificial Sequence: Synthetic oligonucleotide"
auucuuuuucagaauauucc

SEQ ID NO: 5944 - RNA, 20 nt, Artificial Sequence
  source: /note="Description of Artificial Sequence: Synthetic oligonucleotide"
uuauuuuuccaaaugaacuu

SEQ ID NO: 5945 - RNA, 20 nt, Artificial Sequence
  source: /note="Description of Artificial Sequence: Synthetic oligonucleotide"
uuuuaaaguuauauuaaaau

SEQ ID NO: 5946 - RNA, 20 nt, Artificial Sequence
  source: /note="Description of Artificial Sequence: Synthetic oligonucleotide"
auuccaguaaaacuucugac

SEQ ID NO: 5947 - RNA, 20 nt, Artificial Sequence
  source: /note="Description of Artificial Sequence: Synthetic oligonucleotide"
guugaugcucuuauaaauca

SEQ ID NO: 5948 - RNA, 20 nt, Artificial Sequence
  source: /note="Description of Artificial Sequence: Synthetic oligonucleotide"
cauuuuuuacuugauucucu

SEQ ID NO: 5949 - RNA, 20 nt, Artificial Sequence
  source: /note="Description of Artificial Sequence: Synthetic oligonucleotide"
aaauguaaugagaaagacug

SEQ ID NO: 5950 - RNA, 20 nt, Artificial Sequence
  source: /note="Description of Artificial Sequence: Synthetic oligonucleotide"
aauguaaugagaaagacugu

SEQ ID NO: 5951 - RNA, 20 nt, Artificial Sequence
  source: /note="Description of Artificial Sequence: Synthetic oligonucleotide"
aaagcagacaccuuauacaa

SEQ ID NO: 5952 - RNA, 20 nt, Artificial Sequence
  source: /note="Description of Artificial Sequence: Synthetic oligonucleotide"
uuuuuuagugccauuucuuc

SEQ ID NO: 5953 - RNA, 20 nt, Artificial Sequence
  source: /note="Description of Artificial Sequence: Synthetic oligonucleotide"
cuucuggcuuucucuauuau

SEQ ID NO: 5954 - RNA, 20 nt, Artificial Sequence
  source: /note="Description of Artificial Sequence: Synthetic oligonucleotide"
uucuggcuuucucuauuauu

SEQ ID NO: 5955 - RNA, 20 nt, Artificial Sequence
  source: /note="Description of Artificial Sequence: Synthetic oligonucleotide"
aaugaaugcaaucagauuca

SEQ ID NO: 5956 - RNA, 20 nt, Artificial Sequence
  source: /note="Description of Artificial Sequence: Synthetic oligonucleotide"
augaaugcaaucagauucaa

SEQ ID NO: 5957 - RNA, 20 nt, Artificial Sequence
  source: /note="Description of Artificial Sequence: Synthetic oligonucleotide"
agauucaaggguacaagugc

SEQ ID NO: 5958 - RNA, 20 nt, Artificial Sequence
  source: /note="Description of Artificial Sequence: Synthetic oligonucleotide"
gguacaagugcagguuauau

SEQ ID NO: 5959 - RNA, 20 nt, Artificial Sequence
  source: /note="Description of Artificial Sequence: Synthetic oligonucleotide"
uauaggugaauugcaugccu

SEQ ID NO: 5960 - RNA, 20 nt, Artificial Sequence
  source: /note="Description of Artificial Sequence: Synthetic oligonucleotide"
auaggugaauugcaugccuu

SEQ ID NO: 5961 - RNA, 20 nt, Artificial Sequence
  source: /note="Description of Artificial Sequence: Synthetic oligonucleotide"
uaggugaauugcaugccuug

SEQ ID NO: 5962 - RNA, 20 nt, Artificial Sequence
  source: /note="Description of Artificial Sequence: Synthetic oligonucleotide"
aggugaauugcaugccuugg

SEQ ID NO: 5963 - RNA, 20 nt, Artificial Sequence
  source: /note="Description of Artificial Sequence: Synthetic oligonucleotide"
aauugcaugccuuggggguu

SEQ ID NO: 5964 - RNA, 20 nt, Artificial Sequence
  source: /note="Description of Artificial Sequence: Synthetic oligonucleotide"
uacagacuauuuugucaccc

SEQ ID NO: 5965 - RNA, 20 nt, Artificial Sequence
  source: /note="Description of Artificial Sequence: Synthetic oligonucleotide"
uaauaagcguaguacuuaau

SEQ ID NO: 5966 - RNA, 20 nt, Artificial Sequence
  source: /note="Description of Artificial Sequence: Synthetic oligonucleotide"
cugccacuuaagagaacaug

SEQ ID NO: 5967 - RNA, 20 nt, Artificial Sequence
  source: /note="Description of Artificial Sequence: Synthetic oligonucleotide"
guuccuuuguuaguuuguuu

SEQ ID NO: 5968 - RNA, 20 nt, Artificial Sequence
  source: /note="Description of Artificial Sequence: Synthetic oligonucleotide"
uguuaguuuguuuaggauaa

SEQ ID NO: 5969 - RNA, 20 nt, Artificial Sequence
  source: /note="Description of Artificial Sequence: Synthetic oligonucleotide"
cacgauuuuguguuucuuua

SEQ ID NO: 5970 - RNA, 20 nt, Artificial Sequence
  source: /note="Description of Artificial Sequence: Synthetic oligonucleotide"
uauggcuguguaguauucca

SEQ ID NO: 5971 - RNA, 20 nt, Artificial Sequence
  source: /note="Description of Artificial Sequence: Synthetic oligonucleotide"
uuuauccagucuacuacuua

SEQ ID NO: 5972 - RNA, 20 nt, Artificial Sequence
  source: /note="Description of Artificial Sequence: Synthetic oligonucleotide"
ucuacuacuuacggacauuu

SEQ ID NO: 5973 - RNA, 20 nt, Artificial Sequence
  source: /note="Description of Artificial Sequence: Synthetic oligonucleotide"
acgugugcaauaugccuuua

SEQ ID NO: 5974 - RNA, 20 nt, Artificial Sequence
  source: /note="Description of Artificial Sequence: Synthetic oligonucleotide"
uagaaugauuuauaucccuu

SEQ ID NO: 5975 - RNA, 20 nt, Artificial Sequence
  source: /note="Description of Artificial Sequence: Synthetic oligonucleotide"
agaaugauuuauaucccuuu

SEQ ID NO: 5976 - RNA, 20 nt, Artificial Sequence
  source: /note="Description of Artificial Sequence: Synthetic oligonucleotide"
uuggguaauaugccgaauaa

SEQ ID NO: 5977 - RNA, 20 nt, Artificial Sequence
  source: /note="Description of Artificial Sequence: Synthetic oligonucleotide"
uggguaauaugccgaauaau

SEQ ID NO: 5978 - RNA, 20 nt, Artificial Sequence
  source: /note="Description of Artificial Sequence: Synthetic oligonucleotide"
ugccgaauaaugggauugcu

SEQ ID NO: 5979 - RNA, 20 nt, Artificial Sequence
  source: /note="Description of Artificial Sequence: Synthetic oligonucleotide"
aaugggauugcucggucaga

SEQ ID NO: 5980 - RNA, 20 nt, Artificial Sequence
  source: /note="Description of Artificial Sequence: Synthetic oligonucleotide"
uuacauucccacaagcaaua

SEQ ID NO: 5981 - RNA, 20 nt, Artificial Sequence
  source: /note="Description of Artificial Sequence: Synthetic oligonucleotide"
uacauucccacaagcaauaa

SEQ ID NO: 5982 - RNA, 20 nt, Artificial Sequence
  source: /note="Description of Artificial Sequence: Synthetic oligonucleotide"
acauucccacaagcaauaag

SEQ ID NO: 5983 - RNA, 20 nt, Artificial Sequence
  source: /note="Description of Artificial Sequence: Synthetic oligonucleotide"
aaguguucccuuuucucugc

SEQ ID NO: 5984 - RNA, 20 nt, Artificial Sequence
  source: /note="Description of Artificial Sequence: Synthetic oligonucleotide"
uucuuuuagagagucaaaga

SEQ ID NO: 5985 - RNA, 20 nt, Artificial Sequence
  source: /note="Description of Artificial Sequence: Synthetic oligonucleotide"
agagucaaagauggaauccu

SEQ ID NO: 5986 - RNA, 20 nt, Artificial Sequence
  source: /note="Description of Artificial Sequence: Synthetic oligonucleotide"
gagucaaagauggaauccua

SEQ ID NO: 5987 - RNA, 20 nt, Artificial Sequence
  source: /note="Description of Artificial Sequence: Synthetic oligonucleotide"
ccuagggaagaugauaucug

SEQ ID NO: 5988 - RNA, 20 nt, Artificial Sequence
  source: /note="Description of Artificial Sequence: Synthetic oligonucleotide"
gggaagaugauaucugaggc

SEQ ID NO: 5989 - RNA, 20 nt, Artificial Sequence
  source: /note="Description of Artificial Sequence: Synthetic oligonucleotide"
ugaggcagguuuagagucau

SEQ ID NO: 5990 - RNA, 20 nt, Artificial Sequence
  source: /note="Description of Artificial Sequence: Synthetic oligonucleotide"
gaggcagguuuagagucauu

SEQ ID NO: 5991 - RNA, 20 nt, Artificial Sequence
  source: /note="Description of Artificial Sequence: Synthetic oligonucleotide"
uuagagucauugggcaaaua

SEQ ID NO: 5992 - RNA, 20 nt, Artificial Sequence
  source: /note="Description of Artificial Sequence: Synthetic oligonucleotide"
uagagucauugggcaaauaa

SEQ ID NO: 5993 - RNA, 20 nt, Artificial Sequence
  source: /note="Description of Artificial Sequence: Synthetic oligonucleotide"
agagucauugggcaaauaag

SEQ ID NO: 5994 - RNA, 20 nt, Artificial Sequence
  source: /note="Description of Artificial Sequence: Synthetic oligonucleotide"
ggcaaauaaggggauuaaga

SEQ ID NO: 5995 - RNA, 20 nt, Artificial Sequence
  source: /note="Description of Artificial Sequence: Synthetic oligonucleotide"
ggggauuaagaaggcauucu

SEQ ID NO: 5996 - RNA, 20 nt, Artificial Sequence
  source: /note="Description of Artificial Sequence: Synthetic oligonucleotide"
cuaggcagacagaaaaccaa

SEQ ID NO: 5997 - RNA, 20 nt, Artificial Sequence
  source: /note="Description of Artificial Sequence: Synthetic oligonucleotide"
cugaaacagcuuacuauguu

SEQ ID NO: 5998 - RNA, 20 nt, Artificial Sequence
  source: /note="Description of Artificial Sequence: Synthetic oligonucleotide"
uuauaagcuguuguuauugu

SEQ ID NO: 5999 - RNA, 20 nt, Artificial Sequence
  source: /note="Description of Artificial Sequence: Synthetic oligonucleotide"
uauaaacuguaagagagagu

SEQ ID NO: 6000 - RNA, 20 nt, Artificial Sequence
  source: /note="Description of Artificial Sequence: Synthetic oligonucleotide"
aaacuguaagagagaguagg

SEQ ID NO: 6001 - RNA, 20 nt, Artificial Sequence
  source: /note="Description of Artificial Sequence: Synthetic oligonucleotide"
cagaaaaaacagccuguaug

SEQ ID NO: 6002 - RNA, 20 nt, Artificial Sequence
  source: /note="Description of Artificial Sequence: Synthetic oligonucleotide"
agaaaaaacagccuguaugc

SEQ ID NO: 6003 - RNA, 20 nt, Artificial Sequence
  source: /note="Description of Artificial Sequence: Synthetic oligonucleotide"
gaaaaaacagccuguaugcg

SEQ ID NO: 6004 - RNA, 20 nt, Artificial Sequence
  source: /note="Description of Artificial Sequence: Synthetic oligonucleotide"
aaaaaacagccuguaugcgg

SEQ ID NO: 6005 - RNA, 20 nt, Artificial Sequence
  source: /note="Description of Artificial Sequence: Synthetic oligonucleotide"
aaaaacagccuguaugcggg

SEQ ID NO: 6006 - RNA, 20 nt, Artificial Sequence
  source: /note="Description of Artificial Sequence: Synthetic oligonucleotide"
acagaaauucucaaaagauu

SEQ ID NO: 6007 - RNA, 20 nt, Artificial Sequence
  source: /note="Description of Artificial Sequence: Synthetic oligonucleotide"
cagaaauucucaaaagauuu

SEQ ID NO: 6008 - RNA, 20 nt, Artificial Sequence
  source: /note="Description of Artificial Sequence: Synthetic oligonucleotide"
aaacauagaaucaccuagaa

SEQ ID NO: 6009 - RNA, 20 nt, Artificial Sequence
  source: /note="Description of Artificial Sequence: Synthetic oligonucleotide"
aacauagaaucaccuagaaa

SEQ ID NO: 6010 - RNA, 20 nt, Artificial Sequence
  source: /note="Description of Artificial Sequence: Synthetic oligonucleotide"
aucaccccuauucugucacc

SEQ ID NO: 6011 - RNA, 20 nt, Artificial Sequence
  source: /note="Description of Artificial Sequence: Synthetic oligonucleotide"
uggaauauugauaacacuga

SEQ ID NO: 6012 - RNA, 20 nt, Artificial Sequence
  source: /note="Description of Artificial Sequence: Synthetic oligonucleotide"
ggaauauugauaacacugaa

SEQ ID NO: 6013 - RNA, 20 nt, Artificial Sequence
  source: /note="Description of Artificial Sequence: Synthetic oligonucleotide"
gggagugugccuuaucucuc

SEQ ID NO: 6014 - RNA, 20 nt, Artificial Sequence
  source: /note="Description of Artificial Sequence: Synthetic oligonucleotide"
ccuuaucucucagguguauu

SEQ ID NO: 6015 - RNA, 20 nt, Artificial Sequence
  source: /note="Description of Artificial Sequence: Synthetic oligonucleotide"
aaauaguuugagaaccaugc

SEQ ID NO: 6016 - RNA, 20 nt, Artificial Sequence
  source: /note="Description of Artificial Sequence: Synthetic oligonucleotide"
aaucuuccuuuugauaacaa

SEQ ID NO: 6017 - RNA, 20 nt, Artificial Sequence
  source: /note="Description of Artificial Sequence: Synthetic oligonucleotide"
aucuuccuuuugauaacaaa

SEQ ID NO: 6018 - RNA, 20 nt, Artificial Sequence
  source: /note="Description of Artificial Sequence: Synthetic oligonucleotide"
gauaacaaagggaaccuuaa

SEQ ID NO: 6019 - RNA, 20 nt, Artificial Sequence
  source: /note="Description of Artificial Sequence: Synthetic oligonucleotide"
auaacaaagggaaccuuaaa

SEQ ID NO: 6020 - RNA, 20 nt, Artificial Sequence
  source: /note="Description of Artificial Sequence: Synthetic oligonucleotide"
caaagggaaccuuaaagggc

SEQ ID NO: 6021 - RNA, 20 nt, Artificial Sequence
  source: /note="Description of Artificial Sequence: Synthetic oligonucleotide"
agggaaccuuaaagggcugg

SEQ ID NO: 6022 - RNA, 20 nt, Artificial Sequence
  source: /note="Description of Artificial Sequence: Synthetic oligonucleotide"
gggaaccuuaaagggcugga

SEQ ID NO: 6023 - RNA, 20 nt, Artificial Sequence
  source: /note="Description of Artificial Sequence: Synthetic oligonucleotide"
ggaaccuuaaagggcuggag

SEQ ID NO: 6024 - RNA, 20 nt, Artificial Sequence
  source: /note="Description of Artificial Sequence: Synthetic oligonucleotide"
ccuuaaagggcuggagggga

SEQ ID NO: 6025 - RNA, 20 nt, Artificial Sequence
  source: /note="Description of Artificial Sequence: Synthetic oligonucleotide"
cuuaaagggcuggaggggaa

SEQ ID NO: 6026 - RNA, 20 nt, Artificial Sequence
  source: /note="Description of Artificial Sequence: Synthetic oligonucleotide"
ggcuggaggggaagggcaga

SEQ ID NO: 6027 - RNA, 20 nt, Artificial Sequence
  source: /note="Description of Artificial Sequence: Synthetic oligonucleotide"
gcuggaggggaagggcagac

SEQ ID NO: 6028 - RNA, 20 nt, Artificial Sequence
  source: /note="Description of Artificial Sequence: Synthetic oligonucleotide"
cuggaggggaagggcagacg

SEQ ID NO: 6029 - RNA, 20 nt, Artificial Sequence
  source: /note="Description of Artificial Sequence: Synthetic oligonucleotide"
ggggaagggcagacggggcu

SEQ ID NO: 6030 - RNA, 20 nt, Artificial Sequence
  source: /note="Description of Artificial Sequence: Synthetic oligonucleotide"
gggaagggcagacggggcua

SEQ ID NO: 6031 - RNA, 20 nt, Artificial Sequence
  source: /note="Description of Artificial Sequence: Synthetic oligonucleotide"
ggaagggcagacggggcuag

SEQ ID NO: 6032 - RNA, 20 nt, Artificial Sequence
  source: /note="Description of Artificial Sequence: Synthetic oligonucleotide"
agggcagacggggcuagggg

SEQ ID NO: 6033 - RNA, 20 nt, Artificial Sequence
  source: /note="Description of Artificial Sequence: Synthetic oligonucleotide"
cccuuuuaaaaagcuacugc

SEQ ID NO: 6034 - RNA, 20 nt, Artificial Sequence
  source: /note="Description of Artificial Sequence: Synthetic oligonucleotide"
uuuuaaaaagcuacugcagg

SEQ ID NO: 6035 - RNA, 20 nt, Artificial Sequence
  source: /note="Description of Artificial Sequence: Synthetic oligonucleotide"
uuuaaaaagcuacugcaggu

SEQ ID NO: 6036 - RNA, 20 nt, Artificial Sequence
  source: /note="Description of Artificial Sequence: Synthetic oligonucleotide"
uuaaaaagcuacugcaggug

SEQ ID NO: 6037 - RNA, 20 nt, Artificial Sequence
  source: /note="Description of Artificial Sequence: Synthetic oligonucleotide"
aagcuacugcagguggggug

SEQ ID NO: 6038 - RNA, 20 nt, Artificial Sequence
  source: /note="Description of Artificial Sequence: Synthetic oligonucleotide"
cuacugcagguggggugcgg

SEQ ID NO: 6039 - RNA, 20 nt, Artificial Sequence
  source: /note="Description of Artificial Sequence: Synthetic oligonucleotide"
caccuguaaucccagcacuu

SEQ ID NO: 6040 - RNA, 20 nt, Artificial Sequence
  source: /note="Description of Artificial Sequence: Synthetic oligonucleotide"
accuguaaucccagcacuuu

SEQ ID NO: 6041 - RNA, 20 nt, Artificial Sequence
  source: /note="Description of Artificial Sequence: Synthetic oligonucleotide"
uguaaucccagcacuuuggg

SEQ ID NO: 6042 - RNA, 20 nt, Artificial Sequence
  source: /note="Description of Artificial Sequence: Synthetic oligonucleotide"
cccagcacuuugggaggcca

SEQ ID NO: 6043 - RNA, 20 nt, Artificial Sequence
  source: /note="Description of Artificial Sequence: Synthetic oligonucleotide"
gcacuuugggaggccaaggc

SEQ ID NO: 6044 - RNA, 20 nt, Artificial Sequence
  source: /note="Description of Artificial Sequence: Synthetic oligonucleotide"
caaggcaggcagaucaccug

SEQ ID NO: 6045 - RNA, 20 nt, Artificial Sequence
  source: /note="Description of Artificial Sequence: Synthetic oligonucleotide"
caggcagaucaccugagguc

SEQ ID NO: 6046 - RNA, 20 nt, Artificial Sequence
  source: /note="Description of Artificial Sequence: Synthetic oligonucleotide"
ucaggaguucaagaccagcc

SEQ ID NO: 6047 - RNA, 20 nt, Artificial Sequence
  source: /note="Description of Artificial Sequence: Synthetic oligonucleotide"
uaaaaauacaaaaauuagcu

SEQ ID NO: 6048 - RNA, 20 nt, Artificial Sequence
  source: /note="Description of Artificial Sequence: Synthetic oligonucleotide"
auacaaaaauuagcuaggca

SEQ ID NO: 6049 - RNA, 20 nt, Artificial Sequence
  source: /note="Description of Artificial Sequence: Synthetic oligonucleotide"
aauuagcuaggcaugguagc

SEQ ID NO: 6050 - RNA, 20 nt, Artificial Sequence
  source: /note="Description of Artificial Sequence: Synthetic oligonucleotide"
caccuguaaucucagcuacu

SEQ ID NO: 6051 - RNA, 20 nt, Artificial Sequence
  source: /note="Description of Artificial Sequence: Synthetic oligonucleotide"
accuguaaucucagcuacuu

SEQ ID NO: 6052 - RNA, 20 nt, Artificial Sequence
  source: /note="Description of Artificial Sequence: Synthetic oligonucleotide"
uguaaucucagcuacuuggg

SEQ ID NO: 6053 - RNA, 20 nt, Artificial Sequence
  source: /note="Description of Artificial Sequence: Synthetic oligonucleotide"
cucagcuacuugggaggcug

SEQ ID NO: 6054 - RNA, 20 nt, Artificial Sequence
  source: /note="Description of Artificial Sequence: Synthetic oligonucleotide"
gcuacuugggaggcugaggc

SEQ ID NO: 6055 - RNA, 20 nt, Artificial Sequence
  source: /note="Description of Artificial Sequence: Synthetic oligonucleotide"
gcaggagaauugcuugaacc

SEQ ID NO: 6056 - RNA, 20 nt, Artificial Sequence
  source: /note="Description of Artificial Sequence: Synthetic oligonucleotide"
caggagaauugcuugaaccu

SEQ ID NO: 6057 - RNA, 20 nt, Artificial Sequence
  source: /note="Description of Artificial Sequence: Synthetic oligonucleotide"
gagaauugcuugaaccuggg

SEQ ID NO: 6058 - RNA, 20 nt, Artificial Sequence
  source: /note="Description of Artificial Sequence: Synthetic oligonucleotide"
ugcuugaaccugggaggcag

SEQ ID NO: 6059 - RNA, 20 nt, Artificial Sequence
  source: /note="Description of Artificial Sequence: Synthetic oligonucleotide"
ugugccgcugcacuccagcc

SEQ ID NO: 6060 - RNA, 20 nt, Artificial Sequence
  source: /note="Description of Artificial Sequence: Synthetic oligonucleotide"
gugccgcugcacuccagccu

SEQ ID NO: 6061 - RNA, 20 nt, Artificial Sequence
  source: /note="Description of Artificial Sequence: Synthetic oligonucleotide"
aaaagcuacugcaguagauc

SEQ ID NO: 6062 - RNA, 20 nt, Artificial Sequence
  source: /note="Description of Artificial Sequence: Synthetic oligonucleotide"
agcuacugcaguagaucagg

SEQ ID NO: 6063 - RNA, 20 nt, Artificial Sequence
  source: /note="Description of Artificial Sequence: Synthetic oligonucleotide"
uacugcaguagaucaggagg

SEQ ID NO: 6064 - RNA, 20 nt, Artificial Sequence
  source: /note="Description of Artificial Sequence: Synthetic oligonucleotide"
agaagaucugagcuaugaag

SEQ ID NO: 6065 - RNA, 20 nt, Artificial Sequence
  source: /note="Description of Artificial Sequence: Synthetic oligonucleotide"
guggcagucaagaugauuaa

SEQ ID NO: 6066 - RNA, 20 nt, Artificial Sequence
  source: /note="Description of Artificial Sequence: Synthetic oligonucleotide"
agaugauuaaaggaauauau

SEQ ID NO: 6067 - RNA, 20 nt, Artificial Sequence
  source: /note="Description of Artificial Sequence: Synthetic oligonucleotide"
auagaacuuagcaagugauu

SEQ ID NO: 6068 - RNA, 20 nt, Artificial Sequence
  source: /note="Description of Artificial Sequence: Synthetic oligonucleotide"
ugaagugcuagagaaaauaa

SEQ ID NO: 6069 - RNA, 20 nt, Artificial Sequence
  source: /note="Description of Artificial Sequence: Synthetic oligonucleotide"
gaagugcuagagaaaauaaa

SEQ ID NO: 6070 - RNA, 20 nt, Artificial Sequence
  source: /note="Description of Artificial Sequence: Synthetic oligonucleotide"
aagugcuagagaaaauaaag

SEQ ID NO: 6071 - RNA, 20 nt, Artificial Sequence
  source: /note="Description of Artificial Sequence: Synthetic oligonucleotide"
uucaauuguuuuuagcauuu

SEQ ID NO: 6072 - RNA, 20 nt, Artificial Sequence
  source: /note="Description of Artificial Sequence: Synthetic oligonucleotide"
auuuuggcaaaaaauuauuu

SEQ ID NO: 6073 - RNA, 20 nt, Artificial Sequence
  source: /note="Description of Artificial Sequence: Synthetic oligonucleotide"
uaugaacuucccacauuagc

SEQ ID NO: 6074 - RNA, 20 nt, Artificial Sequence
  source: /note="Description of Artificial Sequence: Synthetic oligonucleotide"
aauaucaguuugcuaugucu

SEQ ID NO: 6075 - RNA, 20 nt, Artificial Sequence
  source: /note="Description of Artificial Sequence: Synthetic oligonucleotide"
agagagauuaccauuacauu

SEQ ID NO: 6076 - RNA, 20 nt, Artificial Sequence
  source: /note="Description of Artificial Sequence: Synthetic oligonucleotide"
guaacuugaaguugaaguuu

SEQ ID NO: 6077 - RNA, 20 nt, Artificial Sequence
  source: /note="Description of Artificial Sequence: Synthetic oligonucleotide"
gguaacuugaaguugaaguu

SEQ ID NO: 6078 - RNA, 20 nt, Artificial Sequence
  source: /note="Description of Artificial Sequence: Synthetic oligonucleotide"
aaaguauuugagagggugca

SEQ ID NO: 6079 - RNA, 20 nt, Artificial Sequence
  source: /note="Description of Artificial Sequence: Synthetic oligonucleotide"
aaaaguauuugagagggugc

SEQ ID NO: 6080 - RNA, 20 nt, Artificial Sequence
  source: /note="Description of Artificial Sequence: Synthetic oligonucleotide"
auaaagaaaaguauuugaga

SEQ ID NO: 6081 - RNA, 20 nt, Artificial Sequence
  source: /note="Description of Artificial Sequence: Synthetic oligonucleotide"
aauaaagaaaaguauuugag

SEQ ID NO: 6082 - RNA, 20 nt, Artificial Sequence
  source: /note="Description of Artificial Sequence: Synthetic oligonucleotide"
gcgauaaauacucuaacaac

SEQ ID NO: 6083 - RNA, 20 nt, Artificial Sequence
  source: /note="Description of Artificial Sequence: Synthetic oligonucleotide"
cuacaagugaagcaaaaugg

SEQ ID NO: 6084 - RNA, 20 nt, Artificial Sequence
  source: /note="Description of Artificial Sequence: Synthetic oligonucleotide"
uggcuacaagugaagcaaaa

SEQ ID NO: 6085 - RNA, 20 nt, Artificial Sequence
  source: /note="Description of Artificial Sequence: Synthetic oligonucleotide"
uuaacaagauugagacgaag

SEQ ID NO: 6086 - RNA, 20 nt, Artificial Sequence
  source: /note="Description of Artificial Sequence: Synthetic oligonucleotide"
aaccacaaauaccauuuauu

SEQ ID NO: 6087 - RNA, 20 nt, Artificial Sequence
  source: /note="Description of Artificial Sequence: Synthetic oligonucleotide"
acugacuagccaggugcagg

SEQ ID NO: 6088 - RNA, 20 nt, Artificial Sequence
  source: /note="Description of Artificial Sequence: Synthetic oligonucleotide"
aagacugacuagccaggugc

SEQ ID NO: 6089 - RNA, 20 nt, Artificial Sequence
  source: /note="Description of Artificial Sequence: Synthetic oligonucleotide"
ugucacaagacugacuagcc

SEQ ID NO: 6090 - RNA, 20 nt, Artificial Sequence
  source: /note="Description of Artificial Sequence: Synthetic oligonucleotide"
uuaguucucugcuaguucua

SEQ ID NO: 6091 - RNA, 20 nt, Artificial Sequence
  source: /note="Description of Artificial Sequence: Synthetic oligonucleotide"
guccucaaagucucgucgga

SEQ ID NO: 6092 - RNA, 20 nt, Artificial Sequence
  source: /note="Description of Artificial Sequence: Synthetic oligonucleotide"
gguccucaaagucucgucgg

SEQ ID NO: 6093 - RNA, 20 nt, Artificial Sequence
  source: /note="Description of Artificial Sequence: Synthetic oligonucleotide"
guccuacuaccgaacuuggg

SEQ ID NO: 6094 - RNA, 20 nt, Artificial Sequence
  source: /note="Description of Artificial Sequence: Synthetic oligonucleotide"
uucuccgauuccguccuacu

SEQ ID NO: 6095 - RNA, 20 nt, Artificial Sequence
  source: /note="Description of Artificial Sequence: Synthetic oligonucleotide"
cgaggaauucuccgauuccg

SEQ ID NO: 6096 - RNA, 20 nt, Artificial Sequence
  source: /note="Description of Artificial Sequence: Synthetic oligonucleotide"
gggucgaggaauucuccgau

SEQ ID NO: 6097 - RNA, 20 nt, Artificial Sequence
  source: /note="Description of Artificial Sequence: Synthetic oligonucleotide"
acauuagggucgaggaauuc

SEQ ID NO: 6098 - RNA, 20 nt, Artificial Sequence
  source: /note="Description of Artificial Sequence: Synthetic oligonucleotide"
aucauaugaagacccggacc

SEQ ID NO: 6099 - RNA, 20 nt, Artificial Sequence
  source: /note="Description of Artificial Sequence: Synthetic oligonucleotide"
aaucauaugaagacccggac

SEQ ID NO: 6100 - RNA, 20 nt, Artificial Sequence
  source: /note="Description of Artificial Sequence: Synthetic oligonucleotide"
aaaucauaugaagacccgga

SEQ ID NO: 6101 - RNA, 20 nt, Artificial Sequence
  source: /note="Description of Artificial Sequence: Synthetic oligonucleotide"
aaaaucauaugaagacccgg

SEQ ID NO: 6102 - RNA, 20 nt, Artificial Sequence
  source: /note="Description of Artificial Sequence: Synthetic oligonucleotide"
uucagaaaaucauaugaaga

SEQ ID NO: 6103 - RNA, 20 nt, Artificial Sequence
  source: /note="Description of Artificial Sequence: Synthetic oligonucleotide"
uuucagaaaaucauaugaag

SEQ ID NO: 6104 - RNA, 20 nt, Artificial Sequence
  source: /note="Description of Artificial Sequence: Synthetic oligonucleotide"
uugggacacucagcagguca

SEQ ID NO: 6105 - RNA, 20 nt, Artificial Sequence
  source: /note="Description of Artificial Sequence: Synthetic oligonucleotide"
cuuagguugggacacucagc

SEQ ID NO: 6106 - RNA, 20 nt, Artificial Sequence
  source: /note="Description of Artificial Sequence: Synthetic oligonucleotide"
ggucugacaacccuuagguu

SEQ ID NO: 6107 - RNA, 20 nt, Artificial Sequence
  source: /note="Description of Artificial Sequence: Synthetic oligonucleotide"
uggucugacaacccuuaggu

SEQ ID NO: 6108 - RNA, 20 nt, Artificial Sequence
  source: /note="Description of Artificial Sequence: Synthetic oligonucleotide"
aaaauggucugacaacccuu

SEQ ID NO: 6109 - RNA, 20 nt, Artificial Sequence
  source: /note="Description of Artificial Sequence: Synthetic oligonucleotide"
uacaugcauauaugagaaaa

SEQ ID NO: 6110 - RNA, 20 nt, Artificial Sequence
  source: /note="Description of Artificial Sequence: Synthetic oligonucleotide"
uuaacugucuuauauaguuc

SEQ ID NO: 6111 - RNA, 20 nt, Artificial Sequence
  source: /note="Description of Artificial Sequence: Synthetic oligonucleotide"
aagcugaauuaccuacuaaa

SEQ ID NO: 6112 - RNA, 20 nt, Artificial Sequence
  source: /note="Description of Artificial Sequence: Synthetic oligonucleotide"
ggcagagauuagagcuauac

SEQ ID NO: 6113 - RNA, 20 nt, Artificial Sequence
  source: /note="Description of Artificial Sequence: Synthetic oligonucleotide"
auccucaggugucugcagua

SEQ ID NO: 6114 - RNA, 20 nt, Artificial Sequence
  source: /note="Description of Artificial Sequence: Synthetic oligonucleotide"
gaguggauacuuauauccuc

SEQ ID NO: 6115 - RNA, 20 nt, Artificial Sequence
  source: /note="Description of Artificial Sequence: Synthetic oligonucleotide"
agaaguaucaaguggcagag

SEQ ID NO: 6116 - RNA, 20 nt, Artificial Sequence
  source: /note="Description of Artificial Sequence: Synthetic oligonucleotide"
agucucugagaaguaucaag

SEQ ID NO: 6117 - RNA, 20 nt, Artificial Sequence
  source: /note="Description of Artificial Sequence: Synthetic oligonucleotide"
caacugaggacacacuggaa

SEQ ID NO: 6118 - RNA, 20 nt, Artificial Sequence
  source: /note="Description of Artificial Sequence: Synthetic oligonucleotide"
gaguucaacugaggacacac

SEQ ID NO: 6119 - RNA, 20 nt, Artificial Sequence
  source: /note="Description of Artificial Sequence: Synthetic oligonucleotide"
gaaucaugggaguucaacug

SEQ ID NO: 6120 - RNA, 20 nt, Artificial Sequence
  source: /note="Description of Artificial Sequence: Synthetic oligonucleotide"
uggcaacauccaggaaucau

SEQ ID NO: 6121 - RNA, 20 nt, Artificial Sequence
  source: /note="Description of Artificial Sequence: Synthetic oligonucleotide"
auggcaacauccaggaauca

SEQ ID NO: 6122 - RNA, 20 nt, Artificial Sequence
  source: /note="Description of Artificial Sequence: Synthetic oligonucleotide"
ucuugaaaauggcaacaucc

SEQ ID NO: 6123 - RNA, 20 nt, Artificial Sequence
  source: /note="Description of Artificial Sequence: Synthetic oligonucleotide"
cuugcccugugucuugaaaa

SEQ ID NO: 6124 - RNA, 20 nt, Artificial Sequence
  source: /note="Description of Artificial Sequence: Synthetic oligonucleotide"
uuaaaauucccaagguagag

SEQ ID NO: 6125 - RNA, 20 nt, Artificial Sequence
  source: /note="Description of Artificial Sequence: Synthetic oligonucleotide"
agagugacuuaaaauuccca

SEQ ID NO: 6126 - RNA, 20 nt, Artificial Sequence
  source: /note="Description of Artificial Sequence: Synthetic oligonucleotide"
uaaaaauauuaacaugcaag

SEQ ID NO: 6127 - RNA, 20 nt, Artificial Sequence
  source: /note="Description of Artificial Sequence: Synthetic oligonucleotide"
cuaaaaauauuaacaugcaa

SEQ ID NO: 6128 - RNA, 20 nt, Artificial Sequence
  source: /note="Description of Artificial Sequence: Synthetic oligonucleotide"
ucuaaaaauauuaacaugca

SEQ ID NO: 6129 - RNA, 20 nt, Artificial Sequence
  source: /note="Description of Artificial Sequence: Synthetic oligonucleotide"
uccagcaugagaggggaaag

SEQ ID NO: 6130 - RNA, 20 nt, Artificial Sequence
  source: /note="Description of Artificial Sequence: Synthetic oligonucleotide"
aagauuuuccagcaugagag

SEQ ID NO: 6131 - RNA, 20 nt, Artificial Sequence
  source: /note="Description of Artificial Sequence: Synthetic oligonucleotide"
uaagauuuuccagcaugaga

SEQ ID NO: 6132 - RNA, 20 nt, Artificial Sequence
  source: /note="Description of Artificial Sequence: Synthetic oligonucleotide"
cuaagauuuuccagcaugag

SEQ ID NO: 6133 - RNA, 20 nt, Artificial Sequence
  source: /note="Description of Artificial Sequence: Synthetic oligonucleotide"
agcaaucaucaagggaggag

SEQ ID NO: 6134 - RNA, 20 nt, Artificial Sequence
  source: /note="Description of Artificial Sequence: Synthetic oligonucleotide"
aagcaaucaucaagggagga

SEQ ID NO: 6135 - RNA, 20 nt, Artificial Sequence
  source: /note="Description of Artificial Sequence: Synthetic oligonucleotide"
aaagcaaucaucaagggagg

SEQ ID NO: 6136 - RNA, 20 nt, Artificial Sequence
  source: /note="Description of Artificial Sequence: Synthetic oligonucleotide"
gguaaagcaaucaucaaggg

SEQ ID NO: 6137 - RNA, 20 nt, Artificial Sequence
  source: /note="Description of Artificial Sequence: Synthetic oligonucleotide"
ugagguaaagcaaucaucaa

SEQ ID NO: 6138 - RNA, 20 nt, Artificial Sequence
  source: /note="Description of Artificial Sequence: Synthetic oligonucleotide"
gugagguaaagcaaucauca

SEQ ID NO: 6139 - RNA, 20 nt, Artificial Sequence
  source: /note="Description of Artificial Sequence: Synthetic oligonucleotide"
gucacaguucucacagagug

SEQ ID NO: 6140 - RNA, 20 nt, Artificial Sequence
  source: /note="Description of Artificial Sequence: Synthetic oligonucleotide"
auguuaugacuucauuaagg

SEQ ID NO: 6141 - RNA, 20 nt, Artificial Sequence
  source: /note="Description of Artificial Sequence: Synthetic oligonucleotide"
cuaauguuaugacuucauua

SEQ ID NO: 6142 - RNA, 20 nt, Artificial Sequence
  source: /note="Description of Artificial Sequence: Synthetic oligonucleotide"
cugcacuuuauuccuuaccc

SEQ ID NO: 6143 - RNA, 20 nt, Artificial Sequence
  source: /note="Description of Artificial Sequence: Synthetic oligonucleotide"
uguaaaaccuuuucccucaa

SEQ ID NO: 6144 - RNA, 20 nt, Artificial Sequence
  source: /note="Description of Artificial Sequence: Synthetic oligonucleotide"
agauuuuugaggagauauga

SEQ ID NO: 6145 - RNA, 20 nt, Artificial Sequence
  source: /note="Description of Artificial Sequence: Synthetic oligonucleotide"
aagauuuuugaggagauaug

SEQ ID NO: 6146 - RNA, 20 nt, Artificial Sequence
  source: /note="Description of Artificial Sequence: Synthetic oligonucleotide"
aaugcaaaacaagauuuuug

SEQ ID NO: 6147 - RNA, 20 nt, Artificial Sequence
  source: /note="Description of Artificial Sequence: Synthetic oligonucleotide"
ugcuauugaaaauaugucaa

SEQ ID NO: 6148 - RNA, 20 nt, Artificial Sequence
  source: /note="Description of Artificial Sequence: Synthetic oligonucleotide"
uugcuauugaaaauauguca

SEQ ID NO: 6149 - RNA, 20 nt, Artificial Sequence
  source: /note="Description of Artificial Sequence: Synthetic oligonucleotide"
uacuacuaaaaauaaacucu

SEQ ID NO: 6150 - RNA, 20 nt, Artificial Sequence
  source: /note="Description of Artificial Sequence: Synthetic oligonucleotide"
uaaauuucgucccgaauguc

SEQ ID NO: 6151 - RNA, 20 nt, Artificial Sequence
  source: /note="Description of Artificial Sequence: Synthetic oligonucleotide"
gaagaaacgguaaauuucgu

SEQ ID NO: 6152 - RNA, 20 nt, Artificial Sequence
  source: /note="Description of Artificial Sequence: Synthetic oligonucleotide"
agaagaaacgguaaauuucg

SEQ ID NO: 6153 - RNA, 20 nt, Artificial Sequence
  source: /note="Description of Artificial Sequence: Synthetic oligonucleotide"
gauauacaacccguuacaug

SEQ ID NO: 6154 - RNA, 20 nt, Artificial Sequence
  source: /note="Description of Artificial Sequence: Synthetic oligonucleotide"
aacucuugaaugauauacaa

SEQ ID NO: 6155 - RNA, 20 nt, Artificial Sequence
  source: /note="Description of Artificial Sequence: Synthetic oligonucleotide"
uaacucuugaaugauauaca

SEQ ID NO: 6156 - RNA, 20 nt, Artificial Sequence
  source: /note="Description of Artificial Sequence: Synthetic oligonucleotide"
aaaagcaacauuaauaaaag

SEQ ID NO: 6157 - RNA, 20 nt, Artificial Sequence
  source: /note="Description of Artificial Sequence: Synthetic oligonucleotide"
uucucacggaccauaaaccg

SEQ ID NO: 6158 - RNA, 20 nt, Artificial Sequence
  source: /note="Description of Artificial Sequence: Synthetic oligonucleotide"
gaucuucucacggaccauaa

SEQ ID NO: 6159 - RNA, 20 nt, Artificial Sequence
  source: /note="Description of Artificial Sequence: Synthetic oligonucleotide"
gaucaaggaucuucucacgg

SEQ ID NO: 6160 - RNA, 20 nt, Artificial Sequence
  source: /note="Description of Artificial Sequence: Synthetic oligonucleotide"
uaccuaagauucgaguuguu

SEQ ID NO: 6161 - RNA, 20 nt, Artificial Sequence
  source: /note="Description of Artificial Sequence: Synthetic oligonucleotide"
uuaccuaagauucgaguugu

SEQ ID NO: 6162 - RNA, 20 nt, Artificial Sequence
  source: /note="Description of Artificial Sequence: Synthetic oligonucleotide"
cacagacagagaaugagauu

SEQ ID NO: 6163 - RNA, 20 nt, Artificial Sequence
  source: /note="Description of Artificial Sequence: Synthetic oligonucleotide"
aaaauuuugaaucgugaaga

SEQ ID NO: 6164 - RNA, 20 nt, Artificial Sequence
  source: /note="Description of Artificial Sequence: Synthetic oligonucleotide"
uuaaggaagucuauugaagu

SEQ ID NO: 6165 - RNA, 20 nt, Artificial Sequence
  source: /note="Description of Artificial Sequence: Synthetic oligonucleotide"
uuuuagaugagguccagaaa

SEQ ID NO: 6166 - RNA, 20 nt, Artificial Sequence
  source: /note="Description of Artificial Sequence: Synthetic oligonucleotide"
auaaaaccuuuuagaugagg

SEQ ID NO: 6167 - RNA, 20 nt, Artificial Sequence
  source: /note="Description of Artificial Sequence: Synthetic oligonucleotide"
cuccucuguuauaguccaga

SEQ ID NO: 6168 - RNA, 20 nt, Artificial Sequence
  source: /note="Description of Artificial Sequence: Synthetic oligonucleotide"
cuuccuguccuucaggaucc

SEQ ID NO: 6169 - RNA, 20 nt, Artificial Sequence
  source: /note="Description of Artificial Sequence: Synthetic oligonucleotide"
cccaauucuuccuguccuuc

SEQ ID NO: 6170 - RNA, 20 nt, Artificial Sequence
  source: /note="Description of Artificial Sequence: Synthetic oligonucleotide"
ccccuccacuucucuccacu

SEQ ID NO: 6171 - RNA, 20 nt, Artificial Sequence
  source: /note="Description of Artificial Sequence: Synthetic oligonucleotide"
uccccuccacuucucuccac

SEQ ID NO: 6172 - RNA, 20 nt, Artificial Sequence
  source: /note="Description of Artificial Sequence: Synthetic oligonucleotide"
cuggcccauuccugcccuaa

SEQ ID NO: 6173 - RNA, 20 nt, Artificial Sequence
  source: /note="Description of Artificial Sequence: Synthetic oligonucleotide"
cuucccacuugcccucugcc

SEQ ID NO: 6174 - RNA, 20 nt, Artificial Sequence
  source: /note="Description of Artificial Sequence: Synthetic oligonucleotide"
gccaacaugaacuuuauaca

SEQ ID NO: 6175 - RNA, 20 nt, Artificial Sequence
  source: /note="Description of Artificial Sequence: Synthetic oligonucleotide"
cuuuaggauuuuacuaaauu

SEQ ID NO: 6176 - RNA, 20 nt, Artificial Sequence
  source: /note="Description of Artificial Sequence: Synthetic oligonucleotide"
auaaucuuuagcuugacuuu

SEQ ID NO: 6177 - RNA, 20 nt, Artificial Sequence
  source: /note="Description of Artificial Sequence: Synthetic oligonucleotide"
aauuauuccccaauauuuuc

SEQ ID NO: 6178 - RNA, 20 nt, Artificial Sequence
  source: /note="Description of Artificial Sequence: Synthetic oligonucleotide"
uguacuauguuaguauuaca

SEQ ID NO: 6179 - RNA, 20 nt, Artificial Sequence
  source: /note="Description of Artificial Sequence: Synthetic oligonucleotide"
uauuauaaaaauacaaaauu

SEQ ID NO: 6180 - RNA, 20 nt, Artificial Sequence
  source: /note="Description of Artificial Sequence: Synthetic oligonucleotide"
aaccugaucgacuacagauu

SEQ ID NO: 6181 - RNA, 20 nt, Artificial Sequence
  source: /note="Description of Artificial Sequence: Synthetic oligonucleotide"
gaagguguuuuacuugauua

SEQ ID NO: 6182 - RNA, 20 nt, Artificial Sequence
  source: /note="Description of Artificial Sequence: Synthetic oligonucleotide"
auuucaguacauuguagaga

SEQ ID NO: 6183 - RNA, 20 nt, Artificial Sequence
  source: /note="Description of Artificial Sequence: Synthetic oligonucleotide"
uauuucaguacauuguagag

SEQ ID NO: 6184 - RNA, 20 nt, Artificial Sequence
  source: /note="Description of Artificial Sequence: Synthetic oligonucleotide"
aaucuaugaucgaucuccgu

SEQ ID NO: 6185 - RNA, 20 nt, Artificial Sequence
  source: /note="Description of Artificial Sequence: Synthetic oligonucleotide"
gguucaaucuaugaucgauc

SEQ ID NO: 6186 - RNA, 20 nt, Artificial Sequence
  source: /note="Description of Artificial Sequence: Synthetic oligonucleotide"
gagucucaguauccucugga

SEQ ID NO: 6187 - RNA, 20 nt, Artificial Sequence
  source: /note="Description of Artificial Sequence: Synthetic oligonucleotide"
agagucucaguauccucugg

SEQ ID NO: 6188 - RNA, 20 nt, Artificial Sequence
  source: /note="Description of Artificial Sequence: Synthetic oligonucleotide"
gcaggaggagagucucagua

SEQ ID NO: 6189 - RNA, 20 nt, Artificial Sequence
  source: /note="Description of Artificial Sequence: Synthetic oligonucleotide"
auuauuuuuuuauuagcagg

SEQ ID NO: 6190 - RNA, 20 nt, Artificial Sequence
  source: /note="Description of Artificial Sequence: Synthetic oligonucleotide"
uuuauuauuuuuuuauuagc

SEQ ID NO: 6191 - RNA, 20 nt, Artificial Sequence
  source: /note="Description of Artificial Sequence: Synthetic oligonucleotide"
ggcuacaagagagugcuaac

SEQ ID NO: 6192 - RNA, 20 nt, Artificial Sequence
  source: /note="Description of Artificial Sequence: Synthetic oligonucleotide"
guguauguuaauuagaaaaa

SEQ ID NO: 6193 - RNA, 20 nt, Artificial Sequence
  source: /note="Description of Artificial Sequence: Synthetic oligonucleotide"
uagaucuguuucaugagaaa

SEQ ID NO: 6194 - RNA, 20 nt, Artificial Sequence
  source: /note="Description of Artificial Sequence: Synthetic oligonucleotide"
uuagaucuguuucaugagaa

SEQ ID NO: 6195 - RNA, 20 nt, Artificial Sequence
  source: /note="Description of Artificial Sequence: Synthetic oligonucleotide"
cuucaacaaugacuaaaggu

SEQ ID NO: 6196 - RNA, 20 nt, Artificial Sequence
  source: /note="Description of Artificial Sequence: Synthetic oligonucleotide"
acuucaacaaugacuaaagg

SEQ ID NO: 6197 - RNA, 20 nt, Artificial Sequence
  source: /note="Description of Artificial Sequence: Synthetic oligonucleotide"
gaaacuucaacaaugacuaa

SEQ ID NO: 6198 - RNA, 20 nt, Artificial Sequence
  source: /note="Description of Artificial Sequence: Synthetic oligonucleotide"
aaaagauaacauuguaaauc

SEQ ID NO: 6199 - RNA, 20 nt, Artificial Sequence
  source: /note="Description of Artificial Sequence: Synthetic oligonucleotide"
cuguagggugaugguuuuuu

SEQ ID NO: 6200 - RNA, 20 nt, Artificial Sequence
  source: /note="Description of Artificial Sequence: Synthetic oligonucleotide"
ccuguagggugaugguuuuu

SEQ ID NO: 6201 - RNA, 20 nt, Artificial Sequence
  source: /note="Description of Artificial Sequence: Synthetic oligonucleotide"
auuuauuuccuguaggguga

SEQ ID NO: 6202 - RNA, 20 nt, Artificial Sequence
  source: /note="Description of Artificial Sequence: Synthetic oligonucleotide"
agugugauuuauuuccugua

SEQ ID NO: 6203 - RNA, 20 nt, Artificial Sequence
  source: /note="Description of Artificial Sequence: Synthetic oligonucleotide"
gagugugauuuauuuccugu

SEQ ID NO: 6204 - RNA, 20 nt, Artificial Sequence
  source: /note="Description of Artificial Sequence: Synthetic oligonucleotide"
gagaaaucaguagccagauc

SEQ ID NO: 6205 - RNA, 20 nt, Artificial Sequence
  source: /note="Description of Artificial Sequence: Synthetic oligonucleotide"
aagucuuaaagucuaaguau

SEQ ID NO: 6206 - RNA, 20 nt, Artificial Sequence
  source: /note="Description of Artificial Sequence: Synthetic oligonucleotide"
guucauaagaaugaccugua

SEQ ID NO: 6207 - RNA, 20 nt, Artificial Sequence
  source: /note="Description of Artificial Sequence: Synthetic oligonucleotide"
gcuugcuagaacaaugacua

SEQ ID NO: 6208 - RNA, 20 nt, Artificial Sequence
  source: /note="Description of Artificial Sequence: Synthetic oligonucleotide"
acucaaagaauaaacugcuc

SEQ ID NO: 6209 - RNA, 20 nt, Artificial Sequence
  source: /note="Description of Artificial Sequence: Synthetic oligonucleotide"
gcacuguauuaugaucucua

SEQ ID NO: 6210 - RNA, 20 nt, Artificial Sequence
  source: /note="Description of Artificial Sequence: Synthetic oligonucleotide"
uacaugucugcucacuugcu

SEQ ID NO: 6211 - RNA, 20 nt, Artificial Sequence
  source: /note="Description of Artificial Sequence: Synthetic oligonucleotide"
auaccauguggcauguguaa

SEQ ID NO: 6212 - RNA, 20 nt, Artificial Sequence
  source: /note="Description of Artificial Sequence: Synthetic oligonucleotide"
augacuuguaucauaccaug

SEQ ID NO: 6213 - RNA, 20 nt, Artificial Sequence
  source: /note="Description of Artificial Sequence: Synthetic oligonucleotide"
caagacaccauguauaagag

SEQ ID NO: 6214 - RNA, 20 nt, Artificial Sequence
  source: /note="Description of Artificial Sequence: Synthetic oligonucleotide"
gagacuacugauaccacucu

SEQ ID NO: 6215 - RNA, 20 nt, Artificial Sequence
  source: /note="Description of Artificial Sequence: Synthetic oligonucleotide"
agagacuacugauaccacuc

SEQ ID NO: 6216 - RNA, 20 nt, Artificial Sequence
  source: /note="Description of Artificial Sequence: Synthetic oligonucleotide"
gauguuuaauucagucucuu

SEQ ID NO: 6217 - RNA, 20 nt, Artificial Sequence
  source: /note="Description of Artificial Sequence: Synthetic oligonucleotide"
agauguuuaauucagucucu

SEQ ID NO: 6218 - RNA, 20 nt, Artificial Sequence
  source: /note="Description of Artificial Sequence: Synthetic oligonucleotide"
cagucuauuuacgguguucu

SEQ ID NO: 6219 - RNA, 20 nt, Artificial Sequence
  source: /note="Description of Artificial Sequence: Synthetic oligonucleotide"
acacuuaaaucccuaacggu

SEQ ID NO: 6220 - RNA, 20 nt, Artificial Sequence
  source: /note="Description of Artificial Sequence: Synthetic oligonucleotide"
augucgauaaacacuuaaau

SEQ ID NO: 6221 - RNA, 20 nt, Artificial Sequence
  source: /note="Description of Artificial Sequence: Synthetic oligonucleotide"
uaugucgauaaacacuuaaa

SEQ ID NO: 6222 - RNA, 20 nt, Artificial Sequence
  source: /note="Description of Artificial Sequence: Synthetic oligonucleotide"
aucaaaggacacaucauaug

SEQ ID NO: 6223 - RNA, 20 nt, Artificial Sequence
  source: /note="Description of Artificial Sequence: Synthetic oligonucleotide"
uuuacuuguucuaaaaucaa

SEQ ID NO: 6224 - RNA, 20 nt, Artificial Sequence
  source: /note="Description of Artificial Sequence: Synthetic oligonucleotide"
aucacuuuuacugaaaguau

SEQ ID NO: 6225 - RNA, 20 nt, Artificial Sequence
  source: /note="Description of Artificial Sequence: Synthetic oligonucleotide"
acuauaaaguggaaaacuac

SEQ ID NO: 6226 - RNA, 20 nt, Artificial Sequence
  source: /note="Description of Artificial Sequence: Synthetic oligonucleotide"
uuucuaggacucuaguuguc

SEQ ID NO: 6227 - RNA, 20 nt, Artificial Sequence
  source: /note="Description of Artificial Sequence: Synthetic oligonucleotide"
cacauuuugagaaaaauguc

SEQ ID NO: 6228 - RNA, 20 nt, Artificial Sequence
  source: /note="Description of Artificial Sequence: Synthetic oligonucleotide"
guuagagggugucuaugacu

SEQ ID NO: 6229 - RNA, 20 nt, Artificial Sequence
  source: /note="Description of Artificial Sequence: Synthetic oligonucleotide"
aacuauagguaccccccagg

SEQ ID NO: 6230 - RNA, 20 nt, Artificial Sequence
  source: /note="Description of Artificial Sequence: Synthetic oligonucleotide"
gucuaaaacuauagguaccc

SEQ ID NO: 6231 - RNA, 20 nt, Artificial Sequence
  source: /note="Description of Artificial Sequence: Synthetic oligonucleotide"
ugucuaaaacuauagguacc

SEQ ID NO: 6232 - RNA, 20 nt, Artificial Sequence
  source: /note="Description of Artificial Sequence: Synthetic oligonucleotide"
gugucuaaaacuauagguac

SEQ ID NO: 6233 - RNA, 20 nt, Artificial Sequence
  source: /note="Description of Artificial Sequence: Synthetic oligonucleotide"
ggugucuaaaacuauaggua

SEQ ID NO: 6234 - RNA, 20 nt, Artificial Sequence
  source: /note="Description of Artificial Sequence: Synthetic oligonucleotide"
aggugucuaaaacuauaggu

SEQ ID NO: 6235 - RNA, 20 nt, Artificial Sequence
  source: /note="Description of Artificial Sequence: Synthetic oligonucleotide"
auaaaauauauucucugaac

SEQ ID NO: 6236 - RNA, 20 nt, Artificial Sequence
  source: /note="Description of Artificial Sequence: Synthetic oligonucleotide"
uacuaagcuucauauacccu

SEQ ID NO: 6237 - RNA, 20 nt, Artificial Sequence
  source: /note="Description of Artificial Sequence: Synthetic oligonucleotide"
cuacuaagcuucauauaccc

SEQ ID NO: 6238 - RNA, 20 nt, Artificial Sequence
  source: /note="Description of Artificial Sequence: Synthetic oligonucleotide"
ucucuacuaagcuucauaua

SEQ ID NO: 6239 - RNA, 20 nt, Artificial Sequence
  source: /note="Description of Artificial Sequence: Synthetic oligonucleotide"
cucucuacuaagcuucauau

SEQ ID NO: 6240 - RNA, 20 nt, Artificial Sequence
  source: /note="Description of Artificial Sequence: Synthetic oligonucleotide"
auuauugaugaauguaucgu

SEQ ID NO: 6241 - RNA, 20 nt, Artificial Sequence
  source: /note="Description of Artificial Sequence: Synthetic oligonucleotide"
guuuuaugagucuuuuuuuu

SEQ ID NO: 6242 - RNA, 20 nt, Artificial Sequence
  source: /note="Description of Artificial Sequence: Synthetic oligonucleotide"
aaguaccuaaggucguagac

SEQ ID NO: 6243 - RNA, 20 nt, Artificial Sequence
  source: /note="Description of Artificial Sequence: Synthetic oligonucleotide"
gucgggggguacccauaagu

SEQ ID NO: 6244 - RNA, 20 nt, Artificial Sequence
  source: /note="Description of Artificial Sequence: Synthetic oligonucleotide"
cauuauucagucggggggua

SEQ ID NO: 6245 - RNA, 20 nt, Artificial Sequence
  source: /note="Description of Artificial Sequence: Synthetic oligonucleotide"
acauuauucagucggggggu

SEQ ID NO: 6246 - RNA, 20 nt, Artificial Sequence
  source: /note="Description of Artificial Sequence: Synthetic oligonucleotide"
ucaaggacuauacguguccu

SEQ ID NO: 6247 - RNA, 20 nt, Artificial Sequence
  source: /note="Description of Artificial Sequence: Synthetic oligonucleotide"
aagacuccuaccaagauuca

SEQ ID NO: 6248 - RNA, 20 nt, Artificial Sequence
  source: /note="Description of Artificial Sequence: Synthetic oligonucleotide"
gagucaagaucuugagaaga

SEQ ID NO: 6249 - RNA, 20 nt, Artificial Sequence
  source: /note="Description of Artificial Sequence: Synthetic oligonucleotide"
gcacguguacaagugggggu

SEQ ID NO: 6250 - RNA, 20 nt, Artificial Sequence
  source: /note="Description of Artificial Sequence: Synthetic oligonucleotide"
augugcacguguacaagugg

SEQ ID NO: 6251 - RNA, 20 nt, Artificial Sequence
  source: /note="Description of Artificial Sequence: Synthetic oligonucleotide"
uaugugcacguguacaagug

SEQ ID NO: 6252 - RNA, 20 nt, Artificial Sequence
  source: /note="Description of Artificial Sequence: Synthetic oligonucleotide"
guaugugcacguguacaagu

SEQ ID NO: 6253 - RNA, 20 nt, Artificial Sequence
  source: /note="Description of Artificial Sequence: Synthetic oligonucleotide"
aguaugugcacguguacaag

SEQ ID NO: 6254 - RNA, 20 nt, Artificial Sequence
  source: /note="Description of Artificial Sequence: Synthetic oligonucleotide"
ccacucguccugaauuccuu

SEQ ID NO: 6255 - RNA, 20 nt, Artificial Sequence
  source: /note="Description of Artificial Sequence: Synthetic oligonucleotide"
accacucguccugaauuccu

SEQ ID NO: 6256 - RNA, 20 nt, Artificial Sequence
  source: /note="Description of Artificial Sequence: Synthetic oligonucleotide"
uucgaccacucguccugaau

SEQ ID NO: 6257 - RNA, 20 nt, Artificial Sequence
  source: /note="Description of Artificial Sequence: Synthetic oligonucleotide"
auccuucguucgaccacucg

SEQ ID NO: 6258 - RNA, 20 nt, Artificial Sequence
  source: /note="Description of Artificial Sequence: Synthetic oligonucleotide"
guuacguuauccuucguucg

SEQ ID NO: 6259 - RNA, 20 nt, Artificial Sequence
  source: /note="Description of Artificial Sequence: Synthetic oligonucleotide"
aacuuacgagaguuacguua

SEQ ID NO: 6260 - RNA, 20 nt, Artificial Sequence
  source: /note="Description of Artificial Sequence: Synthetic oligonucleotide"
ccaucuucaagaaccagaug

SEQ ID NO: 6261 - RNA, 20 nt, Artificial Sequence
  source: /note="Description of Artificial Sequence: Synthetic oligonucleotide"
uuuuuauaccaucuucaaga

SEQ ID NO: 6262 - RNA, 20 nt, Artificial Sequence
  source: /note="Description of Artificial Sequence: Synthetic oligonucleotide"
gcccaucuccaccuuuuuau

SEQ ID NO: 6263 - RNA, 20 nt, Artificial Sequence
  source: /note="Description of Artificial Sequence: Synthetic oligonucleotide"
acuguguuuugcccaucucc

SEQ ID NO: 6264 - RNA, 20 nt, Artificial Sequence
  source: /note="Description of Artificial Sequence: Synthetic oligonucleotide"
uaaacuguguuuugcccauc

SEQ ID NO: 6265 - RNA, 20 nt, Artificial Sequence
  source: /note="Description of Artificial Sequence: Synthetic oligonucleotide"
uaugucuaaacuguguuuug

SEQ ID NO: 6266 - RNA, 20 nt, Artificial Sequence
  source: /note="Description of Artificial Sequence: Synthetic oligonucleotide"
auaugucuaaacuguguuuu

SEQ ID NO: 6267 - RNA, 20 nt, Artificial Sequence
  source: /note="Description of Artificial Sequence: Synthetic oligonucleotide"
gauaugucuaaacuguguuu

SEQ ID NO: 6268 - RNA, 20 nt, Artificial Sequence
  source: /note="Description of Artificial Sequence: Synthetic oligonucleotide"
acucugaagaaugaaaagaa

SEQ ID NO: 6269 - RNA, 20 nt, Artificial Sequence
  source: /note="Description of Artificial Sequence: Synthetic oligonucleotide"
uaggaaauaauuuauggaag

SEQ ID NO: 6270 - RNA, 20 nt, Artificial Sequence
  source: /note="Description of Artificial Sequence: Synthetic oligonucleotide"
aacaauuaggaaauaauuua

SEQ ID NO: 6271 - RNA, 20 nt, Artificial Sequence
  source: /note="Description of Artificial Sequence: Synthetic oligonucleotide"
cagaggcagagggaacaauu

SEQ ID NO: 6272 - RNA, 20 nt, Artificial Sequence
  source: /note="Description of Artificial Sequence: Synthetic oligonucleotide"
aaaaaaagaacagaggcaga

SEQ ID NO: 6273 - RNA, 20 nt, Artificial Sequence
  source: /note="Description of Artificial Sequence: Synthetic oligonucleotide"
aaaaaaaagaacagaggcag

SEQ ID NO: 6274 - RNA, 20 nt, Artificial Sequence
  source: /note="Description of Artificial Sequence: Synthetic oligonucleotide"
agaaaaaaaaaaaagaacag

SEQ ID NO: 6275 - RNA, 20 nt, Artificial Sequence
  source: /note="Description of Artificial Sequence: Synthetic oligonucleotide"
acuuaagaaugggcauacag

SEQ ID NO: 6276 - RNA, 20 nt, Artificial Sequence
  source: /note="Description of Artificial Sequence: Synthetic oligonucleotide"
ucagauuugcacuuaagaau

SEQ ID NO: 6277 - RNA, 20 nt, Artificial Sequence
  source: /note="Description of Artificial Sequence: Synthetic oligonucleotide"
gucagauuugcacuuaagaa

SEQ ID NO: 6278 - RNA, 20 nt, Artificial Sequence
  source: /note="Description of Artificial Sequence: Synthetic oligonucleotide"
auauuaagaagggguauaga

SEQ ID NO: 6279 - RNA, 20 nt, Artificial Sequence
  source: /note="Description of Artificial Sequence: Synthetic oligonucleotide"
aaagaaaggauauuaagaag

SEQ ID NO: 6280 - RNA, 20 nt, Artificial Sequence
  source: /note="Description of Artificial Sequence: Synthetic oligonucleotide"
aaaagaaaggauauuaagaa

SEQ ID NO: 6281 - RNA, 20 nt, Artificial Sequence
  source: /note="Description of Artificial Sequence: Synthetic oligonucleotide"
uaaaagaaaggauauuaaga

SEQ ID NO: 6282 - RNA, 20 nt, Artificial Sequence
  source: /note="Description of Artificial Sequence: Synthetic oligonucleotide"
aauggguauccauaaaagaa

SEQ ID NO: 6283 - RNA, 20 nt, Artificial Sequence
  source: /note="Description of Artificial Sequence: Synthetic oligonucleotide"
ccuuuaauaaagucugaaau

SEQ ID NO: 6284 - RNA, 20 nt, Artificial Sequence
  source: /note="Description of Artificial Sequence: Synthetic oligonucleotide"
uccuuuaauaaagucugaaa

SEQ ID NO: 6285 - RNA, 20 nt, Artificial Sequence
  source: /note="Description of Artificial Sequence: Synthetic oligonucleotide"
caaguggugagguggggagg

SEQ ID NO: 6286 - RNA, 20 nt, Artificial Sequence
  source: /note="Description of Artificial Sequence: Synthetic oligonucleotide"
ucaaguggugagguggggag

SEQ ID NO: 6287 - RNA, 20 nt, Artificial Sequence
  source: /note="Description of Artificial Sequence: Synthetic oligonucleotide"
uucaaguggugaggugggga

SEQ ID NO: 6288 - RNA, 20 nt, Artificial Sequence
  source: /note="Description of Artificial Sequence: Synthetic oligonucleotide"
cuucaaguggugaggugggg

SEQ ID NO: 6289 - RNA, 20 nt, Artificial Sequence
  source: /note="Description of Artificial Sequence: Synthetic oligonucleotide"
aaacuucaaguggugaggug

SEQ ID NO: 6290 - RNA, 20 nt, Artificial Sequence
  source: /note="Description of Artificial Sequence: Synthetic oligonucleotide"
aaaacuucaaguggugaggu

SEQ ID NO: 6291 - RNA, 20 nt, Artificial Sequence
  source: /note="Description of Artificial Sequence: Synthetic oligonucleotide"
aaaaacuucaaguggugagg

SEQ ID NO: 6292 - RNA, 20 nt, Artificial Sequence
  source: /note="Description of Artificial Sequence: Synthetic oligonucleotide"
ugcaaaaacuucaaguggug

SEQ ID NO: 6293 - RNA, 20 nt, Artificial Sequence
  source: /note="Description of Artificial Sequence: Synthetic oligonucleotide"
cuaauugcaaaaacuucaag

SEQ ID NO: 6294 - RNA, 20 nt, Artificial Sequence
  source: /note="Description of Artificial Sequence: Synthetic oligonucleotide"
acucugaaaaggggauaagu

SEQ ID NO: 6295 - RNA, 20 nt, Artificial Sequence
  source: /note="Description of Artificial Sequence: Synthetic oligonucleotide"
uucagggccacucugaaaag

SEQ ID NO: 6296 - RNA, 20 nt, Artificial Sequence
  source: /note="Description of Artificial Sequence: Synthetic oligonucleotide"
auucagggccacucugaaaa

SEQ ID NO: 6297 - RNA, 20 nt, Artificial Sequence
  source: /note="Description of Artificial Sequence: Synthetic oligonucleotide"
uauucagggccacucugaaa

SEQ ID NO: 6298 - RNA, 20 nt, Artificial Sequence
  source: /note="Description of Artificial Sequence: Synthetic oligonucleotide"
uggguucacagagcuauuca

SEQ ID NO: 6299 - RNA, 20 nt, Artificial Sequence
  source: /note="Description of Artificial Sequence: Synthetic oligonucleotide"
cuggguucacagagcuauuc

SEQ ID NO: 6300 - RNA, 20 nt, Artificial Sequence
  source: /note="Description of Artificial Sequence: Synthetic oligonucleotide"
acugaguucuucagauuccu

SEQ ID NO: 6301 - RNA, 20 nt, Artificial Sequence
  source: /note="Description of Artificial Sequence: Synthetic oligonucleotide"
uacugaguucuucagauucc

SEQ ID NO: 6302 - RNA, 20 nt, Artificial Sequence
  source: /note="Description of Artificial Sequence: Synthetic oligonucleotide"
aucuacuuucuguaggcuga

SEQ ID NO: 6303 - RNA, 20 nt, Artificial Sequence
  source: /note="Description of Artificial Sequence: Synthetic oligonucleotide"
gaguuugaucuacuuucugu

SEQ ID NO: 6304 - RNA, 20 nt, Artificial Sequence
  source: /note="Description of Artificial Sequence: Synthetic oligonucleotide"
gaguaaccaggagccagauc

SEQ ID NO: 6305 - RNA, 20 nt, Artificial Sequence
  source: /note="Description of Artificial Sequence: Synthetic oligonucleotide"
gaggaauuugaagaguaacc

SEQ ID NO: 6306 - RNA, 20 nt, Artificial Sequence
  source: /note="Description of Artificial Sequence: Synthetic oligonucleotide"
gaagggacaauauaguaagg

SEQ ID NO: 6307 - RNA, 20 nt, Artificial Sequence
  source: /note="Description of Artificial Sequence: Synthetic oligonucleotide"
ucugaagggacaauauagua

SEQ ID NO: 6308 - RNA, 20 nt, Artificial Sequence
  source: /note="Description of Artificial Sequence: Synthetic oligonucleotide"
uaaagauuuacaaaucugaa

SEQ ID NO: 6309 - RNA, 20 nt, Artificial Sequence
  source: /note="Description of Artificial Sequence: Synthetic oligonucleotide"
guaaagauuuacaaaucuga

SEQ ID NO: 6310 - RNA, 20 nt, Artificial Sequence
  source: /note="Description of Artificial Sequence: Synthetic oligonucleotide"
guguguaaaauacgauguca

SEQ ID NO: 6311 - RNA, 20 nt, Artificial Sequence
  source: /note="Description of Artificial Sequence: Synthetic oligonucleotide"
ggagaggaacagcgguacaa

SEQ ID NO: 6312 - RNA, 20 nt, Artificial Sequence
  source: /note="Description of Artificial Sequence: Synthetic oligonucleotide"
guucaucaggagaggaacag

SEQ ID NO: 6313 - RNA, 20 nt, Artificial Sequence
  source: /note="Description of Artificial Sequence: Synthetic oligonucleotide"
aaagggaaguucaucaggag

SEQ ID NO: 6314 - RNA, 20 nt, Artificial Sequence
  source: /note="Description of Artificial Sequence: Synthetic oligonucleotide"
agagaaaagggaaguucauc

SEQ ID NO: 6315 - RNA, 20 nt, Artificial Sequence
  source: /note="Description of Artificial Sequence: Synthetic oligonucleotide"
gcuguguaguuaagagaaaa

SEQ ID NO: 6316 - RNA, 20 nt, Artificial Sequence
  source: /note="Description of Artificial Sequence: Synthetic oligonucleotide"
agcuguguaguuaagagaaa

SEQ ID NO: 6317 - RNA, 20 nt, Artificial Sequence
  source: /note="Description of Artificial Sequence: Synthetic oligonucleotide"
augucauucauccuacaaac

SEQ ID NO: 6318 - RNA, 20 nt, Artificial Sequence
  source: /note="Description of Artificial Sequence: Synthetic oligonucleotide"
uuguuuacugaugucauuca

SEQ ID NO: 6319 - RNA, 20 nt, Artificial Sequence
  source: /note="Description of Artificial Sequence: Synthetic oligonucleotide"
uccuuaaagucuuagacguu

SEQ ID NO: 6320 - RNA, 20 nt, Artificial Sequence
  source: /note="Description of Artificial Sequence: Synthetic oligonucleotide"
guucuacgucggaaacggga

SEQ ID NO: 6321 - RNA, 20 nt, Artificial Sequence
  source: /note="Description of Artificial Sequence: Synthetic oligonucleotide"
aaguugccaguagggggaga

SEQ ID NO: 6322 - RNA, 20 nt, Artificial Sequence
  source: /note="Description of Artificial Sequence: Synthetic oligonucleotide"
gaaguugccaguagggggag

SEQ ID NO: 6323 - RNA, 20 nt, Artificial Sequence
  source: /note="Description of Artificial Sequence: Synthetic oligonucleotide"
aggaagaaguugccaguagg

SEQ ID NO: 6324 - RNA, 20 nt, Artificial Sequence
  source: /note="Description of Artificial Sequence: Synthetic oligonucleotide"
uaggaagaaguugccaguag

SEQ ID NO: 6325 - RNA, 20 nt, Artificial Sequence
  source: /note="Description of Artificial Sequence: Synthetic oligonucleotide"
guaggaagaaguugccagua

SEQ ID NO: 6326 - RNA, 20 nt, Artificial Sequence
  source: /note="Description of Artificial Sequence: Synthetic oligonucleotide"
aguaggaagaaguugccagu

SEQ ID NO: 6327 - RNA, 20 nt, Artificial Sequence
  source: /note="Description of Artificial Sequence: Synthetic oligonucleotide"
cuguaucuauuuuaagaagu

SEQ ID NO: 6328 - RNA, 20 nt, Artificial Sequence
  source: /note="Description of Artificial Sequence: Synthetic oligonucleotide"
accucuucccuccacuuagu

SEQ ID NO: 6329 - RNA, 20 nt, Artificial Sequence
  source: /note="Description of Artificial Sequence: Synthetic oligonucleotide"
caccucuucccuccacuuag

SEQ ID NO: 6330 - RNA, 20 nt, Artificial Sequence
  source: /note="Description of Artificial Sequence: Synthetic oligonucleotide"
cuuauaauuaaguaucucug

SEQ ID NO: 6331 - RNA, 20 nt, Artificial Sequence
  source: /note="Description of Artificial Sequence: Synthetic oligonucleotide"
uacuuuagugaaaaaaaugu

SEQ ID NO: 6332 - RNA, 20 nt, Artificial Sequence
  source: /note="Description of Artificial Sequence: Synthetic oligonucleotide"
gcaacacauuuaauuuugau

SEQ ID NO: 6333 - RNA, 20 nt, Artificial Sequence
  source: /note="Description of Artificial Sequence: Synthetic oligonucleotide"
uauucauguauuucucacua

SEQ ID NO: 6334 - RNA, 20 nt, Artificial Sequence
  source: /note="Description of Artificial Sequence: Synthetic oligonucleotide"
agaacacaaccaaaaacugc

SEQ ID NO: 6335 - RNA, 20 nt, Artificial Sequence
  source: /note="Description of Artificial Sequence: Synthetic oligonucleotide"
ggacagcacucucaaacaua

SEQ ID NO: 6336 - RNA, 20 nt, Artificial Sequence
  source: /note="Description of Artificial Sequence: Synthetic oligonucleotide"
cagccacaucacaaagcacc

SEQ ID NO: 6337 - RNA, 20 nt, Artificial Sequence
  source: /note="Description of Artificial Sequence: Synthetic oligonucleotide"
cacuuuuuacucuuugguca

SEQ ID NO: 6338 - RNA, 20 nt, Artificial Sequence
  source: /note="Description of Artificial Sequence: Synthetic oligonucleotide"
ucacuuuuuacucuuugguc

SEQ ID NO: 6339 - RNA, 20 nt, Artificial Sequence
  source: /note="Description of Artificial Sequence: Synthetic oligonucleotide"
aagaaucacuuuuuacucuu

SEQ ID NO: 6340 - RNA, 20 nt, Artificial Sequence
  source: /note="Description of Artificial Sequence: Synthetic oligonucleotide"
uuuacuuuccucuauagcua

SEQ ID NO: 6341 - RNA, 20 nt, Artificial Sequence
  source: /note="Description of Artificial Sequence: Synthetic oligonucleotide"
uuuaauucuacauuugaugu

SEQ ID NO: 6342 - RNA, 20 nt, Artificial Sequence
  source: /note="Description of Artificial Sequence: Synthetic oligonucleotide"
auuuaauucuacauuugaug

SEQ ID NO: 6343 - RNA, 20 nt, Artificial Sequence
  source: /note="Description of Artificial Sequence: Synthetic oligonucleotide"
aaaaccuuucagagaccauc

SEQ ID NO: 6344 - RNA, 20 nt, Artificial Sequence
  source: /note="Description of Artificial Sequence: Synthetic oligonucleotide"
uuacucugaaagugaguaaa

SEQ ID NO: 6345 - RNA, 20 nt, Artificial Sequence
  source: /note="Description of Artificial Sequence: Synthetic oligonucleotide"
cuuacucugaaagugaguaa

SEQ ID NO: 6346 - RNA, 20 nt, Artificial Sequence
  source: /note="Description of Artificial Sequence: Synthetic oligonucleotide"
aacuuuuggaaaaacagaaa

SEQ ID NO: 6347 - RNA, 20 nt, Artificial Sequence
  source: /note="Description of Artificial Sequence: Synthetic oligonucleotide"
aaacuuuuggaaaaacagaa

SEQ ID NO: 6348 - RNA, 20 nt, Artificial Sequence
  source: /note="Description of Artificial Sequence: Synthetic oligonucleotide"
cuuucaaaaaauaaaacuuu

SEQ ID NO: 6349 - RNA, 20 nt, Artificial Sequence
  source: /note="Description of Artificial Sequence: Synthetic oligonucleotide"
uaauuuuucaaaugucuaaa

SEQ ID NO: 6350 - RNA, 20 nt, Artificial Sequence
  source: /note="Description of Artificial Sequence: Synthetic oligonucleotide"
cuuuucuacguugcuacucu

SEQ ID NO: 6351 - RNA, 20 nt, Artificial Sequence
  source: /note="Description of Artificial Sequence: Synthetic oligonucleotide"
uuauuaaauacuuacuaugu

SEQ ID NO: 6352 - RNA, 20 nt, Artificial Sequence
  source: /note="Description of Artificial Sequence: Synthetic oligonucleotide"
guccucacucgauggagugg

SEQ ID NO: 6353 - RNA, 20 nt, Artificial Sequence
  source: /note="Description of Artificial Sequence: Synthetic oligonucleotide"
aggguuuaacgacccuaaug

SEQ ID NO: 6354 - RNA, 20 nt, Artificial Sequence
  source: /note="Description of Artificial Sequence: Synthetic oligonucleotide"
ggagccggaggguuuaacga

SEQ ID NO: 6355 - RNA, 20 nt, Artificial Sequence
  source: /note="Description of Artificial Sequence: Synthetic oligonucleotide"
cggagccggaggguuuaacg

SEQ ID NO: 6356 - RNA, 20 nt, Artificial Sequence
  source: /note="Description of Artificial Sequence: Synthetic oligonucleotide"
gaguccacuaggugggcgga

SEQ ID NO: 6357 - RNA, 20 nt, Artificial Sequence
  source: /note="Description of Artificial Sequence: Synthetic oligonucleotide"
ccagaguuugagaacuggag

SEQ ID NO: 6358 - RNA, 20 nt, Artificial Sequence
  source: /note="Description of Artificial Sequence: Synthetic oligonucleotide"
aaagugguaugaccaguccg

SEQ ID NO: 6359 - RNA, 20 nt, Artificial Sequence
  source: /note="Description of Artificial Sequence: Synthetic oligonucleotide"
ccccaaagugguaugaccag

SEQ ID NO: 6360 - RNA, 20 nt, Artificial Sequence
  source: /note="Description of Artificial Sequence: Synthetic oligonucleotide"
cucuaccccaaagugguaug

SEQ ID NO: 6361 - RNA, 20 nt, Artificial Sequence
  source: /note="Description of Artificial Sequence: Synthetic oligonucleotide"
aacguaaaaaucaucucuac

SEQ ID NO: 6362 - RNA, 20 nt, Artificial Sequence
  source: /note="Description of Artificial Sequence: Synthetic oligonucleotide"
aaacguaaaaaucaucucua

SEQ ID NO: 6363 - RNA, 20 nt, Artificial Sequence
  source: /note="Description of Artificial Sequence: Synthetic oligonucleotide"
aaaacguaaaaaucaucucu

SEQ ID NO: 6364 - RNA, 20 nt, Artificial Sequence
  source: /note="Description of Artificial Sequence: Synthetic oligonucleotide"
agggcucaucgaccauaaua

SEQ ID NO: 6365 - RNA, 20 nt, Artificial Sequence
  source: /note="Description of Artificial Sequence: Synthetic oligonucleotide"
cggagucggagggcucaucg

SEQ ID NO: 6366 - RNA, 20 nt, Artificial Sequence
  source: /note="Description of Artificial Sequence: Synthetic oligonucleotide"
ccucacguugccgugcuaga

SEQ ID NO: 6367 - RNA, 20 nt, Artificial Sequence
  source: /note="Description of Artificial Sequence: Synthetic oligonucleotide"
aacgaguccgaccucacguu

SEQ ID NO: 6368 - RNA, 20 nt, Artificial Sequence
  source: /note="Description of Artificial Sequence: Synthetic oligonucleotide"
aagugagaacaacgaguccg

SEQ ID NO: 6369 - RNA, 20 nt, Artificial Sequence
  source: /note="Description of Artificial Sequence: Synthetic oligonucleotide"
cucaaagugagaacaacgag

SEQ ID NO: 6370 - RNA, 20 nt, Artificial Sequence
  source: /note="Description of Artificial Sequence: Synthetic oligonucleotide"
uugauaguuuuccuuuucau

SEQ ID NO: 6371 - RNA, 20 nt, Artificial Sequence
  source: /note="Description of Artificial Sequence: Synthetic oligonucleotide"
cauauuuuaguuucugacuu

SEQ ID NO: 6372 - RNA, 20 nt, Artificial Sequence
  source: /note="Description of Artificial Sequence: Synthetic oligonucleotide"
uuccuucugucuccuuuaac

SEQ ID NO: 6373 - RNA, 20 nt, Artificial Sequence
  source: /note="Description of Artificial Sequence: Synthetic oligonucleotide"
auuuucuugcccuuauuuuc

SEQ ID NO: 6374 - RNA, 20 nt, Artificial Sequence
  source: /note="Description of Artificial Sequence: Synthetic oligonucleotide"
guucauuuuuucagccuaca

SEQ ID NO: 6375 - RNA, 20 nt, Artificial Sequence
  source: /note="Description of Artificial Sequence: Synthetic oligonucleotide"
caaggacguaccauaccuuu

SEQ ID NO: 6376 - RNA, 20 nt, Artificial Sequence
  source: /note="Description of Artificial Sequence: Synthetic oligonucleotide"
ccaaggacguaccauaccuu

SEQ ID NO: 6377 - RNA, 20 nt, Artificial Sequence
  source: /note="Description of Artificial Sequence: Synthetic oligonucleotide"
uucuuccaaggacguaccau

SEQ ID NO: 6378 - RNA, 20 nt, Artificial Sequence
  source: /note="Description of Artificial Sequence: Synthetic oligonucleotide"
gucauuucuuccaaggacgu

SEQ ID NO: 6379 - RNA, 20 nt, Artificial Sequence
  source: /note="Description of Artificial Sequence: Synthetic oligonucleotide"
agaauccuuacgucauuucu

SEQ ID NO: 6380 - RNA, 20 nt, Artificial Sequence
  source: /note="Description of Artificial Sequence: Synthetic oligonucleotide"
ccacgaucugaucaggagaa

SEQ ID NO: 6381 - RNA, 20 nt, Artificial Sequence
  source: /note="Description of Artificial Sequence: Synthetic oligonucleotide"
uaaugguguucauagguuaa

SEQ ID NO: 6382 - RNA, 20 nt, Artificial Sequence
  source: /note="Description of Artificial Sequence: Synthetic oligonucleotide"
auuauaauuaaguaucucug

SEQ ID NO: 6383 - RNA, 20 nt, Artificial Sequence
  source: /note="Description of Artificial Sequence: Synthetic oligonucleotide"
gcaacacauuuaauuuuggu

SEQ ID NO: 6384 - RNA, 20 nt, Artificial Sequence
  source: /note="Description of Artificial Sequence: Synthetic oligonucleotide"
aacugcaacacauuuaauuu

SEQ ID NO: 6385 - RNA, 20 nt, Artificial Sequence
  source: /note="Description of Artificial Sequence: Synthetic oligonucleotide"
uuuauguucaucaauacuau

SEQ ID NO: 6386 - RNA, 20 nt, Artificial Sequence
  source: /note="Description of Artificial Sequence: Synthetic oligonucleotide"
caccaaacuuuaauauuuaa

SEQ ID NO: 6387 - RNA, 20 nt, Artificial Sequence
  source: /note="Description of Artificial Sequence: Synthetic oligonucleotide"
acaccaaacuuuaauauuua

SEQ ID NO: 6388 - RNA, 20 nt, Artificial Sequence
  source: /note="Description of Artificial Sequence: Synthetic oligonucleotide"
aauuagaagagagcccuaua

SEQ ID NO: 6389 - RNA, 20 nt, Artificial Sequence
  source: /note="Description of Artificial Sequence: Synthetic oligonucleotide"
aauuaucuacacgucauagg

SEQ ID NO: 6390 - RNA, 20 nt, Artificial Sequence
  source: /note="Description of Artificial Sequence: Synthetic oligonucleotide"
uuuuuucuguuuuuggaaac

SEQ ID NO: 6391 - RNA, 20 nt, Artificial Sequence
  source: /note="Description of Artificial Sequence: Synthetic oligonucleotide"
uuuagugucaguguuucacu

SEQ ID NO: 6392 - RNA, 20 nt, Artificial Sequence
  source: /note="Description of Artificial Sequence: Synthetic oligonucleotide"
ucccugaacuucuuuguucu

SEQ ID NO: 6393 - RNA, 20 nt, Artificial Sequence
  source: /note="Description of Artificial Sequence: Synthetic oligonucleotide"
gguauuuaaaggaauuuccu

SEQ ID NO: 6394 - RNA, 20 nt, Artificial Sequence
  source: /note="Description of Artificial Sequence: Synthetic oligonucleotide"
agguauuuaaaggaauuucc

SEQ ID NO: 6395 - RNA, 20 nt, Artificial Sequence
  source: /note="Description of Artificial Sequence: Synthetic oligonucleotide"
uaaagguauuuaaaggaauu

SEQ ID NO: 6396 - RNA, 20 nt, Artificial Sequence
  source: /note="Description of Artificial Sequence: Synthetic oligonucleotide"
uuuuaagccacuugauggua

SEQ ID NO: 6397 - RNA, 20 nt, Artificial Sequence
  source: /note="Description of Artificial Sequence: Synthetic oligonucleotide"
uuuucuuuuaagccacuuga

SEQ ID NO: 6398 - RNA, 20 nt, Artificial Sequence
  source: /note="Description of Artificial Sequence: Synthetic oligonucleotide"
gugcacaugaggacuugaau

SEQ ID NO: 6399 - RNA, 20 nt, Artificial Sequence
  source: /note="Description of Artificial Sequence: Synthetic oligonucleotide"
guuguuugaggguacugggu

SEQ ID NO: 6400 - RNA, 20 nt, Artificial Sequence
  source: /note="Description of Artificial Sequence: Synthetic oligonucleotide"
cccaugauccgaauuaugga

SEQ ID NO: 6401 - RNA, 20 nt, Artificial Sequence
  source: /note="Description of Artificial Sequence: Synthetic oligonucleotide"
acccaugauccgaauuaugg

SEQ ID NO: 6402 - RNA, 20 nt, Artificial Sequence
  source: /note="Description of Artificial Sequence: Synthetic oligonucleotide"
uuuuuauugauuacccauga

SEQ ID NO: 6403 - RNA, 20 nt, Artificial Sequence
  source: /note="Description of Artificial Sequence: Synthetic oligonucleotide"
cuaguccuuuuuauugauua

SEQ ID NO: 6404 - RNA, 20 nt, Artificial Sequence
  source: /note="Description of Artificial Sequence: Synthetic oligonucleotide"
ccuaguccuuuuuauugauu

SEQ ID NO: 6405 - RNA, 20 nt, Artificial Sequence
  source: /note="Description of Artificial Sequence: Synthetic oligonucleotide"
cacccuccucccucuccuag

SEQ ID NO: 6406 - RNA, 20 nt, Artificial Sequence
  source: /note="Description of Artificial Sequence: Synthetic oligonucleotide"
accucccacccuccucccuc

SEQ ID NO: 6407 - RNA, 20 nt, Artificial Sequence
  source: /note="Description of Artificial Sequence: Synthetic oligonucleotide"
cucccaccucccacccuccu

SEQ ID NO: 6408 - RNA, 20 nt, Artificial Sequence
  source: /note="Description of Artificial Sequence: Synthetic oligonucleotide"
ucucccaccucccacccucc

SEQ ID NO: 6409 - RNA, 20 nt, Artificial Sequence
  source: /note="Description of Artificial Sequence: Synthetic oligonucleotide"
uagucucccaccucccaccc

SEQ ID NO: 6410 - RNA, 20 nt, Artificial Sequence
  source: /note="Description of Artificial Sequence: Synthetic oligonucleotide"
ggauagucucccaccuccca

SEQ ID NO: 6411 - RNA, 20 nt, Artificial Sequence
  source: /note="Description of Artificial Sequence: Synthetic oligonucleotide"
cggauagucucccaccuccc

SEQ ID NO: 6412 - RNA, 20 nt, Artificial Sequence
  source: /note="Description of Artificial Sequence: Synthetic oligonucleotide"
ccccggauagucucccaccu

SEQ ID NO: 6413 - RNA, 20 nt, Artificial Sequence
  source: /note="Description of Artificial Sequence: Synthetic oligonucleotide"
gccccggauagucucccacc

SEQ ID NO: 6414 - RNA, 20 nt, Artificial Sequence
  source: /note="Description of Artificial Sequence: Synthetic oligonucleotide"
guggccccggauagucuccc

SEQ ID NO: 6415 - RNA, 20 nt, Artificial Sequence
  source: /note="Description of Artificial Sequence: Synthetic oligonucleotide"
uguguggccccggauagucu

SEQ ID NO: 6416 - RNA, 20 nt, Artificial Sequence
  source: /note="Description of Artificial Sequence: Synthetic oligonucleotide"
guguguggccccggauaguc

SEQ ID NO: 6417 - RNA, 20 nt, Artificial Sequence
  source: /note="Description of Artificial Sequence: Synthetic oligonucleotide"
cuccccuuguuguguguggc

SEQ ID NO: 6418 - RNA, 20 nt, Artificial Sequence
  source: /note="Description of Artificial Sequence: Synthetic oligonucleotide"
ucuccccuuguugugugugg

SEQ ID NO: 6419 - RNA, 20 nt, Artificial Sequence
  source: /note="Description of Artificial Sequence: Synthetic oligonucleotide"
gucuccccuuguugugugug

SEQ ID NO: 6420 - RNA, 20 nt, Artificial Sequence
  source: /note="Description of Artificial Sequence: Synthetic oligonucleotide"
cuccuguauaccugugucuc

SEQ ID NO: 6421 - RNA, 20 nt, Artificial Sequence
  source: /note="Description of Artificial Sequence: Synthetic oligonucleotide"
acuccuguauaccugugucu

SEQ ID NO: 6422 - RNA, 20 nt, Artificial Sequence
  source: /note="Description of Artificial Sequence: Synthetic oligonucleotide"
uacuccuguauaccuguguc

SEQ ID NO: 6423 - RNA, 20 nt, Artificial Sequence
  source: /note="Description of Artificial Sequence: Synthetic oligonucleotide"
ucgauuuacuacuccuguau

SEQ ID NO: 6424 - RNA, 20 nt, Artificial Sequence
  source: /note="Description of Artificial Sequence: Synthetic oligonucleotide"
auucacccucgauuuacuac

SEQ ID NO: 6425 - RNA, 20 nt, Artificial Sequence
  source: /note="Description of Artificial Sequence: Synthetic oligonucleotide"
cguacaagagugaauauuca

SEQ ID NO: 6426 - RNA, 20 nt, Artificial Sequence
  source: /note="Description of Artificial Sequence: Synthetic oligonucleotide"
acguacaagagugaauauuc

SEQ ID NO: 6427 - RNA, 20 nt, Artificial Sequence
  source: /note="Description of Artificial Sequence: Synthetic oligonucleotide"
auagguaucguuugauugua

SEQ ID NO: 6428 - RNA, 20 nt, Artificial Sequence
  source: /note="Description of Artificial Sequence: Synthetic oligonucleotide"
uaccuguaccuaccucgacc

SEQ ID NO: 6429 - RNA, 20 nt, Artificial Sequence
  source: /note="Description of Artificial Sequence: Synthetic oligonucleotide"
acguaccuguaccuaccucg

SEQ ID NO: 6430 - RNA, 20 nt, Artificial Sequence
  source: /note="Description of Artificial Sequence: Synthetic oligonucleotide"
caaaaaacguaccuguaccu

SEQ ID NO: 6431 - RNA, 20 nt, Artificial Sequence
  source: /note="Description of Artificial Sequence: Synthetic oligonucleotide"
aguacaaaaaacguaccugu

SEQ ID NO: 6432 - RNA, 20 nt, Artificial Sequence
  source: /note="Description of Artificial Sequence: Synthetic oligonucleotide"
uauucuaguacaaaaaacgu

SEQ ID NO: 6433 - RNA, 20 nt, Artificial Sequence
  source: /note="Description of Artificial Sequence: Synthetic oligonucleotide"
ugacacaauauauauguggu

SEQ ID NO: 6434 - RNA, 20 nt, Artificial Sequence
  source: /note="Description of Artificial Sequence: Synthetic oligonucleotide"
uuacgggugguuauuaucug

SEQ ID NO: 6435 - RNA, 20 nt, Artificial Sequence
  source: /note="Description of Artificial Sequence: Synthetic oligonucleotide"
auaaguguuaucguuucugu

SEQ ID NO: 6436 - RNA, 20 nt, Artificial Sequence
  source: /note="Description of Artificial Sequence: Synthetic oligonucleotide"
gugaugacccauauaugguu

SEQ ID NO: 6437 - RNA, 20 nt, Artificial Sequence
  source: /note="Description of Artificial Sequence: Synthetic oligonucleotide"
uugggucguuggggugauga

SEQ ID NO: 6438 - RNA, 20 nt, Artificial Sequence
  source: /note="Description of Artificial Sequence: Synthetic oligonucleotide"
guugggucguuggggugaug

SEQ ID NO: 6439 - RNA, 20 nt, Artificial Sequence
  source: /note="Description of Artificial Sequence: Synthetic oligonucleotide"
cauuuaaucaaguugguaac

SEQ ID NO: 6440 - RNA, 20 nt, Artificial Sequence
  source: /note="Description of Artificial Sequence: Synthetic oligonucleotide"
uugugaauauacgauaacca

SEQ ID NO: 6441 - RNA, 20 nt, Artificial Sequence
  source: /note="Description of Artificial Sequence: Synthetic oligonucleotide"
cuugugaauauacgauaacc

SEQ ID NO: 6442 - RNA, 20 nt, Artificial Sequence
  source: /note="Description of Artificial Sequence: Synthetic oligonucleotide"
uuccuugugaauauacgaua

SEQ ID NO: 6443 - RNA, 20 nt, Artificial Sequence
  source: /note="Description of Artificial Sequence: Synthetic oligonucleotide"
aucacuccaacgccucuuuu

SEQ ID NO: 6444 - RNA, 20 nt, Artificial Sequence
  source: /note="Description of Artificial Sequence: Synthetic oligonucleotide"
uauugugcaaucacuccaac

SEQ ID NO: 6445 - RNA, 20 nt, Artificial Sequence
  source: /note="Description of Artificial Sequence: Synthetic oligonucleotide"
guuuuuuauugugcaaucac

SEQ ID NO: 6446 - RNA, 20 nt, Artificial Sequence
  source: /note="Description of Artificial Sequence: Synthetic oligonucleotide"
gguagaguguggucaguccu

SEQ ID NO: 6447 - RNA, 20 nt, Artificial Sequence
  source: /note="Description of Artificial Sequence: Synthetic oligonucleotide"
cuaugguagaguguggucag

SEQ ID NO: 6448 - RNA, 20 nt, Artificial Sequence
  source: /note="Description of Artificial Sequence: Synthetic oligonucleotide"
auguuuucuucuguauguac

SEQ ID NO: 6449 - RNA, 20 nt, Artificial Sequence
  source: /note="Description of Artificial Sequence: Synthetic oligonucleotide"
ggguaacuuuuucacccguu

SEQ ID NO: 6450 - RNA, 20 nt, Artificial Sequence
  source: /note="Description of Artificial Sequence: Synthetic oligonucleotide"
uuguagggguaacuuuuuca

SEQ ID NO: 6451 - RNA, 20 nt, Artificial Sequence
  source: /note="Description of Artificial Sequence: Synthetic oligonucleotide"
uuuguagggguaacuuuuuc

SEQ ID NO: 6452 - RNA, 20 nt, Artificial Sequence
  source: /note="Description of Artificial Sequence: Synthetic oligonucleotide"
auauuccuagaauuuaaaug

SEQ ID NO: 6453 - RNA, 20 nt, Artificial Sequence
  source: /note="Description of Artificial Sequence: Synthetic oligonucleotide"
uuaucauaggucguagauau

SEQ ID NO: 6454 - RNA, 20 nt, Artificial Sequence
  source: /note="Description of Artificial Sequence: Synthetic oligonucleotide"
uuugucuguuggaugucuua

SEQ ID NO: 6455 - RNA, 20 nt, Artificial Sequence
  source: /note="Description of Artificial Sequence: Synthetic oligonucleotide"
uuuugucuguuggaugucuu

SEQ ID NO: 6456 - RNA, 20 nt, Artificial Sequence
  source: /note="Description of Artificial Sequence: Synthetic oligonucleotide"
cauucguuuuuaaguguuua

SEQ ID NO: 6457 - RNA, 20 nt, Artificial Sequence
  source: /note="Description of Artificial Sequence: Synthetic oligonucleotide"
ucauucguuuuuaaguguuu

SEQ ID NO: 6458 - RNA, 20 nt, Artificial Sequence
  source: /note="Description of Artificial Sequence: Synthetic oligonucleotide"
aaaaaaaaacagugugaccu

SEQ ID NO: 6459 - RNA, 20 nt, Artificial Sequence
  source: /note="Description of Artificial Sequence: Synthetic oligonucleotide"
caaaaaaaaacagugugacc

SEQ ID NO: 6460 - RNA, 20 nt, Artificial Sequence
  source: /note="Description of Artificial Sequence: Synthetic oligonucleotide"
acauaguggugugaggucug

SEQ ID NO: 6461 - RNA, 20 nt, Artificial Sequence
  source: /note="Description of Artificial Sequence: Synthetic oligonucleotide"
acgaacuugggccuuacacc

SEQ ID NO: 6462 - RNA, 20 nt, Artificial Sequence
  source: /note="Description of Artificial Sequence: Synthetic oligonucleotide"
uuaacgaacuugggccuuac

SEQ ID NO: 6463 - RNA, 20 nt, Artificial Sequence
  source: /note="Description of Artificial Sequence: Synthetic oligonucleotide"
cgucuucuuaacgaacuugg

SEQ ID NO: 6464 - RNA, 20 nt, Artificial Sequence
  source: /note="Description of Artificial Sequence: Synthetic oligonucleotide"
gggucgaugaguccuccgac

SEQ ID NO: 6465 - RNA, 20 nt, Artificial Sequence
  source: /note="Description of Artificial Sequence: Synthetic oligonucleotide"
acaucagggucgaugagucc

SEQ ID NO: 6466 - RNA, 20 nt, Artificial Sequence
  source: /note="Description of Artificial Sequence: Synthetic oligonucleotide"
cggacaucagggucgaugag

SEQ ID NO: 6467 - RNA, 20 nt, Artificial Sequence
  source: /note="Description of Artificial Sequence: Synthetic oligonucleotide"
guuuuuaaucgacccguacc

SEQ ID NO: 6468 - RNA, 20 nt, Artificial Sequence
  source: /note="Description of Artificial Sequence: Synthetic oligonucleotide"
uauguuuuuaaucgacccgu

SEQ ID NO: 6469 - RNA, 20 nt, Artificial Sequence
  source: /note="Description of Artificial Sequence: Synthetic oligonucleotide"
auuuuuauguuuuuaaucga

SEQ ID NO: 6470 - RNA, 20 nt, Artificial Sequence
  source: /note="Description of Artificial Sequence: Synthetic oligonucleotide"
gauuuuuauguuuuuaaucg

SEQ ID NO: 6471 - RNA, 20 nt, Artificial Sequence
  source: /note="Description of Artificial Sequence: Synthetic oligonucleotide"
ucucugguaggaccgguugu

SEQ ID NO: 6472 - RNA, 20 nt, Artificial Sequence
  source: /note="Description of Artificial Sequence: Synthetic oligonucleotide"
aguucucuaucucugguagg

SEQ ID NO: 6473 - RNA, 20 nt, Artificial Sequence
  source: /note="Description of Artificial Sequence: Synthetic oligonucleotide"
cgugaaacccuccgacuccg

SEQ ID NO: 6474 - RNA, 20 nt, Artificial Sequence
  source: /note="Description of Artificial Sequence: Synthetic oligonucleotide"
ucgugaaacccuccgacucc

SEQ ID NO: 6475 - RNA, 20 nt, Artificial Sequence
  source: /note="Description of Artificial Sequence: Synthetic oligonucleotide"
gggucgugaaacccuccgac

SEQ ID NO: 6476 - RNA, 20 nt, Artificial Sequence
  source: /note="Description of Artificial Sequence: Synthetic oligonucleotide"
acauuagggucgugaaaccc

SEQ ID NO: 6477 - RNA, 20 nt, Artificial Sequence
  source: /note="Description of Artificial Sequence: Synthetic oligonucleotide"
cggacauuagggucgugaaa

SEQ ID NO: 6478 - RNA, 20 nt, Artificial Sequence
  source: /note="Description of Artificial Sequence: Synthetic oligonucleotide"
ucggacauuagggucgugaa

SEQ ID NO: 6479 - RNA, 20 nt, Artificial Sequence
  source: /note="Description of Artificial Sequence: Synthetic oligonucleotide"
ugaccuggccgguccacacc

SEQ ID NO: 6480 - RNA, 20 nt, Artificial Sequence
  source: /note="Description of Artificial Sequence: Synthetic oligonucleotide"
guaugaccuggccgguccac

SEQ ID NO: 6481 - RNA, 20 nt, Artificial Sequence
  source: /note="Description of Artificial Sequence: Synthetic oligonucleotide"
uaaaaguaugaccuggccgg

SEQ ID NO: 6482 - RNA, 20 nt, Artificial Sequence
  source: /note="Description of Artificial Sequence: Synthetic oligonucleotide"
uugauuaaaaguaugaccug

SEQ ID NO: 6483 - RNA, 20 nt, Artificial Sequence
  source: /note="Description of Artificial Sequence: Synthetic oligonucleotide"
uuugauuaaaaguaugaccu

SEQ ID NO: 6484 - RNA, 20 nt, Artificial Sequence
  source: /note="Description of Artificial Sequence: Synthetic oligonucleotide"
uuuugauuaaaaguaugacc

SEQ ID NO: 6485 - RNA, 20 nt, Artificial Sequence
  source: /note="Description of Artificial Sequence: Synthetic oligonucleotide"
aacaacauggauuucaaccg

SEQ ID NO: 6486 - RNA, 20 nt, Artificial Sequence
  source: /note="Description of Artificial Sequence: Synthetic oligonucleotide"
gguugaaggauucaacaaca

SEQ ID NO: 6487 - RNA, 20 nt, Artificial Sequence
  source: /note="Description of Artificial Sequence: Synthetic oligonucleotide"
cucaguccucaagggguuga

SEQ ID NO: 6488 - RNA, 20 nt, Artificial Sequence
  source: /note="Description of Artificial Sequence: Synthetic oligonucleotide"
gggaauucucaguccucaag

SEQ ID NO: 6489 - RNA, 20 nt, Artificial Sequence
  source: /note="Description of Artificial Sequence: Synthetic oligonucleotide"
agggaauucucaguccucaa

SEQ ID NO: 6490 - RNA, 20 nt, Artificial Sequence
  source: /note="Description of Artificial Sequence: Synthetic oligonucleotide"
aagggaauucucaguccuca

SEQ ID NO: 6491 - RNA, 20 nt, Artificial Sequence
  source: /note="Description of Artificial Sequence: Synthetic oligonucleotide"
gauucagacagauaauuaaa

SEQ ID NO: 6492 - RNA, 20 nt, Artificial Sequence
  source: /note="Description of Artificial Sequence: Synthetic oligonucleotide"
ugauucagacagauaauuaa

SEQ ID NO: 6493 - RNA, 20 nt, Artificial Sequence
  source: /note="Description of Artificial Sequence: Synthetic oligonucleotide"
aagagauaauuuuguuuaau

SEQ ID NO: 6494 - RNA, 20 nt, Artificial Sequence
  source: /note="Description of Artificial Sequence: Synthetic oligonucleotide"
ccuaaauuacacauuugugg

SEQ ID NO: 6495 - RNA, 20 nt, Artificial Sequence
  source: /note="Description of Artificial Sequence: Synthetic oligonucleotide"
uccuaaauuacacauuugug

SEQ ID NO: 6496 - RNA, 20 nt, Artificial Sequence
  source: /note="Description of Artificial Sequence: Synthetic oligonucleotide"
uuccuaaauuacacauuugu

SEQ ID NO: 6497 - RNA, 20 nt, Artificial Sequence
  source: /note="Description of Artificial Sequence: Synthetic oligonucleotide"
auuccuaaauuacacauuug

SEQ ID NO: 6498 - RNA, 20 nt, Artificial Sequence
  source: /note="Description of Artificial Sequence: Synthetic oligonucleotide"
auacuuuccuuaaacuuuuu

SEQ ID NO: 6499 - RNA, 20 nt, Artificial Sequence
  source: /note="Description of Artificial Sequence: Synthetic oligonucleotide"
caguaauugagcacugaaau

SEQ ID NO: 6500 - RNA, 20 nt, Artificial Sequence
  source: /note="Description of Artificial Sequence: Synthetic oligonucleotide"
acaguaauugagcacugaaa

SEQ ID NO: 6501 - RNA, 20 nt, Artificial Sequence
  source: /note="Description of Artificial Sequence: Synthetic oligonucleotide"
auaagcaauacuuccacuug

SEQ ID NO: 6502 - RNA, 20 nt, Artificial Sequence
  source: /note="Description of Artificial Sequence: Synthetic oligonucleotide"
guccuuaaaaccccucagua

SEQ ID NO: 6503 - RNA, 20 nt, Artificial Sequence
  source: /note="Description of Artificial Sequence: Synthetic oligonucleotide"
auugaauucuagccucaacu

SEQ ID NO: 6504 - RNA, 20 nt, Artificial Sequence
  source: /note="Description of Artificial Sequence: Synthetic oligonucleotide"
ugauaccauuuuaacuguau

SEQ ID NO: 6505 - RNA, 20 nt, Artificial Sequence
  source: /note="Description of Artificial Sequence: Synthetic oligonucleotide"
uuuuuuuuuuuuuuuggucc

SEQ ID NO: 6506 - RNA, 20 nt, Artificial Sequence
  source: /note="Description of Artificial Sequence: Synthetic oligonucleotide"
uuuuuuuuuuuuuuuuuuuu

SEQ ID NO: 6507 - RNA, 20 nt, Artificial Sequence
  source: /note="Description of Artificial Sequence: Synthetic oligonucleotide"
acguggcgucagacccguug

SEQ ID NO: 6508 - RNA, 20 nt, Artificial Sequence
  source: /note="Description of Artificial Sequence: Synthetic oligonucleotide"
uccggugacguggcgucaga

SEQ ID NO: 6509 - RNA, 20 nt, Artificial Sequence
  source: /note="Description of Artificial Sequence: Synthetic oligonucleotide"
guccggugacguggcgucag

SEQ ID NO: 6510 - RNA, 20 nt, Artificial Sequence
  source: /note="Description of Artificial Sequence: Synthetic oligonucleotide"
ccgacgucacucggaguuag

SEQ ID NO: 6511 - RNA, 20 nt, Artificial Sequence
  source: /note="Description of Artificial Sequence: Synthetic oligonucleotide"
guggacucggacccuucaac

SEQ ID NO: 6512 - RNA, 20 nt, Artificial Sequence
  source: /note="Description of Artificial Sequence: Synthetic oligonucleotide"
acccuccuaguggacucgga

SEQ ID NO: 6513 - RNA, 20 nt, Artificial Sequence
  source: /note="Description of Artificial Sequence: Synthetic oligonucleotide"
cacccuccuaguggacucgg

SEQ ID NO: 6514 - RNA, 20 nt, Artificial Sequence
  source: /note="Description of Artificial Sequence: Synthetic oligonucleotide"
ugagaccuucgacuccaccc

SEQ ID NO: 6515 - RNA, 20 nt, Artificial Sequence
  source: /note="Description of Artificial Sequence: Synthetic oligonucleotide"
cgaugagaccuucgacucca

SEQ ID NO: 6516 - RNA, 20 nt, Artificial Sequence
  source: /note="Description of Artificial Sequence: Synthetic oligonucleotide"
ucgaugagaccuucgacucc

SEQ ID NO: 6517 - RNA, 20 nt, Artificial Sequence
  source: /note="Description of Artificial Sequence: Synthetic oligonucleotide"
gagucgaugagaccuucgac

SEQ ID NO: 6518 - RNA, 20 nt, Artificial Sequence
  source: /note="Description of Artificial Sequence: Synthetic oligonucleotide"
gggacaccagagucgaugag

SEQ ID NO: 6519 - RNA, 20 nt, Artificial Sequence
  source: /note="Description of Artificial Sequence: Synthetic oligonucleotide"
ccccaccaccguacggggac

SEQ ID NO: 6520 - RNA, 20 nt, Artificial Sequence
  source: /note="Description of Artificial Sequence: Synthetic oligonucleotide"
uuuuuuaaucgguccccacc

SEQ ID NO: 6521 - RNA, 20 nt, Artificial Sequence
  source: /note="Description of Artificial Sequence: Synthetic oligonucleotide"
auguuuuuuaaucggucccc

SEQ ID NO: 6522 - RNA, 20 nt, Artificial Sequence
  source: /note="Description of Artificial Sequence: Synthetic oligonucleotide"
uuuauguuuuuuaaucgguc

SEQ ID NO: 6523 - RNA, 20 nt, Artificial Sequence
  source: /note="Description of Artificial Sequence: Synthetic oligonucleotide"
uuuuauguuuuuuaaucggu

SEQ ID NO: 6524 - RNA, 20 nt, Artificial Sequence
  source: /note="Description of Artificial Sequence: Synthetic oligonucleotide"
uuuuuauguuuuuuaaucgg

SEQ ID NO: 6525 - RNA, 20 nt, Artificial Sequence
  source: /note="Description of Artificial Sequence: Synthetic oligonucleotide"
acgcuugucggacccguugu

SEQ ID NO: 6526 - RNA, 20 nt, Artificial Sequence
  source: /note="Description of Artificial Sequence: Synthetic oligonucleotide"
guccucaaacgcuugucgga

SEQ ID NO: 6527 - RNA, 20 nt, Artificial Sequence
  source: /note="Description of Artificial Sequence: Synthetic oligonucleotide"
gguccucaaacgcuugucgg

SEQ ID NO: 6528 - RNA, 20 nt, Artificial Sequence
  source: /note="Description of Artificial Sequence: Synthetic oligonucleotide"
guccaccuaacgaacuccgg

SEQ ID NO: 6529 - RNA, 20 nt, Artificial Sequence
  source: /note="Description of Artificial Sequence: Synthetic oligonucleotide"
gcuccguccaccuaacgaac

SEQ ID NO: 6530 - RNA, 20 nt, Artificial Sequence
  source: /note="Description of Artificial Sequence: Synthetic oligonucleotide"
gaaacccuucggcuccgucc

SEQ ID NO: 6531 - RNA, 20 nt, Artificial Sequence
  source: /note="Description of Artificial Sequence: Synthetic oligonucleotide"
cgugaaacccuucggcuccg

SEQ ID NO: 6532 - RNA, 20 nt, Artificial Sequence
  source: /note="Description of Artificial Sequence: Synthetic oligonucleotide"
aggucgugaaacccuucggc

SEQ ID NO: 6533 - RNA, 20 nt, Artificial Sequence
  source: /note="Description of Artificial Sequence: Synthetic oligonucleotide"
aggguauuaaggucgugaaa

SEQ ID NO: 6534 - RNA, 20 nt, Artificial Sequence
  source: /note="Description of Artificial Sequence: Synthetic oligonucleotide"
aaggguauuaaggucgugaa

SEQ ID NO: 6535 - RNA, 20 nt, Artificial Sequence
  source: /note="Description of Artificial Sequence: Synthetic oligonucleotide"
gauuccggaggccgacccac

SEQ ID NO: 6536 - RNA, 20 nt, Artificial Sequence
  source: /note="Description of Artificial Sequence: Synthetic oligonucleotide"
cuaaagauuccggaggccga

SEQ ID NO: 6537 - RNA, 20 nt, Artificial Sequence
  source: /note="Description of Artificial Sequence: Synthetic oligonucleotide"
ucuaaagauuccggaggccg

SEQ ID NO: 6538 - RNA, 20 nt, Artificial Sequence
  source: /note="Description of Artificial Sequence: Synthetic oligonucleotide"
guaaucuaaagauuccggag

SEQ ID NO: 6539 - RNA, 20 nt, Artificial Sequence
  source: /note="Description of Artificial Sequence: Synthetic oligonucleotide"
gguaaucuaaagauuccgga

SEQ ID NO: 6540 - RNA, 20 nt, Artificial Sequence
  source: /note="Description of Artificial Sequence: Synthetic oligonucleotide"
ugguaaucuaaagauuccgg

SEQ ID NO: 6541 - RNA, 20 nt, Artificial Sequence
  source: /note="Description of Artificial Sequence: Synthetic oligonucleotide"
aguugguaaucuaaagauuc

SEQ ID NO: 6542 - RNA, 20 nt, Artificial Sequence
  source: /note="Description of Artificial Sequence: Synthetic oligonucleotide"
aaaaccuggaagacagaagu

SEQ ID NO: 6543 - RNA, 20 nt, Artificial Sequence
  source: /note="Description of Artificial Sequence: Synthetic oligonucleotide"
uuuccaaggacauaaaaacc

SEQ ID NO: 6544 - RNA, 20 nt, Artificial Sequence
  source: /note="Description of Artificial Sequence: Synthetic oligonucleotide"
aaaauaugcauaaauuucca

SEQ ID NO: 6545 - RNA, 20 nt, Artificial Sequence
  source: /note="Description of Artificial Sequence: Synthetic oligonucleotide"
auuaggaagaagaugaggau

SEQ ID NO: 6546 - RNA, 20 nt, Artificial Sequence
  source: /note="Description of Artificial Sequence: Synthetic oligonucleotide"
gauuaggaagaagaugagga

SEQ ID NO: 6547 - RNA, 20 nt, Artificial Sequence
  source: /note="Description of Artificial Sequence: Synthetic oligonucleotide"
caaggauuaggaagaagaug

SEQ ID NO: 6548 - RNA, 20 nt, Artificial Sequence
  source: /note="Description of Artificial Sequence: Synthetic oligonucleotide"
uucacaauaugucaaggauu

SEQ ID NO: 6549 - RNA, 20 nt, Artificial Sequence
  source: /note="Description of Artificial Sequence: Synthetic oligonucleotide"
ucuguguucacaauauguca

SEQ ID NO: 6550 - RNA, 20 nt, Artificial Sequence
  source: /note="Description of Artificial Sequence: Synthetic oligonucleotide"
uuaaguauauuuguaacuca

SEQ ID NO: 6551 - RNA, 20 nt, Artificial Sequence
  source: /note="Description of Artificial Sequence: Synthetic oligonucleotide"
uuuaaguauauuuguaacuc

SEQ ID NO: 6552 - RNA, 20 nt, Artificial Sequence
  source: /note="Description of Artificial Sequence: Synthetic oligonucleotide"
gaguccgaaaaguuuccacu

SEQ ID NO: 6553 - RNA, 20 nt, Artificial Sequence
  source: /note="Description of Artificial Sequence: Synthetic oligonucleotide"
cgaguccgaaaaguuuccac

SEQ ID NO: 6554 - RNA, 20 nt, Artificial Sequence
  source: /note="Description of Artificial Sequence: Synthetic oligonucleotide"
gucuccgaguccgaaaaguu

SEQ ID NO: 6555 - RNA, 20 nt, Artificial Sequence
  source: /note="Description of Artificial Sequence: Synthetic oligonucleotide"
uagaguguagagucuccgag

SEQ ID NO: 6556 - RNA, 20 nt, Artificial Sequence
  source: /note="Description of Artificial Sequence: Synthetic oligonucleotide"
cgucaguagaguguagaguc

SEQ ID NO: 6557 - RNA, 20 nt, Artificial Sequence
  source: /note="Description of Artificial Sequence: Synthetic oligonucleotide"
ccuucgcuggauccuaaauc

SEQ ID NO: 6558 - RNA, 20 nt, Artificial Sequence
  source: /note="Description of Artificial Sequence: Synthetic oligonucleotide"
guucaucacccuucgcugga

SEQ ID NO: 6559 - RNA, 20 nt, Artificial Sequence
  source: /note="Description of Artificial Sequence: Synthetic oligonucleotide"
uuaggguaguauguucauca

SEQ ID NO: 6560 - RNA, 20 nt, Artificial Sequence
  source: /note="Description of Artificial Sequence: Synthetic oligonucleotide"
uuuaggguaguauguucauc

SEQ ID NO: 6561 - RNA, 20 nt, Artificial Sequence
  source: /note="Description of Artificial Sequence: Synthetic oligonucleotide"
ugcgaauuacagauuuuuua

SEQ ID NO: 6562 - RNA, 20 nt, Artificial Sequence
  source: /note="Description of Artificial Sequence: Synthetic oligonucleotide"
uugcgaauuacagauuuuuu

SEQ ID NO: 6563 - RNA, 20 nt, Artificial Sequence
  source: /note="Description of Artificial Sequence: Synthetic oligonucleotide"
ccaaaaaaugacugccuuua

SEQ ID NO: 6564 - RNA, 20 nt, Artificial Sequence
  source: /note="Description of Artificial Sequence: Synthetic oligonucleotide"
ugcaaaaugagggcucacug

SEQ ID NO: 6565 - RNA, 20 nt, Artificial Sequence
  source: /note="Description of Artificial Sequence: Synthetic oligonucleotide"
aggcauauguugcaaaauga

SEQ ID NO: 6566 - RNA, 20 nt, Artificial Sequence
  source: /note="Description of Artificial Sequence: Synthetic oligonucleotide"
uaggcauauguugcaaaaug

SEQ ID NO: 6567 - RNA, 20 nt, Artificial Sequence
  source: /note="Description of Artificial Sequence: Synthetic oligonucleotide"
gcaagccagauaugaaaagu

SEQ ID NO: 6568 - RNA, 20 nt, Artificial Sequence
  source: /note="Description of Artificial Sequence: Synthetic oligonucleotide"
auuaaauuauaaauaauaaa

SEQ ID NO: 6569 - RNA, 20 nt, Artificial Sequence
  source: /note="Description of Artificial Sequence: Synthetic oligonucleotide"
uuacaaaacuauggaaagag

SEQ ID NO: 6570 - RNA, 20 nt, Artificial Sequence
  source: /note="Description of Artificial Sequence: Synthetic oligonucleotide"
gcaauucuauuacaaaacua

SEQ ID NO: 6571 - RNA, 20 nt, Artificial Sequence
  source: /note="Description of Artificial Sequence: Synthetic oligonucleotide"
cucauacucugcccuguucc

SEQ ID NO: 6572 - RNA, 20 nt, Artificial Sequence
  source: /note="Description of Artificial Sequence: Synthetic oligonucleotide"
acauuuaaaaauauuugguc

SEQ ID NO: 6573 - RNA, 20 nt, Artificial Sequence
  source: /note="Description of Artificial Sequence: Synthetic oligonucleotide"
uuaagacauuuaaaaauauu

SEQ ID NO: 6574 - RNA, 20 nt, Artificial Sequence
  source: /note="Description of Artificial Sequence: Synthetic oligonucleotide"
guacacgguucgugucacaa

SEQ ID NO: 6575 - RNA, 20 nt, Artificial Sequence
  source: /note="Description of Artificial Sequence: Synthetic oligonucleotide"
cuuacguaaaaaugucuuaa

SEQ ID NO: 6576 - RNA, 20 nt, Artificial Sequence
  source: /note="Description of Artificial Sequence: Synthetic oligonucleotide"
cuuaguaaagcauaaucaua

SEQ ID NO: 6577 - RNA, 20 nt, Artificial Sequence
  source: /note="Description of Artificial Sequence: Synthetic oligonucleotide"
ccacauggucaauguaggaa

SEQ ID NO: 6578 - RNA, 20 nt, Artificial Sequence
  source: /note="Description of Artificial Sequence: Synthetic oligonucleotide"
ugaguccacauggucaaugu

SEQ ID NO: 6579 - RNA, 20 nt, Artificial Sequence
  source: /note="Description of Artificial Sequence: Synthetic oligonucleotide"
aggccaaauaugaguccaca

SEQ ID NO: 6580 - RNA, 20 nt, Artificial Sequence
  source: /note="Description of Artificial Sequence: Synthetic oligonucleotide"
uuauucuaauguaauuauau

SEQ ID NO: 6581 - RNA, 20 nt, Artificial Sequence
  source: /note="Description of Artificial Sequence: Synthetic oligonucleotide"
cuacuuccuuuuccaacuuu

SEQ ID NO: 6582 - RNA, 20 nt, Artificial Sequence
  source: /note="Description of Artificial Sequence: Synthetic oligonucleotide"
uucuguguaauguaauguau

SEQ ID NO: 6583 - RNA, 20 nt, Artificial Sequence
  source: /note="Description of Artificial Sequence: Synthetic oligonucleotide"
aauguauuguauacaaagcc

SEQ ID NO: 6584 - RNA, 20 nt, Artificial Sequence
  source: /note="Description of Artificial Sequence: Synthetic oligonucleotide"
uucuguguaauguaauguau

SEQ ID NO: 6585 - RNA, 20 nt, Artificial Sequence
  source: /note="Description of Artificial Sequence: Synthetic oligonucleotide"
aauguauuguauacaaagcc

SEQ ID NO: 6586 - RNA, 20 nt, Artificial Sequence
  source: /note="Description of Artificial Sequence: Synthetic oligonucleotide"
uucuguguaauguaauguau

SEQ ID NO: 6587 - RNA, 20 nt, Artificial Sequence
  source: /note="Description of Artificial Sequence: Synthetic oligonucleotide"
uagauguguuucccaaagcc

SEQ ID NO: 6588 - RNA, 20 nt, Artificial Sequence
  source: /note="Description of Artificial Sequence: Synthetic oligonucleotide"
uugugcuauguuaagaguuu

SEQ ID NO: 6589 - RNA, 20 nt, Artificial Sequence
  source: /note="Description of Artificial Sequence: Synthetic oligonucleotide"
ucuugguauuaccuaccgua

SEQ ID NO: 6590 - RNA, 20 nt, Artificial Sequence
  source: /note="Description of Artificial Sequence: Synthetic oligonucleotide"
auaacggcccugauuugucu

SEQ ID NO: 6591 - RNA, 20 nt, Artificial Sequence
  source: /note="Description of Artificial Sequence: Synthetic oligonucleotide"
uuccucaagguuguuaauaa

SEQ ID NO: 6592 - RNA, 20 nt, Artificial Sequence
  source: /note="Description of Artificial Sequence: Synthetic oligonucleotide"
uuucccaagacauuuccuca

SEQ ID NO: 6593 - RNA, 20 nt, Artificial Sequence
  source: /note="Description of Artificial Sequence: Synthetic oligonucleotide"
aguuugggaugacuucacag

SEQ ID NO: 6594 - RNA, 20 nt, Artificial Sequence
  source: /note="Description of Artificial Sequence: Synthetic oligonucleotide"
aaauuugccucgaagaguuu

SEQ ID NO: 6595 - RNA, 20 nt, Artificial Sequence
  source: /note="Description of Artificial Sequence: Synthetic oligonucleotide"
uaaauuugccucgaagaguu

SEQ ID NO: 6596 - RNA, 20 nt, Artificial Sequence
  source: /note="Description of Artificial Sequence: Synthetic oligonucleotide"
cauuaaaaaacagggguggg

SEQ ID NO: 6597 - RNA, 20 nt, Artificial Sequence
  source: /note="Description of Artificial Sequence: Synthetic oligonucleotide"
aaacauuaaaaaacaggggu

SEQ ID NO: 6598 - RNA, 20 nt, Artificial Sequence
  source: /note="Description of Artificial Sequence: Synthetic oligonucleotide"
gaaacauuaaaaaacagggg

SEQ ID NO: 6599 - RNA, 20 nt, Artificial Sequence
  source: /note="Description of Artificial Sequence: Synthetic oligonucleotide"
uuagaaacauuaaaaaacag

SEQ ID NO: 6600 - RNA, 20 nt, Artificial Sequence
  source: /note="Description of Artificial Sequence: Synthetic oligonucleotide"
uuuagaaacauuaaaaaaca

SEQ ID NO: 6601 - RNA, 20 nt, Artificial Sequence
  source: /note="Description of Artificial Sequence: Synthetic oligonucleotide"
cuuuagaaacauuaaaaaac

SEQ ID NO: 6602 - RNA, 20 nt, Artificial Sequence
  source: /note="Description of Artificial Sequence: Synthetic oligonucleotide"
guccguacucggugacguga

SEQ ID NO: 6603 - RNA, 20 nt, Artificial Sequence
  source: /note="Description of Artificial Sequence: Synthetic oligonucleotide"
aggguuucacgacgcuaaug

SEQ ID NO: 6604 - RNA, 20 nt, Artificial Sequence
  source: /note="Description of Artificial Sequence: Synthetic oligonucleotide"
gaguccauuagaugggcgga

SEQ ID NO: 6605 - RNA, 20 nt, Artificial Sequence
  source: /note="Description of Artificial Sequence: Synthetic oligonucleotide"
ccagaguuugaggacuggag

SEQ ID NO: 6606 - RNA, 20 nt, Artificial Sequence
  source: /note="Description of Artificial Sequence: Synthetic oligonucleotide"
aaagcgguauaaccgauccg

SEQ ID NO: 6607 - RNA, 20 nt, Artificial Sequence
  source: /note="Description of Artificial Sequence: Synthetic oligonucleotide"
ucccaaagcgguauaaccga

SEQ ID NO: 6608 - RNA, 20 nt, Artificial Sequence
  source: /note="Description of Artificial Sequence: Synthetic oligonucleotide"
aucucucccaaagcgguaua

SEQ ID NO: 6609 - RNA, 20 nt, Artificial Sequence
  source: /note="Description of Artificial Sequence: Synthetic oligonucleotide"
aaaacauaaaaaucaucucu

SEQ ID NO: 6610 - RNA, 20 nt, Artificial Sequence
  source: /note="Description of Artificial Sequence: Synthetic oligonucleotide"
aaaaacauaaaaaucaucuc

SEQ ID NO: 6611 - RNA, 20 nt, Artificial Sequence
  source: /note="Description of Artificial Sequence: Synthetic oligonucleotide"
guccgugaacggugaugcgg

SEQ ID NO: 6612 - RNA, 20 nt, Artificial Sequence
  source: /note="Description of Artificial Sequence: Synthetic oligonucleotide"
aggacucaucgacccuaaug

SEQ ID NO: 6613 - RNA, 20 nt, Artificial Sequence
  source: /note="Description of Artificial Sequence: Synthetic oligonucleotide"
ggagucggaggacucaucga

SEQ ID NO: 6614 - RNA, 20 nt, Artificial Sequence
  source: /note="Description of Artificial Sequence: Synthetic oligonucleotide"
cggagucggaggacucaucg

SEQ ID NO: 6615 - RNA, 20 nt, Artificial Sequence
  source: /note="Description of Artificial Sequence: Synthetic oligonucleotide"
agugacguuggagcggaggg

SEQ ID NO: 6616 - RNA, 20 nt, Artificial Sequence
  source: /note="Description of Artificial Sequence: Synthetic oligonucleotide"
gagugacguuggagcggagg

SEQ ID NO: 6617 - RNA, 20 nt, Artificial Sequence
  source: /note="Description of Artificial Sequence: Synthetic oligonucleotide"
agagugaggcagcggguccg

SEQ ID NO: 6618 - RNA, 20 nt, Artificial Sequence
  source: /note="Description of Artificial Sequence: Synthetic oligonucleotide"
ccucagagugaggcagcggg

SEQ ID NO: 6619 - RNA, 20 nt, Artificial Sequence
  source: /note="Description of Artificial Sequence: Synthetic oligonucleotide"
aaacaaaaacaaaaaacucu

SEQ ID NO: 6620 - RNA, 20 nt, Artificial Sequence
  source: /note="Description of Artificial Sequence: Synthetic oligonucleotide"
caauauaaaaaaaaaaaaaa

SEQ ID NO: 6621 - RNA, 20 nt, Artificial Sequence
  source: /note="Description of Artificial Sequence: Synthetic oligonucleotide"
auucaagauucuuguccuug

SEQ ID NO: 6622 - RNA, 20 nt, Artificial Sequence
  source: /note="Description of Artificial Sequence: Synthetic oligonucleotide"
uaaguaccucauaugcacua

SEQ ID NO: 6623 - RNA, 20 nt, Artificial Sequence
  source: /note="Description of Artificial Sequence: Synthetic oligonucleotide"
acaugaugucuaauauuuuu

SEQ ID NO: 6624 - RNA, 20 nt, Artificial Sequence
  source: /note="Description of Artificial Sequence: Synthetic oligonucleotide"
auacuuuuucuaucaacugu

SEQ ID NO: 6625 - RNA, 20 nt, Artificial Sequence
  source: /note="Description of Artificial Sequence: Synthetic oligonucleotide"
uuugaaacaguuuucuccau

SEQ ID NO: 6626 - RNA, 20 nt, Artificial Sequence
  source: /note="Description of Artificial Sequence: Synthetic oligonucleotide"
auauuucguuucuuuuucuu

SEQ ID NO: 6627 - RNA, 20 nt, Artificial Sequence
  source: /note="Description of Artificial Sequence: Synthetic oligonucleotide"
aauauuucguuucuuuuucu

SEQ ID NO: 6628 - RNA, 20 nt, Artificial Sequence
  source: /note="Description of Artificial Sequence: Synthetic oligonucleotide"
ugacgauuucaguagaguuc

SEQ ID NO: 6629 - RNA, 20 nt, Artificial Sequence
  source: /note="Description of Artificial Sequence: Synthetic oligonucleotide"
gaucucacguaccacaaggu

SEQ ID NO: 6630 - RNA, 20 nt, Artificial Sequence
  source: /note="Description of Artificial Sequence: Synthetic oligonucleotide"
ggaucucacguaccacaagg

SEQ ID NO: 6631 - RNA, 20 nt, Artificial Sequence
  source: /note="Description of Artificial Sequence: Synthetic oligonucleotide"
uaaucuuuuggaucucacgu

SEQ ID NO: 6632 - RNA, 20 nt, Artificial Sequence
  source: /note="Description of Artificial Sequence: Synthetic oligonucleotide"
gugauugaaucacauguguc

SEQ ID NO: 6633 - RNA, 20 nt, Artificial Sequence
  source: /note="Description of Artificial Sequence: Synthetic oligonucleotide"
agaucacuuaucguuuugau

SEQ ID NO: 6634 - RNA, 20 nt, Artificial Sequence
  source: /note="Description of Artificial Sequence: Synthetic oligonucleotide"
uuuagauucucauccaagga

SEQ ID NO: 6635 - RNA, 20 nt, Artificial Sequence
  source: /note="Description of Artificial Sequence: Synthetic oligonucleotide"
ccgaauuauuuagauucuca

SEQ ID NO: 6636 - RNA, 20 nt, Artificial Sequence
  source: /note="Description of Artificial Sequence: Synthetic oligonucleotide"
uuauuguuuuauauauauca

SEQ ID NO: 6637 - RNA, 20 nt, Artificial Sequence
  source: /note="Description of Artificial Sequence: Synthetic oligonucleotide"
uucguuuaaauucguuucuu

SEQ ID NO: 6638 - RNA, 20 nt, Artificial Sequence
  source: /note="Description of Artificial Sequence: Synthetic oligonucleotide"
cauaagguuuagugauuaaa

SEQ ID NO: 6639 - RNA, 20 nt, Artificial Sequence
  source: /note="Description of Artificial Sequence: Synthetic oligonucleotide"
uucguggagaguuuuacgua

SEQ ID NO: 6640 - RNA, 20 nt, Artificial Sequence
  source: /note="Description of Artificial Sequence: Synthetic oligonucleotide"
cuuucguuucgaaacuuuau

SEQ ID NO: 6641 - RNA, 20 nt, Artificial Sequence
  source: /note="Description of Artificial Sequence: Synthetic oligonucleotide"
aaauaauaaagcuagucaag

SEQ ID NO: 6642 - RNA, 20 nt, Artificial Sequence
  source: /note="Description of Artificial Sequence: Synthetic oligonucleotide"
aaguuaaggaaaauauuguu

SEQ ID NO: 6643 - RNA, 20 nt, Artificial Sequence
  source: /note="Description of Artificial Sequence: Synthetic oligonucleotide"
aggcuaaaauuaagaaguua

SEQ ID NO: 6644 - RNA, 20 nt, Artificial Sequence
  source: /note="Description of Artificial Sequence: Synthetic oligonucleotide"
aaaugauuaacuuggaaaac

SEQ ID NO: 6645 - RNA, 20 nt, Artificial Sequence
  source: /note="Description of Artificial Sequence: Synthetic oligonucleotide"
caacagauaaaugauuaacu

SEQ ID NO: 6646 - RNA, 20 nt, Artificial Sequence
  source: /note="Description of Artificial Sequence: Synthetic oligonucleotide"
cugacaaagaaaauuuucuu

SEQ ID NO: 6647 - RNA, 20 nt, Artificial Sequence
  source: /note="Description of Artificial Sequence: Synthetic oligonucleotide"
uaguaccuauuggguugggg

SEQ ID NO: 6648 - RNA, 20 nt, Artificial Sequence
  source: /note="Description of Artificial Sequence: Synthetic oligonucleotide"
auaguaccuauuggguuggg

SEQ ID NO: 6649 - RNA, 20 nt, Artificial Sequence
  source: /note="Description of Artificial Sequence: Synthetic oligonucleotide"
aauaguaccuauuggguugg

SEQ ID NO: 6650 - RNA, 20 nt, Artificial Sequence
  source: /note="Description of Artificial Sequence: Synthetic oligonucleotide"
gaauaguaccuauuggguug

SEQ ID NO: 6651 - RNA, 20 nt, Artificial Sequence
  source: /note="Description of Artificial Sequence: Synthetic oligonucleotide"
agaauaguaccuauuggguu

SEQ ID NO: 6652 - RNA, 20 nt, Artificial Sequence
  source: /note="Description of Artificial Sequence: Synthetic oligonucleotide"
cagaauaguaccuauugggu

SEQ ID NO: 6653 - RNA, 20 nt, Artificial Sequence
  source: /note="Description of Artificial Sequence: Synthetic oligonucleotide"
aaaucagaauaguaccuauu

SEQ ID NO: 6654 - RNA, 20 nt, Artificial Sequence
  source: /note="Description of Artificial Sequence: Synthetic oligonucleotide"
caaaucagaauaguaccuau

SEQ ID NO: 6655 - RNA, 20 nt, Artificial Sequence
  source: /note="Description of Artificial Sequence: Synthetic oligonucleotide"
uccuucaagaaugugugaau

SEQ ID NO: 6656 - RNA, 20 nt, Artificial Sequence
  source: /note="Description of Artificial Sequence: Synthetic oligonucleotide"
aaauuauauuauaauuuugu

SEQ ID NO: 6657 - RNA, 20 nt, Artificial Sequence
  source: /note="Description of Artificial Sequence: Synthetic oligonucleotide"
aaaauuauauuauaauuuug

SEQ ID NO: 6658 - RNA, 20 nt, Artificial Sequence
  source: /note="Description of Artificial Sequence: Synthetic oligonucleotide"
gacgguaacgugaggucgga

SEQ ID NO: 6659 - RNA, 20 nt, Artificial Sequence
  source: /note="Description of Artificial Sequence: Synthetic oligonucleotide"
gagaacuuuggcccuccgcc

SEQ ID NO: 6660 - RNA, 20 nt, Artificial Sequence
  source: /note="Description of Artificial Sequence: Synthetic oligonucleotide"
uuagagaacuuuggcccucc

SEQ ID NO: 6661 - RNA, 20 nt, Artificial Sequence
  source: /note="Description of Artificial Sequence: Synthetic oligonucleotide"
cucuuagagaacuuuggccc

SEQ ID NO: 6662 - RNA, 20 nt, Artificial Sequence
  source: /note="Description of Artificial Sequence: Synthetic oligonucleotide"
guccucuuagagaacuuugg

SEQ ID NO: 6663 - RNA, 20 nt, Artificial Sequence
  source: /note="Description of Artificial Sequence: Synthetic oligonucleotide"
cguccucuuagagaacuuug

SEQ ID NO: 6664 - RNA, 20 nt, Artificial Sequence
  source: /note="Description of Artificial Sequence: Synthetic oligonucleotide"
cgaugagcccuccgacuccg

SEQ ID NO: 6665 - RNA, 20 nt, Artificial Sequence
  source: /note="Description of Artificial Sequence: Synthetic oligonucleotide"
gggucgaugagcccuccgac

SEQ ID NO: 6666 - RNA, 20 nt, Artificial Sequence
  source: /note="Description of Artificial Sequence: Synthetic oligonucleotide"
auauuagggucgaugagccc

SEQ ID NO: 6667 - RNA, 20 nt, Artificial Sequence
  source: /note="Description of Artificial Sequence: Synthetic oligonucleotide"
cggauauuagggucgaugag

SEQ ID NO: 6668 - RNA, 20 nt, Artificial Sequence
  source: /note="Description of Artificial Sequence: Synthetic oligonucleotide"
acggauauuagggucgauga

SEQ ID NO: 6669 - RNA, 20 nt, Artificial Sequence
  source: /note="Description of Artificial Sequence: Synthetic oligonucleotide"
uuuuuuaaucgguccucacc

SEQ ID NO: 6670 - RNA, 20 nt, Artificial Sequence
  source: /note="Description of Artificial Sequence: Synthetic oligonucleotide"
ucuuuuuuuaaucgguccuc

SEQ ID NO: 6671 - RNA, 20 nt, Artificial Sequence
  source: /note="Description of Artificial Sequence: Synthetic oligonucleotide"
uuuuaucuuuuuuuaaucgg

SEQ ID NO: 6672 - RNA, 20 nt, Artificial Sequence
  source: /note="Description of Artificial Sequence: Synthetic oligonucleotide"
acucuggccggacugguugu

SEQ ID NO: 6673 - RNA, 20 nt, Artificial Sequence
  source: /note="Description of Artificial Sequence: Synthetic oligonucleotide"
acuccaacccucaaacucug

SEQ ID NO: 6674 - RNA, 20 nt, Artificial Sequence
  source: /note="Description of Artificial Sequence: Synthetic oligonucleotide"
guccaccuaguggacuccaa

SEQ ID NO: 6675 - RNA, 20 nt, Artificial Sequence
  source: /note="Description of Artificial Sequence: Synthetic oligonucleotide"
cguccaccuaguggacucca

SEQ ID NO: 6676 - RNA, 20 nt, Artificial Sequence
  source: /note="Description of Artificial Sequence: Synthetic oligonucleotide"
acuucguccaccuaguggac

SEQ ID NO: 6677 - RNA, 20 nt, Artificial Sequence
  source: /note="Description of Artificial Sequence: Synthetic oligonucleotide"
gaaauccuccgacuucgucc

SEQ ID NO: 6678 - RNA, 20 nt, Artificial Sequence
  source: /note="Description of Artificial Sequence: Synthetic oligonucleotide"
cgugaaauccuccgacuucg

SEQ ID NO: 6679 - RNA, 20 nt, Artificial Sequence
  source: /note="Description of Artificial Sequence: Synthetic oligonucleotide"
acauuaggaucgugaaaucc

SEQ ID NO: 6680 - RNA, 20 nt, Artificial Sequence
  source: /note="Description of Artificial Sequence: Synthetic oligonucleotide"
cggacauuaggaucgugaaa

SEQ ID NO: 6681 - RNA, 20 nt, Artificial Sequence
  source: /note="Description of Artificial Sequence: Synthetic oligonucleotide"
auguuuucccgacccacacc

SEQ ID NO: 6682 - RNA, 20 nt, Artificial Sequence
  source: /note="Description of Artificial Sequence: Synthetic oligonucleotide"
auaauguuuucccgacccac

SEQ ID NO: 6683 - RNA, 20 nt, Artificial Sequence
  source: /note="Description of Artificial Sequence: Synthetic oligonucleotide"
uuaagauaauguuuucccga

SEQ ID NO: 6684 - RNA, 20 nt, Artificial Sequence
  source: /note="Description of Artificial Sequence: Synthetic oligonucleotide"
auuaagauaauguuuucccg

SEQ ID NO: 6685 - RNA, 20 nt, Artificial Sequence
  source: /note="Description of Artificial Sequence: Synthetic oligonucleotide"
cuccauuaagauaauguuuu

SEQ ID NO: 6686 - RNA, 20 nt, Artificial Sequence
  source: /note="Description of Artificial Sequence: Synthetic oligonucleotide"
aaggguguggguuguggggu

SEQ ID NO: 6687 - RNA, 20 nt, Artificial Sequence
  source: /note="Description of Artificial Sequence: Synthetic oligonucleotide"
aaaggguguggguugugggg

SEQ ID NO: 6688 - RNA, 20 nt, Artificial Sequence
  source: /note="Description of Artificial Sequence: Synthetic oligonucleotide"
uacaaaggguguggguugug

SEQ ID NO: 6689 - RNA, 20 nt, Artificial Sequence
  source: /note="Description of Artificial Sequence: Synthetic oligonucleotide"
auacaaaggguguggguugu

SEQ ID NO: 6690 - RNA, 20 nt, Artificial Sequence
  source: /note="Description of Artificial Sequence: Synthetic oligonucleotide"
aauacaaaggguguggguug

SEQ ID NO: 6691 - RNA, 20 nt, Artificial Sequence
  source: /note="Description of Artificial Sequence: Synthetic oligonucleotide"
aagagaaauacaaagggugu

SEQ ID NO: 6692 - RNA, 20 nt, Artificial Sequence
  source: /note="Description of Artificial Sequence: Synthetic oligonucleotide"
aaagagaaauacaaagggug

SEQ ID NO: 6693 - RNA, 20 nt, Artificial Sequence
  source: /note="Description of Artificial Sequence: Synthetic oligonucleotide"
aaguaaaagagaaauacaaa

SEQ ID NO: 6694 - RNA, 20 nt, Artificial Sequence
  source: /note="Description of Artificial Sequence: Synthetic oligonucleotide"
caaguaaaagagaaauacaa

SEQ ID NO: 6695 - RNA, 20 nt, Artificial Sequence
  source: /note="Description of Artificial Sequence: Synthetic oligonucleotide"
aaacuauaaaucugaacuag

SEQ ID NO: 6696 - RNA, 20 nt, Artificial Sequence
  source: /note="Description of Artificial Sequence: Synthetic oligonucleotide"
gagcuguuccccaaccagau

SEQ ID NO: 6697 - RNA, 20 nt, Artificial Sequence
  source: /note="Description of Artificial Sequence: Synthetic oligonucleotide"
agagcuguuccccaaccaga

SEQ ID NO: 6698 - RNA, 20 nt, Artificial Sequence
  source: /note="Description of Artificial Sequence: Synthetic oligonucleotide"
ggaaagggagaggucccagu

SEQ ID NO: 6699 - RNA, 20 nt, Artificial Sequence
  source: /note="Description of Artificial Sequence: Synthetic oligonucleotide"
aggaaagggagaggucccag

SEQ ID NO: 6700 - RNA, 20 nt, Artificial Sequence
  source: /note="Description of Artificial Sequence: Synthetic oligonucleotide"
ucacucaugaggaaagggag

SEQ ID NO: 6701 - RNA, 20 nt, Artificial Sequence
  source: /note="Description of Artificial Sequence: Synthetic oligonucleotide"
uggcgucacucaugaggaaa

SEQ ID NO: 6702 - RNA, 20 nt, Artificial Sequence
  source: /note="Description of Artificial Sequence: Synthetic oligonucleotide"
cuggcgucacucaugaggaa

SEQ ID NO: 6703 - RNA, 20 nt, Artificial Sequence
  source: /note="Description of Artificial Sequence: Synthetic oligonucleotide"
ggacccuggcgucacucaug

SEQ ID NO: 6704 - RNA, 20 nt, Artificial Sequence
  source: /note="Description of Artificial Sequence: Synthetic oligonucleotide"
gcuuaugggcagcaggaccc

SEQ ID NO: 6705 - RNA, 20 nt, Artificial Sequence
  source: /note="Description of Artificial Sequence: Synthetic oligonucleotide"
acagaaugcuuaugggcagc

SEQ ID NO: 6706 - RNA, 20 nt, Artificial Sequence
  source: /note="Description of Artificial Sequence: Synthetic oligonucleotide"
ucagcaaacagaaugcuuau

SEQ ID NO: 6707 - RNA, 20 nt, Artificial Sequence
  source: /note="Description of Artificial Sequence: Synthetic oligonucleotide"
cucagcaaacagaaugcuua

SEQ ID NO: 6708 - RNA, 20 nt, Artificial Sequence
  source: /note="Description of Artificial Sequence: Synthetic oligonucleotide"
aaggcagcgaagcuggggaa

SEQ ID NO: 6709 - RNA, 20 nt, Artificial Sequence
  source: /note="Description of Artificial Sequence: Synthetic oligonucleotide"
agccaaaggcagcgaagcug

SEQ ID NO: 6710 - RNA, 20 nt, Artificial Sequence
  source: /note="Description of Artificial Sequence: Synthetic oligonucleotide"
cagccaaaggcagcgaagcu

SEQ ID NO: 6711 - RNA, 20 nt, Artificial Sequence
  source: /note="Description of Artificial Sequence: Synthetic oligonucleotide"
gcagccaaaggcagcgaagc

SEQ ID NO: 6712 - RNA, 20 nt, Artificial Sequence
  source: /note="Description of Artificial Sequence: Synthetic oligonucleotide"
cuuaaucacaaagcagccaa

SEQ ID NO: 6713 - RNA, 20 nt, Artificial Sequence
  source: /note="Description of Artificial Sequence: Synthetic oligonucleotide"
aaggaggcuuuaggaaacau

SEQ ID NO: 6714 - RNA, 20 nt, Artificial Sequence
  source: /note="Description of Artificial Sequence: Synthetic oligonucleotide"
gaaggaggcuuuaggaaaca

SEQ ID NO: 6715 - RNA, 20 nt, Artificial Sequence
  source: /note="Description of Artificial Sequence: Synthetic oligonucleotide"
cuaaaggcgaaggaggcuuu

SEQ ID NO: 6716 - RNA, 20 nt, Artificial Sequence
  source: /note="Description of Artificial Sequence: Synthetic oligonucleotide"
ucaaggacuaaaggcgaagg

SEQ ID NO: 6717 - RNA, 20 nt, Artificial Sequence
  source: /note="Description of Artificial Sequence: Synthetic oligonucleotide"
gcaucaaggacuaaaggcga

SEQ ID NO: 6718 - RNA, 20 nt, Artificial Sequence
  source: /note="Description of Artificial Sequence: Synthetic oligonucleotide"
uccccagcaucaaggacuaa

SEQ ID NO: 6719 - RNA, 20 nt, Artificial Sequence
  source: /note="Description of Artificial Sequence: Synthetic oligonucleotide"
ccaaaagguccccagcauca

SEQ ID NO: 6720 - RNA, 20 nt, Artificial Sequence
  source: /note="Description of Artificial Sequence: Synthetic oligonucleotide"
aagcugucuucccaaccaaa

SEQ ID NO: 6721 - RNA, 20 nt, Artificial Sequence
  source: /note="Description of Artificial Sequence: Synthetic oligonucleotide"
agcaggcucacccugacaua

SEQ ID NO: 6722 - RNA, 20 nt, Artificial Sequence
  source: /note="Description of Artificial Sequence: Synthetic oligonucleotide"
gaguuacauaccuguguagc

SEQ ID NO: 6723 - RNA, 20 nt, Artificial Sequence
  source: /note="Description of Artificial Sequence: Synthetic oligonucleotide"
cuaaacagaaacucaacagu

SEQ ID NO: 6724 - RNA, 20 nt, Artificial Sequence
  source: /note="Description of Artificial Sequence: Synthetic oligonucleotide"
uccacguuuguaccauuuga

SEQ ID NO: 6725 - RNA, 20 nt, Artificial Sequence
  source: /note="Description of Artificial Sequence: Synthetic oligonucleotide"
cuccacguuuguaccauuug

SEQ ID NO: 6726 - RNA, 20 nt, Artificial Sequence
  source: /note="Description of Artificial Sequence: Synthetic oligonucleotide"
agacaaaacuaacaggacaa

SEQ ID NO: 6727 - RNA, 20 nt, Artificial Sequence
  source: /note="Description of Artificial Sequence: Synthetic oligonucleotide"
cugugauagacaaaacuaac

SEQ ID NO: 6728 - RNA, 20 nt, Artificial Sequence
  source: /note="Description of Artificial Sequence: Synthetic oligonucleotide"
aucucuuauuuggagggcau

SEQ ID NO: 6729 - RNA, 20 nt, Artificial Sequence
  source: /note="Description of Artificial Sequence: Synthetic oligonucleotide"
caucucuuauuuggagggca

SEQ ID NO: 6730 - RNA, 20 nt, Artificial Sequence
  source: /note="Description of Artificial Sequence: Synthetic oligonucleotide"
uccaucaucucuuauuugga

SEQ ID NO: 6731 - RNA, 20 nt, Artificial Sequence
  source: /note="Description of Artificial Sequence: Synthetic oligonucleotide"
cuccaucaucucuuauuugg

SEQ ID NO: 6732 - RNA, 20 nt, Artificial Sequence
  source: /note="Description of Artificial Sequence: Synthetic oligonucleotide"
cugcuccaucaucucuuauu

SEQ ID NO: 6733 - RNA, 20 nt, Artificial Sequence
  source: /note="Description of Artificial Sequence: Synthetic oligonucleotide"
cccucuuuuaaagucaguug

SEQ ID NO: 6734 - RNA, 20 nt, Artificial Sequence
  source: /note="Description of Artificial Sequence: Synthetic oligonucleotide"
uaccuuaucacggucgacuc

SEQ ID NO: 6735 - RNA, 20 nt, Artificial Sequence
  source: /note="Description of Artificial Sequence: Synthetic oligonucleotide"
gguaaucgugauuuuauggu

SEQ ID NO: 6736 - RNA, 20 nt, Artificial Sequence
  source: /note="Description of Artificial Sequence: Synthetic oligonucleotide"
uggaggacuuguagacuagc

SEQ ID NO: 6737 - RNA, 20 nt, Artificial Sequence
  source: /note="Description of Artificial Sequence: Synthetic oligonucleotide"
caugaacaaaaucaggcugg

SEQ ID NO: 6738 - RNA, 20 nt, Artificial Sequence
  source: /note="Description of Artificial Sequence: Synthetic oligonucleotide"
guucaugaacaaaaucaggc

SEQ ID NO: 6739 - RNA, 20 nt, Artificial Sequence
  source: /note="Description of Artificial Sequence: Synthetic oligonucleotide"
ucauguucaugaacaaaauc

SEQ ID NO: 6740 - RNA, 20 nt, Artificial Sequence
  source: /note="Description of Artificial Sequence: Synthetic oligonucleotide"
aaagcaguauccaauauuaa

SEQ ID NO: 6741 - RNA, 20 nt, Artificial Sequence
  source: /note="Description of Artificial Sequence: Synthetic oligonucleotide"
uauuuuuguucuugcgagac

SEQ ID NO: 6742 - RNA, 20 nt, Artificial Sequence
  source: /note="Description of Artificial Sequence: Synthetic oligonucleotide"
caaacuuguuuuauaugacu

SEQ ID NO: 6743 - RNA, 20 nt, Artificial Sequence
  source: /note="Description of Artificial Sequence: Synthetic oligonucleotide"
cauuuccauauauuaauguu

SEQ ID NO: 6744 - RNA, 20 nt, Artificial Sequence
  source: /note="Description of Artificial Sequence: Synthetic oligonucleotide"
gagaaucuuauaaaagcaac

SEQ ID NO: 6745 - RNA, 20 nt, Artificial Sequence
  source: /note="Description of Artificial Sequence: Synthetic oligonucleotide"
aaggagaguucucaugcuua

SEQ ID NO: 6746 - RNA, 20 nt, Artificial Sequence
  source: /note="Description of Artificial Sequence: Synthetic oligonucleotide"
gucucccuuuguacuucaaa

SEQ ID NO: 6747 - RNA, 20 nt, Artificial Sequence
  source: /note="Description of Artificial Sequence: Synthetic oligonucleotide"
aaucuguuggcuauucugaa

SEQ ID NO: 6748 - RNA, 20 nt, Artificial Sequence
  source: /note="Description of Artificial Sequence: Synthetic oligonucleotide"
aacucuuguuuaaaaucugu

SEQ ID NO: 6749 - RNA, 20 nt, Artificial Sequence
  source: /note="Description of Artificial Sequence: Synthetic oligonucleotide"
auagccaaaacaagcagaaa

SEQ ID NO: 6750 - RNA, 20 nt, Artificial Sequence
  source: /note="Description of Artificial Sequence: Synthetic oligonucleotide"
cauagccaaaacaagcagaa

SEQ ID NO: 6751 - RNA, 20 nt, Artificial Sequence
  source: /note="Description of Artificial Sequence: Synthetic oligonucleotide"
cuuaaauacagacacugaaa

SEQ ID NO: 6752 - RNA, 20 nt, Artificial Sequence
  source: /note="Description of Artificial Sequence: Synthetic oligonucleotide"
uuucacauccgaaaucauac

SEQ ID NO: 6753 - RNA, 20 nt, Artificial Sequence
  source: /note="Description of Artificial Sequence: Synthetic oligonucleotide"
cacagcaguauagguuaaca

SEQ ID NO: 6754 - RNA, 20 nt, Artificial Sequence
  source: /note="Description of Artificial Sequence: Synthetic oligonucleotide"
aaugacuuccacagcaguau

SEQ ID NO: 6755 - RNA, 20 nt, Artificial Sequence
  source: /note="Description of Artificial Sequence: Synthetic oligonucleotide"
aagagugauaaaguuaaauu

SEQ ID NO: 6756 - RNA, 20 nt, Artificial Sequence
  source: /note="Description of Artificial Sequence: Synthetic oligonucleotide"
agauagaaguuaucgucugu

SEQ ID NO: 6757 - RNA, 20 nt, Artificial Sequence
  source: /note="Description of Artificial Sequence: Synthetic oligonucleotide"
ucaaugaauucuucuuuggu

SEQ ID NO: 6758 - RNA, 20 nt, Artificial Sequence
  source: /note="Description of Artificial Sequence: Synthetic oligonucleotide"
auaugagggguaaccacacu

SEQ ID NO: 6759 - RNA, 20 nt, Artificial Sequence
  source: /note="Description of Artificial Sequence: Synthetic oligonucleotide"
gauaugagggguaaccacac

SEQ ID NO: 6760 - RNA, 20 nt, Artificial Sequence
  source: /note="Description of Artificial Sequence: Synthetic oligonucleotide"
gacaguagauaugaggggua

SEQ ID NO: 6761 - RNA, 20 nt, Artificial Sequence
  source: /note="Description of Artificial Sequence: Synthetic oligonucleotide"
guuuaaguugaauagguuuu

SEQ ID NO: 6762 - RNA, 20 nt, Artificial Sequence
  source: /note="Description of Artificial Sequence: Synthetic oligonucleotide"
agacauggacauacagggua

SEQ ID NO: 6763 - RNA, 20 nt, Artificial Sequence
  source: /note="Description of Artificial Sequence: Synthetic oligonucleotide"
gaagucgucucaaguguuaa

SEQ ID NO: 6764 - RNA, 20 nt, Artificial Sequence
  source: /note="Description of Artificial Sequence: Synthetic oligonucleotide"
aggugacccaagagauggcc

SEQ ID NO: 6765 - RNA, 20 nt, Artificial Sequence
  source: /note="Description of Artificial Sequence: Synthetic oligonucleotide"
uggcaaggugacccaagaga

SEQ ID NO: 6766 - RNA, 20 nt, Artificial Sequence
  source: /note="Description of Artificial Sequence: Synthetic oligonucleotide"
aagagaaugaaaaguuggca

SEQ ID NO: 6767 - RNA, 20 nt, Artificial Sequence
  source: /note="Description of Artificial Sequence: Synthetic oligonucleotide"
uuguaaagagaaugaaaagu

SEQ ID NO: 6768 - RNA, 20 nt, Artificial Sequence
  source: /note="Description of Artificial Sequence: Synthetic oligonucleotide"
caaggugacccaagauaagu

SEQ ID NO: 6769 - RNA, 20 nt, Artificial Sequence
  source: /note="Description of Artificial Sequence: Synthetic oligonucleotide"
aagagaaugaaaaguuagca

SEQ ID NO: 6770 - RNA, 20 nt, Artificial Sequence
  source: /note="Description of Artificial Sequence: Synthetic oligonucleotide"
gagaagccagcuugagaaug

SEQ ID NO: 6771 - RNA, 20 nt, Artificial Sequence
  source: /note="Description of Artificial Sequence: Synthetic oligonucleotide"
agagaagccagcuugagaau

SEQ ID NO: 6772 - RNA, 20 nt, Artificial Sequence
  source: /note="Description of Artificial Sequence: Synthetic oligonucleotide"
cagagaagccagcuugagaa

SEQ ID NO: 6773 - RNA, 20 nt, Artificial Sequence
  source: /note="Description of Artificial Sequence: Synthetic oligonucleotide"
cugcucaaugcuagccauuu

SEQ ID NO: 6774 - RNA, 20 nt, Artificial Sequence
  source: /note="Description of Artificial Sequence: Synthetic oligonucleotide"
ccugcucaaugcuagccauu

SEQ ID NO: 6775 - RNA, 20 nt, Artificial Sequence
  source: /note="Description of Artificial Sequence: Synthetic oligonucleotide"
uaauucagaggaguauguug

SEQ ID NO: 6776 - RNA, 20 nt, Artificial Sequence
  source: /note="Description of Artificial Sequence: Synthetic oligonucleotide"
guaauucagaggaguauguu

SEQ ID NO: 6777 - RNA, 20 nt, Artificial Sequence
  source: /note="Description of Artificial Sequence: Synthetic oligonucleotide"
uguaauucagaggaguaugu

SEQ ID NO: 6778 - RNA, 20 nt, Artificial Sequence
  source: /note="Description of Artificial Sequence: Synthetic oligonucleotide"
uaacucaaaauguaauucag

SEQ ID NO: 6779 - RNA, 20 nt, Artificial Sequence
  source: /note="Description of Artificial Sequence: Synthetic oligonucleotide"
ucucuaucccuuauacuuaa

SEQ ID NO: 6780 - RNA, 20 nt, Artificial Sequence
  source: /note="Description of Artificial Sequence: Synthetic oligonucleotide"
agaaguauaaacugauuaaa

SEQ ID NO: 6781 - RNA, 20 nt, Artificial Sequence
  source: /note="Description of Artificial Sequence: Synthetic oligonucleotide"
cucagcaacuuuuugaugac

SEQ ID NO: 6782 - RNA, 20 nt, Artificial Sequence
  source: /note="Description of Artificial Sequence: Synthetic oligonucleotide"
uccuaaacuuugagauuaau

SEQ ID NO: 6783 - RNA, 20 nt, Artificial Sequence
  source: /note="Description of Artificial Sequence: Synthetic oligonucleotide"
agguuaccacgucaaaaagc

SEQ ID NO: 6784 - RNA, 20 nt, Artificial Sequence
  source: /note="Description of Artificial Sequence: Synthetic oligonucleotide"
cuguuuccuuuuguuauggc

SEQ ID NO: 6785 - RNA, 20 nt, Artificial Sequence
  source: /note="Description of Artificial Sequence: Synthetic oligonucleotide"
ccugcuguuuccuuuuguua

SEQ ID NO: 6786 - RNA, 20 nt, Artificial Sequence
  source: /note="Description of Artificial Sequence: Synthetic oligonucleotide"
gggaagaagacuguuuuaau

SEQ ID NO: 6787 - RNA, 20 nt, Artificial Sequence
  source: /note="Description of Artificial Sequence: Synthetic oligonucleotide"
gcugacaguucguucuuugg

SEQ ID NO: 6788 - RNA, 20 nt, Artificial Sequence
  source: /note="Description of Artificial Sequence: Synthetic oligonucleotide"
ugcugacaguucguucuuug

SEQ ID NO: 6789 - RNA, 20 nt, Artificial Sequence
  source: /note="Description of Artificial Sequence: Synthetic oligonucleotide"
uugcugacaguucguucuuu

SEQ ID NO: 6790 - RNA, 20 nt, Artificial Sequence
  source: /note="Description of Artificial Sequence: Synthetic oligonucleotide"
uuugcugacaguucguucuu

SEQ ID NO: 6791 - RNA, 20 nt, Artificial Sequence
  source: /note="Description of Artificial Sequence: Synthetic oligonucleotide"
aaugccaaacuuaauucuac

SEQ ID NO: 6792 - RNA, 20 nt, Artificial Sequence
  source: /note="Description of Artificial Sequence: Synthetic oligonucleotide"
auauauauauccaugccuug

SEQ ID NO: 6793 - RNA, 20 nt, Artificial Sequence
  source: /note="Description of Artificial Sequence: Synthetic oligonucleotide"
gaauacacaccaaaagugaa

SEQ ID NO: 6794 - RNA, 20 nt, Artificial Sequence
  source: /note="Description of Artificial Sequence: Synthetic oligonucleotide"
cugguugaauaacucacagc

SEQ ID NO: 6795 - RNA, 20 nt, Artificial Sequence
  source: /note="Description of Artificial Sequence: Synthetic oligonucleotide"
agacucaaacuuagugagcc

SEQ ID NO: 6796 - RNA, 20 nt, Artificial Sequence
  source: /note="Description of Artificial Sequence: Synthetic oligonucleotide"
agauuuccucccuauuugga

SEQ ID NO: 6797 - RNA, 20 nt, Artificial Sequence
  source: /note="Description of Artificial Sequence: Synthetic oligonucleotide"
uuucagauuuccucccuauu

SEQ ID NO: 6798 - RNA, 20 nt, Artificial Sequence
  source: /note="Description of Artificial Sequence: Synthetic oligonucleotide"
cagagcaucucagucaacac

SEQ ID NO: 6799 - RNA, 20 nt, Artificial Sequence
  source: /note="Description of Artificial Sequence: Synthetic oligonucleotide"
aguuggugagcucugagucc

SEQ ID NO: 6800 - RNA, 20 nt, Artificial Sequence
  source: /note="Description of Artificial Sequence: Synthetic oligonucleotide"
uuaacauaaagauccaaagu

SEQ ID NO: 6801 - RNA, 20 nt, Artificial Sequence
  source: /note="Description of Artificial Sequence: Synthetic oligonucleotide"
agccacugaccuauaucaag

SEQ ID NO: 6802 - RNA, 20 nt, Artificial Sequence
  source: /note="Description of Artificial Sequence: Synthetic oligonucleotide"
uuuaguuaaaagaaaguugu

SEQ ID NO: 6803 - RNA, 20 nt, Artificial Sequence
  source: /note="Description of Artificial Sequence: Synthetic oligonucleotide"
cccauugugacaaaccaacu

SEQ ID NO: 6804 - RNA, 20 nt, Artificial Sequence
  source: /note="Description of Artificial Sequence: Synthetic oligonucleotide"
uuauaaaagcaucuucacca

SEQ ID NO: 6805 - RNA, 20 nt, Artificial Sequence
  source: /note="Description of Artificial Sequence: Synthetic oligonucleotide"
uguuuaaaauaauucuuuca

SEQ ID NO: 6806 - RNA, 20 nt, Artificial Sequence
  source: /note="Description of Artificial Sequence: Synthetic oligonucleotide"
acgacagugguagaguaacg

SEQ ID NO: 6807 - RNA, 20 nt, Artificial Sequence
  source: /note="Description of Artificial Sequence: Synthetic oligonucleotide"
acaggaaugaaaaugauggu

SEQ ID NO: 6808 - RNA, 20 nt, Artificial Sequence
  source: /note="Description of Artificial Sequence: Synthetic oligonucleotide"
ggcaaauuuuuuauuggaua

SEQ ID NO: 6809 - RNA, 20 nt, Artificial Sequence
  source: /note="Description of Artificial Sequence: Synthetic oligonucleotide"
ucaaugaauucuucuuuggu

SEQ ID NO: 6810 - RNA, 20 nt, Artificial Sequence
  source: /note="Description of Artificial Sequence: Synthetic oligonucleotide"
uguaagggguagucacacuc

SEQ ID NO: 6811 - RNA, 20 nt, Artificial Sequence
  source: /note="Description of Artificial Sequence: Synthetic oligonucleotide"
auguaagggguagucacacu

SEQ ID NO: 6812 - RNA, 20 nt, Artificial Sequence
  source: /note="Description of Artificial Sequence: Synthetic oligonucleotide"
gauguaagggguagucacac

SEQ ID NO: 6813 - RNA, 20 nt, Artificial Sequence
  source: /note="Description of Artificial Sequence: Synthetic oligonucleotide"
guuugagaugaauagguuuu

SEQ ID NO: 6814 - RNA, 20 nt, Artificial Sequence
  source: /note="Description of Artificial Sequence: Synthetic oligonucleotide"
agacauggacauacagggua

SEQ ID NO: 6815 - RNA, 20 nt, Artificial Sequence
  source: /note="Description of Artificial Sequence: Synthetic oligonucleotide"
gaagucgucucaaguguuaa

SEQ ID NO: 6816 - RNA, 20 nt, Artificial Sequence
  source: /note="Description of Artificial Sequence: Synthetic oligonucleotide"
uccacuggguucucuaccgg

SEQ ID NO: 6817 - RNA, 20 nt, Artificial Sequence
  source: /note="Description of Artificial Sequence: Synthetic oligonucleotide"
guuguuccacuggguucucu

SEQ ID NO: 6818 - RNA, 20 nt, Artificial Sequence
  source: /note="Description of Artificial Sequence: Synthetic oligonucleotide"
uucucuuacuuuucaguugu

SEQ ID NO: 6819 - RNA, 20 nt, Artificial Sequence
  source: /note="Description of Artificial Sequence: Synthetic oligonucleotide"
cucuucggucggacucuaac

SEQ ID NO: 6820 - RNA, 20 nt, Artificial Sequence
  source: /note="Description of Artificial Sequence: Synthetic oligonucleotide"
ccucuucggucggacucuaa

SEQ ID NO: 6821 - RNA, 20 nt, Artificial Sequence
  source: /note="Description of Artificial Sequence: Synthetic oligonucleotide"
accucuucggucggacucua

SEQ ID NO: 6822 - RNA, 20 nt, Artificial Sequence
  source: /note="Description of Artificial Sequence: Synthetic oligonucleotide"
uaggguucauucucauguca

SEQ ID NO: 6823 - RNA, 20 nt, Artificial Sequence
  source: /note="Description of Artificial Sequence: Synthetic oligonucleotide"
cuugacacaauuggaugguu

SEQ ID NO: 6824 - RNA, 20 nt, Artificial Sequence
  source: /note="Description of Artificial Sequence: Synthetic oligonucleotide"
uuagucguuccccagauucg

SEQ ID NO: 6825 - RNA, 20 nt, Artificial Sequence
  source: /note="Description of Artificial Sequence: Synthetic oligonucleotide"
guucaguccuuuagucguuc

SEQ ID NO: 6826 - RNA, 20 nt, Artificial Sequence
  source: /note="Description of Artificial Sequence: Synthetic oligonucleotide"
uguucaguccuuuagucguu

SEQ ID NO: 6827 - RNA, 20 nt, Artificial Sequence
  source: /note="Description of Artificial Sequence: Synthetic oligonucleotide"
auguucaguccuuuagucgu

SEQ ID NO: 6828 - RNA, 20 nt, Artificial Sequence
  source: /note="Description of Artificial Sequence: Synthetic oligonucleotide"
ccgucaacucacauguucag

SEQ ID NO: 6829 - RNA, 20 nt, Artificial Sequence
  source: /note="Description of Artificial Sequence: Synthetic oligonucleotide"
aauuucacccauauaauccg

SEQ ID NO: 6830 - RNA, 20 nt, Artificial Sequence
  source: /note="Description of Artificial Sequence: Synthetic oligonucleotide"
uaguaauuucacccauauaa

SEQ ID NO: 6831 - RNA, 20 nt, Artificial Sequence
  source: /note="Description of Artificial Sequence: Synthetic oligonucleotide"
uacauguaauaguaauuuca

SEQ ID NO: 6832 - RNA, 20 nt, Artificial Sequence
  source: /note="Description of Artificial Sequence: Synthetic oligonucleotide"
cuacauguaauaguaauuuc

SEQ ID NO: 6833 - RNA, 20 nt, Artificial Sequence
  source: /note="Description of Artificial Sequence: Synthetic oligonucleotide"
auacugacugucuuuuuaau

SEQ ID NO: 6834 - RNA, 20 nt, Artificial Sequence
  source: /note="Description of Artificial Sequence: Synthetic oligonucleotide"
uaaacaauccuacccauuua

SEQ ID NO: 6835 - RNA, 20 nt, Artificial Sequence
  source: /note="Description of Artificial Sequence: Synthetic oligonucleotide"
auaaacaauccuacccauuu

SEQ ID NO: 6836 - RNA, 20 nt, Artificial Sequence
  source: /note="Description of Artificial Sequence: Synthetic oligonucleotide"
uaccacgauaaacaauccua

SEQ ID NO: 6837 - RNA, 20 nt, Artificial Sequence
  source: /note="Description of Artificial Sequence: Synthetic oligonucleotide"
cuaccacgauaaacaauccu

SEQ ID NO: 6838 - RNA, 20 nt, Artificial Sequence
  source: /note="Description of Artificial Sequence: Synthetic oligonucleotide"
acuacuaccacgauaaacaa

SEQ ID NO: 6839 - RNA, 20 nt, Artificial Sequence
  source: /note="Description of Artificial Sequence: Synthetic oligonucleotide"
aacucgauuuuccaacuacu

SEQ ID NO: 6840 - RNA, 20 nt, Artificial Sequence
  source: /note="Description of Artificial Sequence: Synthetic oligonucleotide"
cucaaaacagaacucgauuu

SEQ ID NO: 6841 - RNA, 20 nt, Artificial Sequence
  source: /note="Description of Artificial Sequence: Synthetic oligonucleotide"
cuacacucuuucauguacuu

SEQ ID NO: 6842 - RNA, 20 nt, Artificial Sequence
  source: /note="Description of Artificial Sequence: Synthetic oligonucleotide"
cuuugucuuguugaaccauu

SEQ ID NO: 6843 - RNA, 20 nt, Artificial Sequence
  source: /note="Description of Artificial Sequence: Synthetic oligonucleotide"
uuccgucuuugucuuguuga

SEQ ID NO: 6844 - RNA, 20 nt, Artificial Sequence
  source: /note="Description of Artificial Sequence: Synthetic oligonucleotide"
uuuaaauccuguguaaaacu

SEQ ID NO: 6845 - RNA, 20 nt, Artificial Sequence
  source: /note="Description of Artificial Sequence: Synthetic oligonucleotide"
cgucucuuuaccuauuuaaa

SEQ ID NO: 6846 - RNA, 20 nt, Artificial Sequence
  source: /note="Description of Artificial Sequence: Synthetic oligonucleotide"
cuuaucgucaccgucucuuu

SEQ ID NO: 6847 - RNA, 20 nt, Artificial Sequence
  source: /note="Description of Artificial Sequence: Synthetic oligonucleotide"
ggacuugaucucuuaucguc

SEQ ID NO: 6848 - RNA, 20 nt, Artificial Sequence
  source: /note="Description of Artificial Sequence: Synthetic oligonucleotide"
uggcgucauuauguucucuu

SEQ ID NO: 6849 - RNA, 20 nt, Artificial Sequence
  source: /note="Description of Artificial Sequence: Synthetic oligonucleotide"
ucuggaaauuuucuagugag

SEQ ID NO: 6850 - RNA, 20 nt, Artificial Sequence
  source: /note="Description of Artificial Sequence: Synthetic oligonucleotide"
auuuaggucacccuucggua

SEQ ID NO: 6851 - RNA, 20 nt, Artificial Sequence
  source: /note="Description of Artificial Sequence: Synthetic oligonucleotide"
cuaauaauaaauuuagguca

SEQ ID NO: 6852 - RNA, 20 nt, Artificial Sequence
  source: /note="Description of Artificial Sequence: Synthetic oligonucleotide"
ucuaauaauaaauuuagguc

SEQ ID NO: 6853 - RNA, 20 nt, Artificial Sequence
  source: /note="Description of Artificial Sequence: Synthetic oligonucleotide"
cuucauacauuuccgguacc

SEQ ID NO: 6854 - RNA, 20 nt, Artificial Sequence
  source: /note="Description of Artificial Sequence: Synthetic oligonucleotide"
gaucuucauacauuuccggu

SEQ ID NO: 6855 - RNA, 20 nt, Artificial Sequence
  source: /note="Description of Artificial Sequence: Synthetic oligonucleotide"
cacgccgaucuucauacauu

SEQ ID NO: 6856 - RNA, 20 nt, Artificial Sequence
  source: /note="Description of Artificial Sequence: Synthetic oligonucleotide"
uucuccucacaaaacuccac

SEQ ID NO: 6857 - RNA, 20 nt, Artificial Sequence
  source: /note="Description of Artificial Sequence: Synthetic oligonucleotide"
acuuguucuccucacaaaac

SEQ ID NO: 6858 - RNA, 20 nt, Artificial Sequence
  source: /note="Description of Artificial Sequence: Synthetic oligonucleotide"
caaucaagagucacuuguuc

SEQ ID NO: 6859 - RNA, 20 nt, Artificial Sequence
  source: /note="Description of Artificial Sequence: Synthetic oligonucleotide"
aucgacuccucuucucuuug

SEQ ID NO: 6860 - RNA, 20 nt, Artificial Sequence
  source: /note="Description of Artificial Sequence: Synthetic oligonucleotide"
uuuaaucguacuauaucgac

SEQ ID NO: 6861 - RNA, 20 nt, Artificial Sequence
  source: /note="Description of Artificial Sequence: Synthetic oligonucleotide"
ucucccuuguuuucauguuu

SEQ ID NO: 6862 - RNA, 20 nt, Artificial Sequence
  source: /note="Description of Artificial Sequence: Synthetic oligonucleotide"
ccuucuuacuaagucgaucu

SEQ ID NO: 6863 - RNA, 20 nt, Artificial Sequence
  source: /note="Description of Artificial Sequence: Synthetic oligonucleotide"
accuucuuacuaagucgauc

SEQ ID NO: 6864 - RNA, 20 nt, Artificial Sequence
  source: /note="Description of Artificial Sequence: Synthetic oligonucleotide"
uucgguuacuaucuuacugg

SEQ ID NO: 6865 - RNA, 20 nt, Artificial Sequence
  source: /note="Description of Artificial Sequence: Synthetic oligonucleotide"
gauaaaucuaucucguccau

SEQ ID NO: 6866 - RNA, 20 nt, Artificial Sequence
  source: /note="Description of Artificial Sequence: Synthetic oligonucleotide"
guccugauaaaucuaucucg

SEQ ID NO: 6867 - RNA, 20 nt, Artificial Sequence
  source: /note="Description of Artificial Sequence: Synthetic oligonucleotide"
cucuauuucuccugauuuug

SEQ ID NO: 6868 - RNA, 20 nt, Artificial Sequence
  source: /note="Description of Artificial Sequence: Synthetic oligonucleotide"
uagacucacuacucuauuuc

SEQ ID NO: 6869 - RNA, 20 nt, Artificial Sequence
  source: /note="Description of Artificial Sequence: Synthetic oligonucleotide"
gucugacuacucacgauacu

SEQ ID NO: 6870 - RNA, 20 nt, Artificial Sequence
  source: /note="Description of Artificial Sequence: Synthetic oligonucleotide"
agucugacuacucacgauac

SEQ ID NO: 6871 - RNA, 20 nt, Artificial Sequence
  source: /note="Description of Artificial Sequence: Synthetic oligonucleotide"
aucccuacuuguucuaucag

SEQ ID NO: 6872 - RNA, 20 nt, Artificial Sequence
  source: /note="Description of Artificial Sequence: Synthetic oligonucleotide"
aagauccaagaucccuacau

SEQ ID NO: 6873 - RNA, 20 nt, Artificial Sequence
  source: /note="Description of Artificial Sequence: Synthetic oligonucleotide"
caagauccaagaucccuaca

SEQ ID NO: 6874 - RNA, 20 nt, Artificial Sequence
  source: /note="Description of Artificial Sequence: Synthetic oligonucleotide"
uguauaacaagauccaagau

SEQ ID NO: 6875 - RNA, 20 nt, Artificial Sequence
  source: /note="Description of Artificial Sequence: Synthetic oligonucleotide"
uuguauaacaagauccaaga

SEQ ID NO: 6876 - RNA, 20 nt, Artificial Sequence
  source: /note="Description of Artificial Sequence: Synthetic oligonucleotide"
auagaaauuguauaacaaga

SEQ ID NO: 6877 - RNA, 20 nt, Artificial Sequence
  source: /note="Description of Artificial Sequence: Synthetic oligonucleotide"
gucaccucagggggcuggac

SEQ ID NO: 6878 - RNA, 20 nt, Artificial Sequence
  source: /note="Description of Artificial Sequence: Synthetic oligonucleotide"
ugcuggucaccucagggggc

SEQ ID NO: 6879 - RNA, 20 nt, Artificial Sequence
  source: /note="Description of Artificial Sequence: Synthetic oligonucleotide"
uaaaugcuggucaccucagg

SEQ ID NO: 6880 - RNA, 20 nt, Artificial Sequence
  source: /note="Description of Artificial Sequence: Synthetic oligonucleotide"
cuaaaugcuggucaccucag

SEQ ID NO: 6881 - RNA, 20 nt, Artificial Sequence
  source: /note="Description of Artificial Sequence: Synthetic oligonucleotide"
ccuaaaugcuggucaccuca

SEQ ID NO: 6882 - RNA, 20 nt, Artificial Sequence
  source: /note="Description of Artificial Sequence: Synthetic oligonucleotide"
cccuaaaugcuggucaccuc

SEQ ID NO: 6883 - RNA, 20 nt, Artificial Sequence
  source: /note="Description of Artificial Sequence: Synthetic oligonucleotide"
ucggcuuauucccuaaaugc

SEQ ID NO: 6884 - RNA, 20 nt, Artificial Sequence
  source: /note="Description of Artificial Sequence: Synthetic oligonucleotide"
uuaauggcccuccucugccu

SEQ ID NO: 6885 - RNA, 20 nt, Artificial Sequence
  source: /note="Description of Artificial Sequence: Synthetic oligonucleotide"
cucucauugcuccuucuuaa

SEQ ID NO: 6886 - RNA, 20 nt, Artificial Sequence
  source: /note="Description of Artificial Sequence: Synthetic oligonucleotide"
guuaggacacucucacuuua

SEQ ID NO: 6887 - RNA, 20 nt, Artificial Sequence
  source: /note="Description of Artificial Sequence: Synthetic oligonucleotide"
uguuaggacacucucacuuu

SEQ ID NO: 6888 - RNA, 20 nt, Artificial Sequence
  source: /note="Description of Artificial Sequence: Synthetic oligonucleotide"
cuuucauuuagaccuguguu

SEQ ID NO: 6889 - RNA, 20 nt, Artificial Sequence
  source: /note="Description of Artificial Sequence: Synthetic oligonucleotide"
cagaauuucccuaucuuuca

SEQ ID NO: 6890 - RNA, 20 nt, Artificial Sequence
  source: /note="Description of Artificial Sequence: Synthetic oligonucleotide"
gggaugacuauuccccaaac

SEQ ID NO: 6891 - RNA, 20 nt, Artificial Sequence
  source: /note="Description of Artificial Sequence: Synthetic oligonucleotide"
cucuauugugaaagacaaau

SEQ ID NO: 6892 - RNA, 20 nt, Artificial Sequence
  source: /note="Description of Artificial Sequence: Synthetic oligonucleotide"
acucuauugugaaagacaaa

SEQ ID NO: 6893 - RNA, 20 nt, Artificial Sequence
  source: /note="Description of Artificial Sequence: Synthetic oligonucleotide"
cacuguuguaauugugauuu

SEQ ID NO: 6894 - RNA, 20 nt, Artificial Sequence
  source: /note="Description of Artificial Sequence: Synthetic oligonucleotide"
acaaaugacacacuaggacu

SEQ ID NO: 6895 - RNA, 20 nt, Artificial Sequence
  source: /note="Description of Artificial Sequence: Synthetic oligonucleotide"
gugaauaugagguggccaua

SEQ ID NO: 6896 - RNA, 20 nt, Artificial Sequence
  source: /note="Description of Artificial Sequence: Synthetic oligonucleotide"
uaugcagggugaauaugagg

SEQ ID NO: 6897 - RNA, 20 nt, Artificial Sequence
  source: /note="Description of Artificial Sequence: Synthetic oligonucleotide"
uuauaugcagggugaauaug

SEQ ID NO: 6898 - RNA, 20 nt, Artificial Sequence
  source: /note="Description of Artificial Sequence: Synthetic oligonucleotide"
uuggcauacuguuauaugca

SEQ ID NO: 6899 - RNA, 20 nt, Artificial Sequence
  source: /note="Description of Artificial Sequence: Synthetic oligonucleotide"
auuggcauacuguuauaugc

SEQ ID NO: 6900 - RNA, 20 nt, Artificial Sequence
  source: /note="Description of Artificial Sequence: Synthetic oligonucleotide"
uucacgccucauuccuacau

SEQ ID NO: 6901 - RNA, 20 nt, Artificial Sequence
  source: /note="Description of Artificial Sequence: Synthetic oligonucleotide"
agcuaccaaaggaauaauca

SEQ ID NO: 6902 - RNA, 20 nt, Artificial Sequence
  source: /note="Description of Artificial Sequence: Synthetic oligonucleotide"
auuucccuugaagcuaccaa

SEQ ID NO: 6903 - RNA, 20 nt, Artificial Sequence
  source: /note="Description of Artificial Sequence: Synthetic oligonucleotide"
gacagauaaagugcugacau

SEQ ID NO: 6904 - RNA, 20 nt, Artificial Sequence
  source: /note="Description of Artificial Sequence: Synthetic oligonucleotide"
ggacagauaaagugcugaca

SEQ ID NO: 6905 - RNA, 20 nt, Artificial Sequence
  source: /note="Description of Artificial Sequence: Synthetic oligonucleotide"
uuuggaauuucucauguuuc

SEQ ID NO: 6906 - RNA, 20 nt, Artificial Sequence
  source: /note="Description of Artificial Sequence: Synthetic oligonucleotide"
aacugcauggcuugaacauu

SEQ ID NO: 6907 - RNA, 20 nt, Artificial Sequence
  source: /note="Description of Artificial Sequence: Synthetic oligonucleotide"
cugacuagauaaaaacugca

SEQ ID NO: 6908 - RNA, 20 nt, Artificial Sequence
  source: /note="Description of Artificial Sequence: Synthetic oligonucleotide"
cauuacaacuauggguaacc

SEQ ID NO: 6909 - RNA, 20 nt, Artificial Sequence
  source: /note="Description of Artificial Sequence: Synthetic oligonucleotide"
gagguauucauuacaacuau

SEQ ID NO: 6910 - RNA, 20 nt, Artificial Sequence
  source: /note="Description of Artificial Sequence: Synthetic oligonucleotide"
ggagguauucauuacaacua

SEQ ID NO: 6911 - RNA, 20 nt, Artificial Sequence
  source: /note="Description of Artificial Sequence: Synthetic oligonucleotide"
acauuaagaagauaaagagg

SEQ ID NO: 6912 - RNA, 20 nt, Artificial Sequence
  source: /note="Description of Artificial Sequence: Synthetic oligonucleotide"
agaacauuaagaagauaaag

SEQ ID NO: 6913 - RNA, 20 nt, Artificial Sequence
  source: /note="Description of Artificial Sequence: Synthetic oligonucleotide"
aguaaucuuuauagaucauu

SEQ ID NO: 6914 - RNA, 20 nt, Artificial Sequence
  source: /note="Description of Artificial Sequence: Synthetic oligonucleotide"
cugcuggaccucaaucugaa

SEQ ID NO: 6915 - RNA, 20 nt, Artificial Sequence
  source: /note="Description of Artificial Sequence: Synthetic oligonucleotide"
guaguguucugaaagucugc

SEQ ID NO: 6916 - RNA, 20 nt, Artificial Sequence
  source: /note="Description of Artificial Sequence: Synthetic oligonucleotide"
agcuuauuauuuuauuaguu

SEQ ID NO: 6917 - RNA, 20 nt, Artificial Sequence
  source: /note="Description of Artificial Sequence: Synthetic oligonucleotide"
gagcuuauuauuuuauuagu

SEQ ID NO: 6918 - RNA, 20 nt, Artificial Sequence
  source: /note="Description of Artificial Sequence: Synthetic oligonucleotide"
ccacaaauaaaggcaaauac

SEQ ID NO: 6919 - RNA, 20 nt, Artificial Sequence
  source: /note="Description of Artificial Sequence: Synthetic oligonucleotide"
guguguauacccacaaauaa

SEQ ID NO: 6920 - RNA, 20 nt, Artificial Sequence
  source: /note="Description of Artificial Sequence: Synthetic oligonucleotide"
aaugauuuuacucuaguuua

SEQ ID NO: 6921 - RNA, 20 nt, Artificial Sequence
  source: /note="Description of Artificial Sequence: Synthetic oligonucleotide"
auacacaauuugaaaauuuu

SEQ ID NO: 6922 - RNA, 20 nt, Artificial Sequence
  source: /note="Description of Artificial Sequence: Synthetic oligonucleotide"
cauacacaauuugaaaauuu

SEQ ID NO: 6923 - RNA, 20 nt, Artificial Sequence
  source: /note="Description of Artificial Sequence: Synthetic oligonucleotide"
uaauuucauuuaaaccagaa

SEQ ID NO: 6924 - RNA, 20 nt, Artificial Sequence
  source: /note="Description of Artificial Sequence: Synthetic oligonucleotide"
gcacucgauggcguggaccg

SEQ ID NO: 6925 - RNA, 20 nt, Artificial Sequence
  source: /note="Description of Artificial Sequence: Synthetic oligonucleotide"
guccgcacucgauggcgugg

SEQ ID NO: 6926 - RNA, 20 nt, Artificial Sequence
  source: /note="Description of Artificial Sequence: Synthetic oligonucleotide"
aggguuucacgacccuaaug

SEQ ID NO: 6927 - RNA, 20 nt, Artificial Sequence
  source: /note="Description of Artificial Sequence: Synthetic oligonucleotide"
ggagucggaggguuucacga

SEQ ID NO: 6928 - RNA, 20 nt, Artificial Sequence
  source: /note="Description of Artificial Sequence: Synthetic oligonucleotide"
cggagucggaggguuucacg

SEQ ID NO: 6929 - RNA, 20 nt, Artificial Sequence
  source: /note="Description of Artificial Sequence: Synthetic oligonucleotide"
ccaaaacuugaggacugaag

SEQ ID NO: 6930 - RNA, 20 nt, Artificial Sequence
  source: /note="Description of Artificial Sequence: Synthetic oligonucleotide"
aaagugguacaaccgguccg

SEQ ID NO: 6931 - RNA, 20 nt, Artificial Sequence
  source: /note="Description of Artificial Sequence: Synthetic oligonucleotide"
ucccaaagugguacaaccgg

SEQ ID NO: 6932 - RNA, 20 nt, Artificial Sequence
  source: /note="Description of Artificial Sequence: Synthetic oligonucleotide"
cucugucccaaagugguaca

SEQ ID NO: 6933 - RNA, 20 nt, Artificial Sequence
  source: /note="Description of Artificial Sequence: Synthetic oligonucleotide"
aacauaaaaaucaucucugu

SEQ ID NO: 6934 - RNA, 20 nt, Artificial Sequence
  source: /note="Description of Artificial Sequence: Synthetic oligonucleotide"
aaacauaaaaaucaucucug

SEQ ID NO: 6935 - RNA, 20 nt, Artificial Sequence
  source: /note="Description of Artificial Sequence: Synthetic oligonucleotide"
guccgugcacggugguacgg

SEQ ID NO: 6936 - RNA, 20 nt, Artificial Sequence
  source: /note="Description of Artificial Sequence: Synthetic oligonucleotide"
uagguucauagacccugaug

SEQ ID NO: 6937 - RNA, 20 nt, Artificial Sequence
  source: /note="Description of Artificial Sequence: Synthetic oligonucleotide"
ggagucgguagguucauaga

SEQ ID NO: 6938 - RNA, 20 nt, Artificial Sequence
  source: /note="Description of Artificial Sequence: Synthetic oligonucleotide"
cggagucgguagguucauag

SEQ ID NO: 6939 - RNA, 20 nt, Artificial Sequence
  source: /note="Description of Artificial Sequence: Synthetic oligonucleotide"
gugacguuggaggcggagga

SEQ ID NO: 6940 - RNA, 20 nt, Artificial Sequence
  source: /note="Description of Artificial Sequence: Synthetic oligonucleotide"
agugacguuggaggcggagg

SEQ ID NO: 6941 - RNA, 20 nt, Artificial Sequence
  source: /note="Description of Artificial Sequence: Synthetic oligonucleotide"
agcugguccgaucucacguc

SEQ ID NO: 6942 - RNA, 20 nt, Artificial Sequence
  source: /note="Description of Artificial Sequence: Synthetic oligonucleotide"
ucuaagagugagacagcugg

SEQ ID NO: 6943 - RNA, 20 nt, Artificial Sequence
  source: /note="Description of Artificial Sequence: Synthetic oligonucleotide"
ggugggugggugggggaaug

SEQ ID NO: 6944 - RNA, 20 nt, Artificial Sequence
  source: /note="Description of Artificial Sequence: Synthetic oligonucleotide"
uggugggugggugggggaau

SEQ ID NO: 6945 - RNA, 20 nt, Artificial Sequence
  source: /note="Description of Artificial Sequence: Synthetic oligonucleotide"
uuggugggugggugggggaa

SEQ ID NO: 6946 - RNA, 20 nt, Artificial Sequence
  source: /note="Description of Artificial Sequence: Synthetic oligonucleotide"
gucuuuuggugggugggugg

SEQ ID NO: 6947 - RNA, 20 nt, Artificial Sequence
  source: /note="Description of Artificial Sequence: Synthetic oligonucleotide"
agucuuuuggugggugggug

SEQ ID NO: 6948 - RNA, 20 nt, Artificial Sequence
  source: /note="Description of Artificial Sequence: Synthetic oligonucleotide"
gagucuuuuggugggugggu

SEQ ID NO: 6949 - RNA, 20 nt, Artificial Sequence
  source: /note="Description of Artificial Sequence: Synthetic oligonucleotide"
ggagucuuuugguggguggg

SEQ ID NO: 6950 - RNA, 20 nt, Artificial Sequence
  source: /note="Description of Artificial Sequence: Synthetic oligonucleotide"
aauggagucuuuuggugggu

SEQ ID NO: 6951 - RNA, 20 nt, Artificial Sequence
  source: /note="Description of Artificial Sequence: Synthetic oligonucleotide"
caauggagucuuuugguggg

SEQ ID NO: 6952 - RNA, 20 nt, Artificial Sequence
  source: /note="Description of Artificial Sequence: Synthetic oligonucleotide"
cuccaauggagucuuuuggu

SEQ ID NO: 6953 - RNA, 20 nt, Artificial Sequence
  source: /note="Description of Artificial Sequence: Synthetic oligonucleotide"
acuccaauggagucuuuugg

SEQ ID NO: 6954 - RNA, 20 nt, Artificial Sequence
  source: /note="Description of Artificial Sequence: Synthetic oligonucleotide"
aaaacuccaauggagucuuu

SEQ ID NO: 6955 - RNA, 20 nt, Artificial Sequence
  source: /note="Description of Artificial Sequence: Synthetic oligonucleotide"
uuuguaaaauaaaacuccaa

SEQ ID NO: 6956 - RNA, 20 nt, Artificial Sequence
  source: /note="Description of Artificial Sequence: Synthetic oligonucleotide"
cuaugucagaaaaagaauug

SEQ ID NO: 6957 - RNA, 20 nt, Artificial Sequence
  source: /note="Description of Artificial Sequence: Synthetic oligonucleotide"
cugacgugucaaacuucagc

SEQ ID NO: 6958 - RNA, 20 nt, Artificial Sequence
  source: /note="Description of Artificial Sequence: Synthetic oligonucleotide"
aaacucaauuugauuaaaau

SEQ ID NO: 6959 - RNA, 20 nt, Artificial Sequence
  source: /note="Description of Artificial Sequence: Synthetic oligonucleotide"
uuagugugucauuuugaaua

SEQ ID NO: 6960 - RNA, 20 nt, Artificial Sequence
  source: /note="Description of Artificial Sequence: Synthetic oligonucleotide"
caaugagaagaauacagaug

SEQ ID NO: 6961 - RNA, 20 nt, Artificial Sequence
  source: /note="Description of Artificial Sequence: Synthetic oligonucleotide"
aaguccauuuggucaagcau

SEQ ID NO: 6962 - RNA, 20 nt, Artificial Sequence
  source: /note="Description of Artificial Sequence: Synthetic oligonucleotide"
aaaauagcaggaaguccauu

SEQ ID NO: 6963 - RNA, 20 nt, Artificial Sequence
  source: /note="Description of Artificial Sequence: Synthetic oligonucleotide"
gaaaaauaucuuaaaauagc

SEQ ID NO: 6964 - RNA, 20 nt, Artificial Sequence
  source: /note="Description of Artificial Sequence: Synthetic oligonucleotide"
agaagaacauccuagguaaa

SEQ ID NO: 6965 - RNA, 20 nt, Artificial Sequence
  source: /note="Description of Artificial Sequence: Synthetic oligonucleotide"
aagaagaacauccuagguaa

SEQ ID NO: 6966 - RNA, 20 nt, Artificial Sequence
  source: /note="Description of Artificial Sequence: Synthetic oligonucleotide"
cagugaaagaagaacauccu

SEQ ID NO: 6967 - RNA, 20 nt, Artificial Sequence
  source: /note="Description of Artificial Sequence: Synthetic oligonucleotide"
ggcuuuugguagugugcuuu

SEQ ID NO: 6968 - RNA, 20 nt, Artificial Sequence
  source: /note="Description of Artificial Sequence: Synthetic oligonucleotide"
ucauccaaaugaagggcuuu

SEQ ID NO: 6969 - RNA, 20 nt, Artificial Sequence
  source: /note="Description of Artificial Sequence: Synthetic oligonucleotide"
aggugggucauccaaaugaa

SEQ ID NO: 6970 - RNA, 20 nt, Artificial Sequence
  source: /note="Description of Artificial Sequence: Synthetic oligonucleotide"
aaggugggucauccaaauga

SEQ ID NO: 6971 - RNA, 20 nt, Artificial Sequence
  source: /note="Description of Artificial Sequence: Synthetic oligonucleotide"
auggagacucauaggaaggu

SEQ ID NO: 6972 - RNA, 20 nt, Artificial Sequence
  source: /note="Description of Artificial Sequence: Synthetic oligonucleotide"
uauggagacucauaggaagg

SEQ ID NO: 6973 - RNA, 20 nt, Artificial Sequence
  source: /note="Description of Artificial Sequence: Synthetic oligonucleotide"
aacuauggagacucauagga

SEQ ID NO: 6974 - RNA, 20 nt, Artificial Sequence
  source: /note="Description of Artificial Sequence: Synthetic oligonucleotide"
augcaacuauggagacucau

SEQ ID NO: 6975 - RNA, 20 nt, Artificial Sequence
  source: /note="Description of Artificial Sequence: Synthetic oligonucleotide"
ugccaucagacaugcaacua

SEQ ID NO: 6976 - RNA, 20 nt, Artificial Sequence
  source: /note="Description of Artificial Sequence: Synthetic oligonucleotide"
augggaaacagaaugacaau

SEQ ID NO: 6977 - RNA, 20 nt, Artificial Sequence
  source: /note="Description of Artificial Sequence: Synthetic oligonucleotide"
aguacuguacuaggugccau

SEQ ID NO: 6978 - RNA, 20 nt, Artificial Sequence
  source: /note="Description of Artificial Sequence: Synthetic oligonucleotide"
gaguacuguacuaggugcca

SEQ ID NO: 6979 - RNA, 20 nt, Artificial Sequence
  source: /note="Description of Artificial Sequence: Synthetic oligonucleotide"
ugugagcagaguacuguacu

SEQ ID NO: 6980 - RNA, 20 nt, Artificial Sequence
  source: /note="Description of Artificial Sequence: Synthetic oligonucleotide"
ugaggugggacccgcugucu

SEQ ID NO: 6981 - RNA, 20 nt, Artificial Sequence
  source: /note="Description of Artificial Sequence: Synthetic oligonucleotide"
augaggugggacccgcuguc

SEQ ID NO: 6982 - RNA, 20 nt, Artificial Sequence
  source: /note="Description of Artificial Sequence: Synthetic oligonucleotide"
cguggugacaugagguggga

SEQ ID NO: 6983 - RNA, 20 nt, Artificial Sequence
  source: /note="Description of Artificial Sequence: Synthetic oligonucleotide"
acguggugacaugagguggg

SEQ ID NO: 6984 - RNA, 20 nt, Artificial Sequence
  source: /note="Description of Artificial Sequence: Synthetic oligonucleotide"
agugaacuugggucgucguc

SEQ ID NO: 6985 - RNA, 20 nt, Artificial Sequence
  source: /note="Description of Artificial Sequence: Synthetic oligonucleotide"
cgaugagcccucagacucug

SEQ ID NO: 6986 - RNA, 20 nt, Artificial Sequence
  source: /note="Description of Artificial Sequence: Synthetic oligonucleotide"
accauaucagggucgaugag

SEQ ID NO: 6987 - RNA, 20 nt, Artificial Sequence
  source: /note="Description of Artificial Sequence: Synthetic oligonucleotide"
caccauaucagggucgauga

SEQ ID NO: 6988 - RNA, 20 nt, Artificial Sequence
  source: /note="Description of Artificial Sequence: Synthetic oligonucleotide"
ucgguccguaccaccguacc

SEQ ID NO: 6989 - RNA, 20 nt, Artificial Sequence
  source: /note="Description of Artificial Sequence: Synthetic oligonucleotide"
caaucgguccguaccaccgu

SEQ ID NO: 6990 - RNA, 20 nt, Artificial Sequence
  source: /note="Description of Artificial Sequence: Synthetic oligonucleotide"
auuuucaaucgguccguacc

SEQ ID NO: 6991 - RNA, 20 nt, Artificial Sequence
  source: /note="Description of Artificial Sequence: Synthetic oligonucleotide"
augauuuucaaucgguccgu

SEQ ID NO: 6992 - RNA, 20 nt, Artificial Sequence
  source: /note="Description of Artificial Sequence: Synthetic oligonucleotide"
caaagaugauuuucaaucgg

SEQ ID NO: 6993 - RNA, 20 nt, Artificial Sequence
  source: /note="Description of Artificial Sequence: Synthetic oligonucleotide"
ccucuggucggaccgguugu

SEQ ID NO: 6994 - RNA, 20 nt, Artificial Sequence
  source: /note="Description of Artificial Sequence: Synthetic oligonucleotide"
gguccucaaccucuggucgg

SEQ ID NO: 6995 - RNA, 20 nt, Artificial Sequence
  source: /note="Description of Artificial Sequence: Synthetic oligonucleotide"
cuagugaacuccgguccuca

SEQ ID NO: 6996 - RNA, 20 nt, Artificial Sequence
  source: /note="Description of Artificial Sequence: Synthetic oligonucleotide"
guccaccuagugaacuccgg

SEQ ID NO: 6997 - RNA, 20 nt, Artificial Sequence
  source: /note="Description of Artificial Sequence: Synthetic oligonucleotide"
guuccguccaccuagugaac

SEQ ID NO: 6998 - RNA, 20 nt, Artificial Sequence
  source: /note="Description of Artificial Sequence: Synthetic oligonucleotide"
gaaauacuccgguuccgucc

SEQ ID NO: 6999 - RNA, 20 nt, Artificial Sequence
  source: /note="Description of Artificial Sequence: Synthetic oligonucleotide"
cgugaaauacuccgguuccg

SEQ ID NO: 7000 - RNA, 20 nt, Artificial Sequence
  source: /note="Description of Artificial Sequence: Synthetic oligonucleotide"
ggaucgugaaauacuccggu

SEQ ID NO: 7001 - RNA, 20 nt, Artificial Sequence
  source: /note="Description of Artificial Sequence: Synthetic oligonucleotide"
uuuugaggaucgugaaauac

SEQ ID NO: 7002 - RNA, 20 nt, Artificial Sequence
  source: /note="Description of Artificial Sequence: Synthetic oligonucleotide"
auauauagcauuguacugua

SEQ ID NO: 7003 - RNA, 20 nt, Artificial Sequence
  source: /note="Description of Artificial Sequence: Synthetic oligonucleotide"
cucgauacuuggucuuuggu

SEQ ID NO: 7004 - RNA, 20 nt, Artificial Sequence
  source: /note="Description of Artificial Sequence: Synthetic oligonucleotide"
uucugacauuuuucccuaua

SEQ ID NO: 7005 - RNA, 20 nt, Artificial Sequence
  source: /note="Description of Artificial Sequence: Synthetic oligonucleotide"
gauuguuuucugacauuuuu

SEQ ID NO: 7006 - RNA, 20 nt, Artificial Sequence
  source: /note="Description of Artificial Sequence: Synthetic oligonucleotide"
agauuguuuucugacauuuu

SEQ ID NO: 7007 - RNA, 20 nt, Artificial Sequence
  source: /note="Description of Artificial Sequence: Synthetic oligonucleotide"
caaaagauuccggacggggc

SEQ ID NO: 7008 - RNA, 20 nt, Artificial Sequence
  source: /note="Description of Artificial Sequence: Synthetic oligonucleotide"
uccucucuaagacaaaagau

SEQ ID NO: 7009 - RNA, 20 nt, Artificial Sequence
  source: /note="Description of Artificial Sequence: Synthetic oligonucleotide"
cccuguucacuuuccuuccg

SEQ ID NO: 7010 - RNA, 20 nt, Artificial Sequence
  source: /note="Description of Artificial Sequence: Synthetic oligonucleotide"
agcccccuguucacuuuccu

SEQ ID NO: 7011 - RNA, 20 nt, Artificial Sequence
  source: /note="Description of Artificial Sequence: Synthetic oligonucleotide"
agggagcccccuguucacuu

SEQ ID NO: 7012 - RNA, 20 nt, Artificial Sequence
  source: /note="Description of Artificial Sequence: Synthetic oligonucleotide"
uuuuuuuuuuagagggagcc

SEQ ID NO: 7013 - RNA, 20 nt, Artificial Sequence
  source: /note="Description of Artificial Sequence: Synthetic oligonucleotide"
uuuuuuuuuuuagagggagc

SEQ ID NO: 7014 - RNA, 20 nt, Artificial Sequence
  source: /note="Description of Artificial Sequence: Synthetic oligonucleotide"
uuuuuuuuuuuuagagggag

SEQ ID NO: 7015 - RNA, 20 nt, Artificial Sequence
  source: /note="Description of Artificial Sequence: Synthetic oligonucleotide"
uuuuuuuuuuuuuagaggga

SEQ ID NO: 7016 - RNA, 20 nt, Artificial Sequence
  source: /note="Description of Artificial Sequence: Synthetic oligonucleotide"
ugaggucggacccacugugu

SEQ ID NO: 7017 - RNA, 20 nt, Artificial Sequence
  source: /note="Description of Artificial Sequence: Synthetic oligonucleotide"
gugaggucggacccacugug

SEQ ID NO: 7018 - RNA, 20 nt, Artificial Sequence
  source: /note="Description of Artificial Sequence: Synthetic oligonucleotide"
uguggugacgugaggucgga

SEQ ID NO: 7019 - RNA, 20 nt, Artificial Sequence
  source: /note="Description of Artificial Sequence: Synthetic oligonucleotide"
guguggugacgugaggucgg

SEQ ID NO: 7020 - RNA, 20 nt, Artificial Sequence
  source: /note="Description of Artificial Sequence: Synthetic oligonucleotide"
uuggauccuccgacuccgac

SEQ ID NO: 7021 - RNA, 20 nt, Artificial Sequence
  source: /note="Description of Artificial Sequence: Synthetic oligonucleotide"
acgaacuuggauccuccgac

SEQ ID NO: 7022 - RNA, 20 nt, Artificial Sequence
  source: /note="Description of Artificial Sequence: Synthetic oligonucleotide"
cuccuaacgaacuuggaucc

SEQ ID NO: 7023 - RNA, 20 nt, Artificial Sequence
  source: /note="Description of Artificial Sequence: Synthetic oligonucleotide"
acccuccuaacgaacuugga

SEQ ID NO: 7024 - RNA, 20 nt, Artificial Sequence
  source: /note="Description of Artificial Sequence: Synthetic oligonucleotide"
ugaacccuccgacucuaccc

SEQ ID NO: 7025 - RNA, 20 nt, Artificial Sequence
  source: /note="Description of Artificial Sequence: Synthetic oligonucleotide"
ccaugaacccuccgacucua

SEQ ID NO: 7026 - RNA, 20 nt, Artificial Sequence
  source: /note="Description of Artificial Sequence: Synthetic oligonucleotide"
uccaugaacccuccgacucu

SEQ ID NO: 7027 - RNA, 20 nt, Artificial Sequence
  source: /note="Description of Artificial Sequence: Synthetic oligonucleotide"
acaucaggguccaugaaccc

SEQ ID NO: 7028 - RNA, 20 nt, Artificial Sequence
  source: /note="Description of Artificial Sequence: Synthetic oligonucleotide"
cggacaucaggguccaugaa

SEQ ID NO: 7029 - RNA, 20 nt, Artificial Sequence
  source: /note="Description of Artificial Sequence: Synthetic oligonucleotide"
acggacaucaggguccauga

SEQ ID NO: 7030 - RNA, 20 nt, Artificial Sequence
  source: /note="Description of Artificial Sequence: Synthetic oligonucleotide"
accguacacggacaucaggg

SEQ ID NO: 7031 - RNA, 20 nt, Artificial Sequence
  source: /note="Description of Artificial Sequence: Synthetic oligonucleotide"
uuuuuuuuacgguccacacc

SEQ ID NO: 7032 - RNA, 20 nt, Artificial Sequence
  source: /note="Description of Artificial Sequence: Synthetic oligonucleotide"
uuuuuuuuuuuacgguccac

SEQ ID NO: 7033 - RNA, 20 nt, Artificial Sequence
  source: /note="Description of Artificial Sequence: Synthetic oligonucleotide"
uuuuuuuuuuuuuuuuacgg

SEQ ID NO: 7034 - RNA, 20 nt, Artificial Sequence
  source: /note="Description of Artificial Sequence: Synthetic oligonucleotide"
ccuccggucugacccguugu

SEQ ID NO: 7035 - RNA, 20 nt, Artificial Sequence
  source: /note="Description of Artificial Sequence: Synthetic oligonucleotide"
guccucgaccuccggucuga

SEQ ID NO: 7036 - RNA, 20 nt, Artificial Sequence
  source: /note="Description of Artificial Sequence: Synthetic oligonucleotide"
gguccucgaccuccggucug

SEQ ID NO: 7037 - RNA, 20 nt, Artificial Sequence
  source: /note="Description of Artificial Sequence: Synthetic oligonucleotide"
gugaacucggguccucgacc

SEQ ID NO: 7038 - RNA, 20 nt, Artificial Sequence
  source: /note="Description of Artificial Sequence: Synthetic oligonucleotide"
cuagugaacucggguccucg

SEQ ID NO: 7039 - RNA, 20 nt, Artificial Sequence
  source: /note="Description of Artificial Sequence: Synthetic oligonucleotide"
acccaccuagugaacucggg

SEQ ID NO: 7040 - RNA, 20 nt, Artificial Sequence
  source: /note="Description of Artificial Sequence: Synthetic oligonucleotide"
caccaaacucgguuccaccc

SEQ ID NO: 7041 - RNA, 20 nt, Artificial Sequence
  source: /note="Description of Artificial Sequence: Synthetic oligonucleotide"
caccaccaaacucgguucca

SEQ ID NO: 7042 - RNA, 20 nt, Artificial Sequence
  source: /note="Description of Artificial Sequence: Synthetic oligonucleotide"
acaccaccaaacucgguucc

SEQ ID NO: 7043 - RNA, 20 nt, Artificial Sequence
  source: /note="Description of Artificial Sequence: Synthetic oligonucleotide"
cccacaccaccaaacucggu

SEQ ID NO: 7044 - RNA, 20 nt, Artificial Sequence
  source: /note="Description of Artificial Sequence: Synthetic oligonucleotide"
agggagucccaacccacacc

SEQ ID NO: 7045 - RNA, 20 nt, Artificial Sequence
  source: /note="Description of Artificial Sequence: Synthetic oligonucleotide"
uagagggagucccaacccac

SEQ ID NO: 7046 - RNA, 20 nt, Artificial Sequence
  source: /note="Description of Artificial Sequence: Synthetic oligonucleotide"
aaucuuagagggagucccaa

SEQ ID NO: 7047 - RNA, 20 nt, Artificial Sequence
  source: /note="Description of Artificial Sequence: Synthetic oligonucleotide"
uaaucuuagagggaguccca

SEQ ID NO: 7048 - RNA, 20 nt, Artificial Sequence
  source: /note="Description of Artificial Sequence: Synthetic oligonucleotide"
cuucuaaucuuagagggagu

SEQ ID NO: 7049 - RNA, 20 nt, Artificial Sequence
  source: /note="Description of Artificial Sequence: Synthetic oligonucleotide"
ccuucuaaucuuagagggag

SEQ ID NO: 7050 - RNA, 20 nt, Artificial Sequence
  source: /note="Description of Artificial Sequence: Synthetic oligonucleotide"
cugaguuuuagucuucccac

SEQ ID NO: 7051 - RNA, 20 nt, Artificial Sequence
  source: /note="Description of Artificial Sequence: Synthetic oligonucleotide"
ucugaguuuuagucuuccca

SEQ ID NO: 7052 - RNA, 20 nt, Artificial Sequence
  source: /note="Description of Artificial Sequence: Synthetic oligonucleotide"
uucugaguuuuagucuuccc

SEQ ID NO: 7053 - RNA, 20 nt, Artificial Sequence
  source: /note="Description of Artificial Sequence: Synthetic oligonucleotide"
aaauucugaguuuuagucuu

SEQ ID NO: 7054 - RNA, 20 nt, Artificial Sequence
  source: /note="Description of Artificial Sequence: Synthetic oligonucleotide"
aaaauucugaguuuuagucu

SEQ ID NO: 7055 - RNA, 20 nt, Artificial Sequence
  source: /note="Description of Artificial Sequence: Synthetic oligonucleotide"
uuucccacccuggaagagac

SEQ ID NO: 7056 - RNA, 20 nt, Artificial Sequence
  source: /note="Description of Artificial Sequence: Synthetic oligonucleotide"
guuucccacccuggaagaga

SEQ ID NO: 7057 - RNA, 20 nt, Artificial Sequence
  source: /note="Description of Artificial Sequence: Synthetic oligonucleotide"
cguuucccacccuggaagag

SEQ ID NO: 7058 - RNA, 20 nt, Artificial Sequence
  source: /note="Description of Artificial Sequence: Synthetic oligonucleotide"
gaaaggggucacguuuccca

SEQ ID NO: 7059 - RNA, 20 nt, Artificial Sequence
  source: /note="Description of Artificial Sequence: Synthetic oligonucleotide"
ggaaaggggucacguuuccc

SEQ ID NO: 7060 - RNA, 20 nt, Artificial Sequence
  source: /note="Description of Artificial Sequence: Synthetic oligonucleotide"
uaaggaaaggggucacguuu

SEQ ID NO: 7061 - RNA, 20 nt, Artificial Sequence
  source: /note="Description of Artificial Sequence: Synthetic oligonucleotide"
guaaggaaaggggucacguu

SEQ ID NO: 7062 - RNA, 20 nt, Artificial Sequence
  source: /note="Description of Artificial Sequence: Synthetic oligonucleotide"
uaggaggacucaaaaauacc

SEQ ID NO: 7063 - RNA, 20 nt, Artificial Sequence
  source: /note="Description of Artificial Sequence: Synthetic oligonucleotide"
aguuaggaggacucaaaaau

SEQ ID NO: 7064 - RNA, 20 nt, Artificial Sequence
  source: /note="Description of Artificial Sequence: Synthetic oligonucleotide"
guggaagguccuuggaggug

SEQ ID NO: 7065 - RNA, 20 nt, Artificial Sequence
  source: /note="Description of Artificial Sequence: Synthetic oligonucleotide"
gggaccuacucgguggaagg

SEQ ID NO: 7066 - RNA, 20 nt, Artificial Sequence
  source: /note="Description of Artificial Sequence: Synthetic oligonucleotide"
gccucgaagauucaggaggg

SEQ ID NO: 7067 - RNA, 20 nt, Artificial Sequence
  source: /note="Description of Artificial Sequence: Synthetic oligonucleotide"
acuucauauuccuuucacgu

SEQ ID NO: 7068 - RNA, 20 nt, Artificial Sequence
  source: /note="Description of Artificial Sequence: Synthetic oligonucleotide"
cuacgaaucccacuucauau

SEQ ID NO: 7069 - RNA, 20 nt, Artificial Sequence
  source: /note="Description of Artificial Sequence: Synthetic oligonucleotide"
augucuacuucucuacgaau

SEQ ID NO: 7070 - RNA, 20 nt, Artificial Sequence
  source: /note="Description of Artificial Sequence: Synthetic oligonucleotide"
uaugucuacuucucuacgaa

SEQ ID NO: 7071 - RNA, 20 nt, Artificial Sequence
  source: /note="Description of Artificial Sequence: Synthetic oligonucleotide"
auauaaacgaccaaauaguu

SEQ ID NO: 7072 - RNA, 20 nt, Artificial Sequence
  source: /note="Description of Artificial Sequence: Synthetic oligonucleotide"
uuugugaaugaauauaaacg

SEQ ID NO: 7073 - RNA, 20 nt, Artificial Sequence
  source: /note="Description of Artificial Sequence: Synthetic oligonucleotide"
gagaaacccaaguuaugcaa

SEQ ID NO: 7074 - RNA, 20 nt, Artificial Sequence
  source: /note="Description of Artificial Sequence: Synthetic oligonucleotide"
caaggguguugugggagaaa

SEQ ID NO: 7075 - RNA, 20 nt, Artificial Sequence
  source: /note="Description of Artificial Sequence: Synthetic oligonucleotide"
ccaaggguguugugggagaa

SEQ ID NO: 7076 - RNA, 20 nt, Artificial Sequence
  source: /note="Description of Artificial Sequence: Synthetic oligonucleotide"
cugguuggucgaagcucaac

SEQ ID NO: 7077 - RNA, 20 nt, Artificial Sequence
  source: /note="Description of Artificial Sequence: Synthetic oligonucleotide"
acugguuggucgaagcucaa

SEQ ID NO: 7078 - RNA, 20 nt, Artificial Sequence
  source: /note="Description of Artificial Sequence: Synthetic oligonucleotide"
gacugguuggucgaagcuca

SEQ ID NO: 7079 - RNA, 20 nt, Artificial Sequence
  source: /note="Description of Artificial Sequence: Synthetic oligonucleotide"
gucuguguucaguguuuagg

SEQ ID NO: 7080 - RNA, 20 nt, Artificial Sequence
  source: /note="Description of Artificial Sequence: Synthetic oligonucleotide"
cacaggagguuaaauuaagg

SEQ ID NO: 7081 - RNA, 20 nt, Artificial Sequence
  source: /note="Description of Artificial Sequence: Synthetic oligonucleotide"
uguucgucgucugugaucga

SEQ ID NO: 7082 - RNA, 20 nt, Artificial Sequence
  source: /note="Description of Artificial Sequence: Synthetic oligonucleotide"
uuguucgucgucugugaucg

SEQ ID NO: 7083 - RNA, 20 nt, Artificial Sequence
  source: /note="Description of Artificial Sequence: Synthetic oligonucleotide"
agaacacugguuuacacacu

SEQ ID NO: 7084 - RNA, 20 nt, Artificial Sequence
  source: /note="Description of Artificial Sequence: Synthetic oligonucleotide"
gagaacacugguuuacacac

SEQ ID NO: 7085 - RNA, 20 nt, Artificial Sequence
  source: /note="Description of Artificial Sequence: Synthetic oligonucleotide"
aucacugccuauggcacaca

SEQ ID NO: 7086 - RNA, 20 nt, Artificial Sequence
  source: /note="Description of Artificial Sequence: Synthetic oligonucleotide"
cauauucuuaucacugccua

SEQ ID NO: 7087 - RNA, 20 nt, Artificial Sequence
  source: /note="Description of Artificial Sequence: Synthetic oligonucleotide"
aggucucauguagcauuuuc

SEQ ID NO: 7088 - RNA, 20 nt, Artificial Sequence
  source: /note="Description of Artificial Sequence: Synthetic oligonucleotide"
gaaaauuagauuuuauaaaa

SEQ ID NO: 7089 - RNA, 20 nt, Artificial Sequence
  source: /note="Description of Artificial Sequence: Synthetic oligonucleotide"
uuuucuagaacauuauuuca

SEQ ID NO: 7090 - RNA, 20 nt, Artificial Sequence
  source: /note="Description of Artificial Sequence: Synthetic oligonucleotide"
gaauaauaauucaggcuuuu

SEQ ID NO: 7091 - RNA, 20 nt, Artificial Sequence
  source: /note="Description of Artificial Sequence: Synthetic oligonucleotide"
aaugugcugaauaauaauuc

SEQ ID NO: 7092 - RNA, 20 nt, Artificial Sequence
  source: /note="Description of Artificial Sequence: Synthetic oligonucleotide"
cucagaggcauuucuaacuc

SEQ ID NO: 7093 - RNA, 20 nt, Artificial Sequence
  source: /note="Description of Artificial Sequence: Synthetic oligonucleotide"
aacucuaaaucuuuucucag

SEQ ID NO: 7094 - RNA, 20 nt, Artificial Sequence
  source: /note="Description of Artificial Sequence: Synthetic oligonucleotide"
ugcauuauugaagcagugcu

SEQ ID NO: 7095 - RNA, 20 nt, Artificial Sequence
  source: /note="Description of Artificial Sequence: Synthetic oligonucleotide"
cugcauuauugaagcagugc

SEQ ID NO: 7096 - RNA, 20 nt, Artificial Sequence
  source: /note="Description of Artificial Sequence: Synthetic oligonucleotide"
gauaagggggaaaaaaaaac

SEQ ID NO: 7097 - RNA, 20 nt, Artificial Sequence
  source: /note="Description of Artificial Sequence: Synthetic oligonucleotide"
uaaaaucacugcagauaagg

SEQ ID NO: 7098 - RNA, 20 nt, Artificial Sequence
  source: /note="Description of Artificial Sequence: Synthetic oligonucleotide"
guaaaaucacugcagauaag

SEQ ID NO: 7099 - RNA, 20 nt, Artificial Sequence
  source: /note="Description of Artificial Sequence: Synthetic oligonucleotide"
gguaaaaucacugcagauaa

SEQ ID NO: 7100 - RNA, 20 nt, Artificial Sequence
  source: /note="Description of Artificial Sequence: Synthetic oligonucleotide"
ugguaaaaucacugcagaua

SEQ ID NO: 7101 - RNA, 20 nt, Artificial Sequence
  source: /note="Description of Artificial Sequence: Synthetic oligonucleotide"
uaagauguagcaugaagaga

SEQ ID NO: 7102 - RNA, 20 nt, Artificial Sequence
  source: /note="Description of Artificial Sequence: Synthetic oligonucleotide"
auguuucaauguucucuuug

SEQ ID NO: 7103 - RNA, 20 nt, Artificial Sequence
  source: /note="Description of Artificial Sequence: Synthetic oligonucleotide"
ccagaaaugaguuggcauuc

SEQ ID NO: 7104 - RNA, 20 nt, Artificial Sequence
  source: /note="Description of Artificial Sequence: Synthetic oligonucleotide"
uuagaaccccagaaaugagu

SEQ ID NO: 7105 - RNA, 20 nt, Artificial Sequence
  source: /note="Description of Artificial Sequence: Synthetic oligonucleotide"
ugcucugcuaaaaaagguua

SEQ ID NO: 7106 - RNA, 20 nt, Artificial Sequence
  source: /note="Description of Artificial Sequence: Synthetic oligonucleotide"
cuacacugcucugcuaaaaa

SEQ ID NO: 7107 - RNA, 20 nt, Artificial Sequence
  source: /note="Description of Artificial Sequence: Synthetic oligonucleotide"
uuacucaggccgaccauuua

SEQ ID NO: 7108 - RNA, 20 nt, Artificial Sequence
  source: /note="Description of Artificial Sequence: Synthetic oligonucleotide"
uuacaguuaaaauguuacuc

SEQ ID NO: 7109 - RNA, 20 nt, Artificial Sequence
  source: /note="Description of Artificial Sequence: Synthetic oligonucleotide"
ugucagacaugucucuucaa

SEQ ID NO: 7110 - RNA, 20 nt, Artificial Sequence
  source: /note="Description of Artificial Sequence: Synthetic oligonucleotide"
aaagguacuuuagucacaca

SEQ ID NO: 7111 - RNA, 20 nt, Artificial Sequence
  source: /note="Description of Artificial Sequence: Synthetic oligonucleotide"
gguugaucucuuaauagaaa

SEQ ID NO: 7112 - RNA, 20 nt, Artificial Sequence
  source: /note="Description of Artificial Sequence: Synthetic oligonucleotide"
caaagaguagaaggaaaugg

SEQ ID NO: 7113 - RNA, 20 nt, Artificial Sequence
  source: /note="Description of Artificial Sequence: Synthetic oligonucleotide"
gaacaaagaguagaaggaaa

SEQ ID NO: 7114 - RNA, 20 nt, Artificial Sequence
  source: /note="Description of Artificial Sequence: Synthetic oligonucleotide"
aggggagaacaaagaguaga

SEQ ID NO: 7115 - RNA, 20 nt, Artificial Sequence
  source: /note="Description of Artificial Sequence: Synthetic oligonucleotide"
cugaauuaacuuuauuuaag

SEQ ID NO: 7116 - RNA, 20 nt, Artificial Sequence
  source: /note="Description of Artificial Sequence: Synthetic oligonucleotide"
gcugaauuaacuuuauuuaa

SEQ ID NO: 7117 - RNA, 20 nt, Artificial Sequence
  source: /note="Description of Artificial Sequence: Synthetic oligonucleotide"
agcugaauuaacuuuauuua

SEQ ID NO: 7118 - RNA, 20 nt, Artificial Sequence
  source: /note="Description of Artificial Sequence: Synthetic oligonucleotide"
uagcucuaauauucacagca

SEQ ID NO: 7119 - RNA, 20 nt, Artificial Sequence
  source: /note="Description of Artificial Sequence: Synthetic oligonucleotide"
uccuuuuguuuuagucagcg

SEQ ID NO: 7120 - RNA, 20 nt, Artificial Sequence
  source: /note="Description of Artificial Sequence: Synthetic oligonucleotide"
cucuaucguauccaucuuuu

SEQ ID NO: 7121 - RNA, 20 nt, Artificial Sequence
  source: /note="Description of Artificial Sequence: Synthetic oligonucleotide"
aaauguucugcuuuaaccug

SEQ ID NO: 7122 - RNA, 20 nt, Artificial Sequence
  source: /note="Description of Artificial Sequence: Synthetic oligonucleotide"
gauuguagaggaaaacaucu

SEQ ID NO: 7123 - RNA, 20 nt, Artificial Sequence
  source: /note="Description of Artificial Sequence: Synthetic oligonucleotide"
gaacaaaaacaggauuguag

SEQ ID NO: 7124 - RNA, 20 nt, Artificial Sequence
  source: /note="Description of Artificial Sequence: Synthetic oligonucleotide"
auuuuucauagaacaaaaac

SEQ ID NO: 7125 - RNA, 20 nt, Artificial Sequence
  source: /note="Description of Artificial Sequence: Synthetic oligonucleotide"
uagugaaugauccaaguuua

SEQ ID NO: 7126 - RNA, 20 nt, Artificial Sequence
  source: /note="Description of Artificial Sequence: Synthetic oligonucleotide"
auauaaccuuaacauuaccu

SEQ ID NO: 7127 - RNA, 20 nt, Artificial Sequence
  source: /note="Description of Artificial Sequence: Synthetic oligonucleotide"
cucaaaaaaucuaaacauuu

SEQ ID NO: 7128 - RNA, 20 nt, Artificial Sequence
  source: /note="Description of Artificial Sequence: Synthetic oligonucleotide"
uucauagagaaugcagggag

SEQ ID NO: 7129 - RNA, 20 nt, Artificial Sequence
  source: /note="Description of Artificial Sequence: Synthetic oligonucleotide"
cuucauagagaaugcaggga

SEQ ID NO: 7130 - RNA, 20 nt, Artificial Sequence
  source: /note="Description of Artificial Sequence: Synthetic oligonucleotide"
ucuucauagagaaugcaggg

SEQ ID NO: 7131 - RNA, 20 nt, Artificial Sequence
  source: /note="Description of Artificial Sequence: Synthetic oligonucleotide"
guaucuucauagagaaugca

SEQ ID NO: 7132 - RNA, 20 nt, Artificial Sequence
  source: /note="Description of Artificial Sequence: Synthetic oligonucleotide"
uguaucuucauagagaaugc

SEQ ID NO: 7133 - RNA, 20 nt, Artificial Sequence
  source: /note="Description of Artificial Sequence: Synthetic oligonucleotide"
ucuguucauaggauauaauu

SEQ ID NO: 7134 - RNA, 20 nt, Artificial Sequence
  source: /note="Description of Artificial Sequence: Synthetic oligonucleotide"
gaagagaaaggucuguucau

SEQ ID NO: 7135 - RNA, 20 nt, Artificial Sequence
  source: /note="Description of Artificial Sequence: Synthetic oligonucleotide"
ugccuuugaaaugaagagaa

SEQ ID NO: 7136 - RNA, 20 nt, Artificial Sequence
  source: /note="Description of Artificial Sequence: Synthetic oligonucleotide"
gaguucauuuucaagagcaa

SEQ ID NO: 7137 - RNA, 20 nt, Artificial Sequence
  source: /note="Description of Artificial Sequence: Synthetic oligonucleotide"
cugaugagaaccuguggacu

SEQ ID NO: 7138 - RNA, 20 nt, Artificial Sequence
  source: /note="Description of Artificial Sequence: Synthetic oligonucleotide"
gaggcacugaugagaaccug

SEQ ID NO: 7139 - RNA, 20 nt, Artificial Sequence
  source: /note="Description of Artificial Sequence: Synthetic oligonucleotide"
uaaucugugcauagaucuug

SEQ ID NO: 7140 - RNA, 20 nt, Artificial Sequence
  source: /note="Description of Artificial Sequence: Synthetic oligonucleotide"
aagguaccuuaucguaugaa

SEQ ID NO: 7141 - RNA, 20 nt, Artificial Sequence
  source: /note="Description of Artificial Sequence: Synthetic oligonucleotide"
gacuuauuugucauaaaggu

SEQ ID NO: 7142 - RNA, 20 nt, Artificial Sequence
  source: /note="Description of Artificial Sequence: Synthetic oligonucleotide"
uuuguguccuaguaacaaau

SEQ ID NO: 7143 - RNA, 20 nt, Artificial Sequence
  source: /note="Description of Artificial Sequence: Synthetic oligonucleotide"
aggaccuguauuacuuugug

SEQ ID NO: 7144 - RNA, 20 nt, Artificial Sequence
  source: /note="Description of Artificial Sequence: Synthetic oligonucleotide"
uccacgacacaccguaaagg

SEQ ID NO: 7145 - RNA, 20 nt, Artificial Sequence
  source: /note="Description of Artificial Sequence: Synthetic oligonucleotide"
uacagaccuuuccacgacac

SEQ ID NO: 7146 - RNA, 20 nt, Artificial Sequence
  source: /note="Description of Artificial Sequence: Synthetic oligonucleotide"
acuacuauccuacagaccuu

SEQ ID NO: 7147 - RNA, 20 nt, Artificial Sequence
  source: /note="Description of Artificial Sequence: Synthetic oligonucleotide"
auuauacuacuauccuacag

SEQ ID NO: 7148 - RNA, 20 nt, Artificial Sequence
  source: /note="Description of Artificial Sequence: Synthetic oligonucleotide"
uuucagaaauuauacuacua

SEQ ID NO: 7149 - RNA, 20 nt, Artificial Sequence
  source: /note="Description of Artificial Sequence: Synthetic oligonucleotide"
uuaaaacaaagaaauuacgu

SEQ ID NO: 7150 - RNA, 20 nt, Artificial Sequence
  source: /note="Description of Artificial Sequence: Synthetic oligonucleotide"
uuaacguguaauuuuaaaaa

SEQ ID NO: 7151 - RNA, 20 nt, Artificial Sequence
  source: /note="Description of Artificial Sequence: Synthetic oligonucleotide"
aucuaugggacugguucuuu

SEQ ID NO: 7152 - RNA, 20 nt, Artificial Sequence
  source: /note="Description of Artificial Sequence: Synthetic oligonucleotide"
uaucuaugggacugguucuu

SEQ ID NO: 7153 - RNA, 20 nt, Artificial Sequence
  source: /note="Description of Artificial Sequence: Synthetic oligonucleotide"
gugauaucuaucuaugggac

SEQ ID NO: 7154 - RNA, 20 nt, Artificial Sequence
  source: /note="Description of Artificial Sequence: Synthetic oligonucleotide"
cauaugugauaucuaucuau

SEQ ID NO: 7155 - RNA, 20 nt, Artificial Sequence
  source: /note="Description of Artificial Sequence: Synthetic oligonucleotide"
ucauaugugauaucuaucua

SEQ ID NO: 7156 - RNA, 20 nt, Artificial Sequence
  source: /note="Description of Artificial Sequence: Synthetic oligonucleotide"
agagauguguccuaaugugu

SEQ ID NO: 7157 - RNA, 20 nt, Artificial Sequence
  source: /note="Description of Artificial Sequence: Synthetic oligonucleotide"
uucuucguccaggauccguu

SEQ ID NO: 7158 - RNA, 20 nt, Artificial Sequence
  source: /note="Description of Artificial Sequence: Synthetic oligonucleotide"
cuguaauucuucguccagga

SEQ ID NO: 7159 - RNA, 20 nt, Artificial Sequence
  source: /note="Description of Artificial Sequence: Synthetic oligonucleotide"
uuaaaaacuguaauucuucg

SEQ ID NO: 7160 - RNA, 20 nt, Artificial Sequence
  source: /note="Description of Artificial Sequence: Synthetic oligonucleotide"
agacgcccucucuauuuuaa

SEQ ID NO: 7161 - RNA, 20 nt, Artificial Sequence
  source: /note="Description of Artificial Sequence: Synthetic oligonucleotide"
gagacgcccucucuauuuua

SEQ ID NO: 7162 - RNA, 20 nt, Artificial Sequence
  source: /note="Description of Artificial Sequence: Synthetic oligonucleotide"
aagugagcucaguugagacg

SEQ ID NO: 7163 - RNA, 20 nt, Artificial Sequence
  source: /note="Description of Artificial Sequence: Synthetic oligonucleotide"
gaagugagcucaguugagac

SEQ ID NO: 7164 - RNA, 20 nt, Artificial Sequence
  source: /note="Description of Artificial Sequence: Synthetic oligonucleotide"
aaagcaaguacccuggacag

SEQ ID NO: 7165 - RNA, 20 nt, Artificial Sequence
  source: /note="Description of Artificial Sequence: Synthetic oligonucleotide"
ugcccuuaaagcaaguaccc

SEQ ID NO: 7166 - RNA, 20 nt, Artificial Sequence
  source: /note="Description of Artificial Sequence: Synthetic oligonucleotide"
cuucaucuucaagaaucacu

SEQ ID NO: 7167 - RNA, 20 nt, Artificial Sequence
  source: /note="Description of Artificial Sequence: Synthetic oligonucleotide"
ucuucaucuucaagaaucac

SEQ ID NO: 7168 - RNA, 20 nt, Artificial Sequence
  source: /note="Description of Artificial Sequence: Synthetic oligonucleotide"
uuaaaaagcuuucuucauug

SEQ ID NO: 7169 - RNA, 20 nt, Artificial Sequence
  source: /note="Description of Artificial Sequence: Synthetic oligonucleotide"
cauaaauucuucuauggggc

SEQ ID NO: 7170 - RNA, 20 nt, Artificial Sequence
  source: /note="Description of Artificial Sequence: Synthetic oligonucleotide"
ggaacauaaauucuucuaug

SEQ ID NO: 7171 - RNA, 20 nt, Artificial Sequence
  source: /note="Description of Artificial Sequence: Synthetic oligonucleotide"
aggaacauaaauucuucuau

SEQ ID NO: 7172 - RNA, 20 nt, Artificial Sequence
  source: /note="Description of Artificial Sequence: Synthetic oligonucleotide"
uaggaacauaaauucuucua

SEQ ID NO: 7173 - RNA, 20 nt, Artificial Sequence
  source: /note="Description of Artificial Sequence: Synthetic oligonucleotide"
gccaauaugaucacaucacu

SEQ ID NO: 7174 - RNA, 20 nt, Artificial Sequence
  source: /note="Description of Artificial Sequence: Synthetic oligonucleotide"
uuggaaaagaaacacuggau

SEQ ID NO: 7175 - RNA, 20 nt, Artificial Sequence
  source: /note="Description of Artificial Sequence: Synthetic oligonucleotide"
uguccuuggaaaagaaacac

SEQ ID NO: 7176 - RNA, 20 nt, Artificial Sequence
  source: /note="Description of Artificial Sequence: Synthetic oligonucleotide"
cuccuuaucaguacuguccu

SEQ ID NO: 7177 - RNA, 20 nt, Artificial Sequence
  source: /note="Description of Artificial Sequence: Synthetic oligonucleotide"
ucaggacaaagagguagauu

SEQ ID NO: 7178 - RNA, 20 nt, Artificial Sequence
  source: /note="Description of Artificial Sequence: Synthetic oligonucleotide"
augaucuguucaggacaaag

SEQ ID NO: 7179 - RNA, 20 nt, Artificial Sequence
  source: /note="Description of Artificial Sequence: Synthetic oligonucleotide"
uagauggagaugaucuguuc

SEQ ID NO: 7180 - RNA, 20 nt, Artificial Sequence
  source: /note="Description of Artificial Sequence: Synthetic oligonucleotide"
ugagccaaacuaugaauaga

SEQ ID NO: 7181 - RNA, 20 nt, Artificial Sequence
  source: /note="Description of Artificial Sequence: Synthetic oligonucleotide"
ggcauggcauagccgacaug

SEQ ID NO: 7182 - RNA, 20 nt, Artificial Sequence
  source: /note="Description of Artificial Sequence: Synthetic oligonucleotide"
gcuaaaagaacgaaacggca

SEQ ID NO: 7183 - RNA, 20 nt, Artificial Sequence
  source: /note="Description of Artificial Sequence: Synthetic oligonucleotide"
aacaagcuaaaagaacgaaa

SEQ ID NO: 7184 - RNA, 20 nt, Artificial Sequence
  source: /note="Description of Artificial Sequence: Synthetic oligonucleotide"
aagaccacuuucgguuugaa

SEQ ID NO: 7185 - RNA, 20 nt, Artificial Sequence
  source: /note="Description of Artificial Sequence: Synthetic oligonucleotide"
gaagaccacuuucgguuuga

SEQ ID NO: 7186 - RNA, 20 nt, Artificial Sequence
  source: /note="Description of Artificial Sequence: Synthetic oligonucleotide"
cucaucacgaagaccacuuu

SEQ ID NO: 7187 - RNA, 20 nt, Artificial Sequence
  source: /note="Description of Artificial Sequence: Synthetic oligonucleotide"
gcaaugauaaauaucuacug

SEQ ID NO: 7188 - RNA, 20 nt, Artificial Sequence
  source: /note="Description of Artificial Sequence: Synthetic oligonucleotide"
ggcaaugauaaauaucuacu

SEQ ID NO: 7189 - RNA, 20 nt, Artificial Sequence
  source: /note="Description of Artificial Sequence: Synthetic oligonucleotide"
uggcaaugauaaauaucuac

SEQ ID NO: 7190 - RNA, 20 nt, Artificial Sequence
  source: /note="Description of Artificial Sequence: Synthetic oligonucleotide"
uacgauacuaagagauuaac

SEQ ID NO: 7191 - RNA, 20 nt, Artificial Sequence
  source: /note="Description of Artificial Sequence: Synthetic oligonucleotide"
uuacuuguacuaauguagau

SEQ ID NO: 7192 - RNA, 20 nt, Artificial Sequence
  source: /note="Description of Artificial Sequence: Synthetic oligonucleotide"
aauuuuuaaauauuaugcuc

SEQ ID NO: 7193 - RNA, 20 nt, Artificial Sequence
  source: /note="Description of Artificial Sequence: Synthetic oligonucleotide"
aaauuuuuaaauauuaugcu

SEQ ID NO: 7194 - RNA, 20 nt, Artificial Sequence
  source: /note="Description of Artificial Sequence: Synthetic oligonucleotide"
aaaauuuuuaaauauuaugc

SEQ ID NO: 7195 - RNA, 20 nt, Artificial Sequence
  source: /note="Description of Artificial Sequence: Synthetic oligonucleotide"
ugaguuuugguugauuuaca

SEQ ID NO: 7196 - RNA, 20 nt, Artificial Sequence
  source: /note="Description of Artificial Sequence: Synthetic oligonucleotide"
cugaguuuugguugauuuac

SEQ ID NO: 7197 - RNA, 20 nt, Artificial Sequence
  source: /note="Description of Artificial Sequence: Synthetic oligonucleotide"
agaacaagaaugcugaguuu

SEQ ID NO: 7198 - RNA, 20 nt, Artificial Sequence
  source: /note="Description of Artificial Sequence: Synthetic oligonucleotide"
aagacaagacauauaccuac

SEQ ID NO: 7199 - RNA, 20 nt, Artificial Sequence
  source: /note="Description of Artificial Sequence: Synthetic oligonucleotide"
uccagaaguugcauaaaaua

SEQ ID NO: 7200 - RNA, 20 nt, Artificial Sequence
  source: /note="Description of Artificial Sequence: Synthetic oligonucleotide"
cuucuggaaacauaauuuau

SEQ ID NO: 7201 - RNA, 20 nt, Artificial Sequence
  source: /note="Description of Artificial Sequence: Synthetic oligonucleotide"
ucuucuggaaacauaauuua

SEQ ID NO: 7202 - RNA, 20 nt, Artificial Sequence
  source: /note="Description of Artificial Sequence: Synthetic oligonucleotide"
uucauuacaaaagguucuuc

SEQ ID NO: 7203 - RNA, 20 nt, Artificial Sequence
  source: /note="Description of Artificial Sequence: Synthetic oligonucleotide"
uauauauuuuucauuacaaa

SEQ ID NO: 7204 - RNA, 20 nt, Artificial Sequence
  source: /note="Description of Artificial Sequence: Synthetic oligonucleotide"
ucugaaaagcucugauaaau

SEQ ID NO: 7205 - RNA, 20 nt, Artificial Sequence
  source: /note="Description of Artificial Sequence: Synthetic oligonucleotide"
aucuucuuaaagauuaauaa

SEQ ID NO: 7206 - RNA, 20 nt, Artificial Sequence
  source: /note="Description of Artificial Sequence: Synthetic oligonucleotide"
aguuaauuuguaggauauua

SEQ ID NO: 7207 - RNA, 20 nt, Artificial Sequence
  source: /note="Description of Artificial Sequence: Synthetic oligonucleotide"
ucauguuuuaguuaauuugu

SEQ ID NO: 7208 - RNA, 20 nt, Artificial Sequence
  source: /note="Description of Artificial Sequence: Synthetic oligonucleotide"
cauuuuuauucuuccuauuu

SEQ ID NO: 7209 - RNA, 20 nt, Artificial Sequence
  source: /note="Description of Artificial Sequence: Synthetic oligonucleotide"
aacugguuaccauaacaauc

SEQ ID NO: 7210 - RNA, 20 nt, Artificial Sequence
  source: /note="Description of Artificial Sequence: Synthetic oligonucleotide"
uugaucuagucuuaaucaac

SEQ ID NO: 7211 - RNA, 20 nt, Artificial Sequence
  source: /note="Description of Artificial Sequence: Synthetic oligonucleotide"
aaggcaugccaucuauguuu

SEQ ID NO: 7212 - RNA, 20 nt, Artificial Sequence
  source: /note="Description of Artificial Sequence: Synthetic oligonucleotide"
uucccuaccauugccucaaa

SEQ ID NO: 7213 - RNA, 20 nt, Artificial Sequence
  source: /note="Description of Artificial Sequence: Synthetic oligonucleotide"
uccuuguaacacaagcauuu

SEQ ID NO: 7214 - RNA, 20 nt, Artificial Sequence
  source: /note="Description of Artificial Sequence: Synthetic oligonucleotide"
uuauuuaaaaacucuguacc

SEQ ID NO: 7215 - RNA, 20 nt, Artificial Sequence
  source: /note="Description of Artificial Sequence: Synthetic oligonucleotide"
cuaaauugucacauccccag

SEQ ID NO: 7216 - RNA, 20 nt, Artificial Sequence
  source: /note="Description of Artificial Sequence: Synthetic oligonucleotide"
acuaaauugucacaucccca

SEQ ID NO: 7217 - RNA, 20 nt, Artificial Sequence
  source: /note="Description of Artificial Sequence: Synthetic oligonucleotide"
aacuaaauugucacaucccc

SEQ ID NO: 7218 - RNA, 20 nt, Artificial Sequence
  source: /note="Description of Artificial Sequence: Synthetic oligonucleotide"
gaaauuaacuauauuagagu

SEQ ID NO: 7219 - RNA, 20 nt, Artificial Sequence
  source: /note="Description of Artificial Sequence: Synthetic oligonucleotide"
uaccccacaaagcuaucaaa

SEQ ID NO: 7220 - RNA, 20 nt, Artificial Sequence
  source: /note="Description of Artificial Sequence: Synthetic oligonucleotide"
uucagcccuaaaaucaagaa

SEQ ID NO: 7221 - RNA, 20 nt, Artificial Sequence
  source: /note="Description of Artificial Sequence: Synthetic oligonucleotide"
auaauuuaugauauauuacu

SEQ ID NO: 7222 - RNA, 20 nt, Artificial Sequence
  source: /note="Description of Artificial Sequence: Synthetic oligonucleotide"
gauaauuuaugauauauuac

SEQ ID NO: 7223 - RNA, 20 nt, Artificial Sequence
  source: /note="Description of Artificial Sequence: Synthetic oligonucleotide"
cuuaguucucauagccccuc

SEQ ID NO: 7224 - RNA, 20 nt, Artificial Sequence
  source: /note="Description of Artificial Sequence: Synthetic oligonucleotide"
ugcuccuuaguucucauagc

SEQ ID NO: 7225 - RNA, 20 nt, Artificial Sequence
  source: /note="Description of Artificial Sequence: Synthetic oligonucleotide"
uugcuccuuaguucucauag

SEQ ID NO: 7226 - RNA, 20 nt, Artificial Sequence
  source: /note="Description of Artificial Sequence: Synthetic oligonucleotide"
auugcuccuuaguucucaua

SEQ ID NO: 7227 - RNA, 20 nt, Artificial Sequence
  source: /note="Description of Artificial Sequence: Synthetic oligonucleotide"
uuuauuaucccgucgauugc

SEQ ID NO: 7228 - RNA, 20 nt, Artificial Sequence
  source: /note="Description of Artificial Sequence: Synthetic oligonucleotide"
ccuuuuuguuucuuuauuau

SEQ ID NO: 7229 - RNA, 20 nt, Artificial Sequence
  source: /note="Description of Artificial Sequence: Synthetic oligonucleotide"
cccuuuuuguuucuuuauua

SEQ ID NO: 7230 - RNA, 20 nt, Artificial Sequence
  source: /note="Description of Artificial Sequence: Synthetic oligonucleotide"
uucuuuuacaacucacgauu

SEQ ID NO: 7231 - RNA, 20 nt, Artificial Sequence
  source: /note="Description of Artificial Sequence: Synthetic oligonucleotide"
auucuuuuacaacucacgau

SEQ ID NO: 7232 - RNA, 20 nt, Artificial Sequence
  source: /note="Description of Artificial Sequence: Synthetic oligonucleotide"
ucuuucauuuaauacaccac

SEQ ID NO: 7233 - RNA, 20 nt, Artificial Sequence
  source: /note="Description of Artificial Sequence: Synthetic oligonucleotide"
guuauucuuucauuuaauac

SEQ ID NO: 7234 - RNA, 20 nt, Artificial Sequence
  source: /note="Description of Artificial Sequence: Synthetic oligonucleotide"
aaccuggacuauaagauuac

SEQ ID NO: 7235 - RNA, 20 nt, Artificial Sequence
  source: /note="Description of Artificial Sequence: Synthetic oligonucleotide"
cuauuuaugaggacagaaga

SEQ ID NO: 7236 - RNA, 20 nt, Artificial Sequence
  source: /note="Description of Artificial Sequence: Synthetic oligonucleotide"
aacuuguauaagauacacag

SEQ ID NO: 7237 - RNA, 20 nt, Artificial Sequence
  source: /note="Description of Artificial Sequence: Synthetic oligonucleotide"
guuauaaaaauaaucuguca

SEQ ID NO: 7238 - RNA, 20 nt, Artificial Sequence
  source: /note="Description of Artificial Sequence: Synthetic oligonucleotide"
guguaguuauauaaugacac

SEQ ID NO: 7239 - RNA, 20 nt, Artificial Sequence
  source: /note="Description of Artificial Sequence: Synthetic oligonucleotide"
acuuuauguaauuucuagga

SEQ ID NO: 7240 - RNA, 20 nt, Artificial Sequence
  source: /note="Description of Artificial Sequence: Synthetic oligonucleotide"
aacuuuauguaauuucuagg

SEQ ID NO: 7241 - RNA, 20 nt, Artificial Sequence
  source: /note="Description of Artificial Sequence: Synthetic oligonucleotide"
aagaacuuuauguaauuucu

SEQ ID NO: 7242 - RNA, 20 nt, Artificial Sequence
  source: /note="Description of Artificial Sequence: Synthetic oligonucleotide"
uaauguauaggccaacaaau

SEQ ID NO: 7243 - RNA, 20 nt, Artificial Sequence
  source: /note="Description of Artificial Sequence: Synthetic oligonucleotide"
guaauguauaggccaacaaa

SEQ ID NO: 7244 - RNA, 20 nt, Artificial Sequence
  source: /note="Description of Artificial Sequence: Synthetic oligonucleotide"
agguuaucuugguaauguau

SEQ ID NO: 7245 - RNA, 20 nt, Artificial Sequence
  source: /note="Description of Artificial Sequence: Synthetic oligonucleotide"
ugaaaguaaaaauauaugcc

SEQ ID NO: 7246 - RNA, 20 nt, Artificial Sequence
  source: /note="Description of Artificial Sequence: Synthetic oligonucleotide"
uuaugaaaguaaaaauauau

SEQ ID NO: 7247 - RNA, 20 nt, Artificial Sequence
  source: /note="Description of Artificial Sequence: Synthetic oligonucleotide"
ugauauuaucauauauacuc

SEQ ID NO: 7248 - RNA, 20 nt, Artificial Sequence
  source: /note="Description of Artificial Sequence: Synthetic oligonucleotide"
cugauauuaucauauauacu

SEQ ID NO: 7249 - RNA, 20 nt, Artificial Sequence
  source: /note="Description of Artificial Sequence: Synthetic oligonucleotide"
ucugauauuaucauauauac

SEQ ID NO: 7250 - RNA, 20 nt, Artificial Sequence
  source: /note="Description of Artificial Sequence: Synthetic oligonucleotide"
aauuaccgacuuaccccacu

SEQ ID NO: 7251 - RNA, 20 nt, Artificial Sequence
  source: /note="Description of Artificial Sequence: Synthetic oligonucleotide"
uucuguaauuaccgacuuac

SEQ ID NO: 7252 - RNA, 20 nt, Artificial Sequence
  source: /note="Description of Artificial Sequence: Synthetic oligonucleotide"
cuucuguaauuaccgacuua

SEQ ID NO: 7253 - RNA, 20 nt, Artificial Sequence
  source: /note="Description of Artificial Sequence: Synthetic oligonucleotide"
ucuucuguaauuaccgacuu

SEQ ID NO: 7254 - RNA, 20 nt, Artificial Sequence
  source: /note="Description of Artificial Sequence: Synthetic oligonucleotide"
ggaccaguucuucuguaauu

SEQ ID NO: 7255 - RNA, 20 nt, Artificial Sequence
  source: /note="Description of Artificial Sequence: Synthetic oligonucleotide"
cgacauuuuuaauacaaugg

SEQ ID NO: 7256 - RNA, 20 nt, Artificial Sequence
  source: /note="Description of Artificial Sequence: Synthetic oligonucleotide"
uuuaacaagauuauugguuu

SEQ ID NO: 7257 - RNA, 20 nt, Artificial Sequence
  source: /note="Description of Artificial Sequence: Synthetic oligonucleotide"
aacccucaaaauuuuacuua

SEQ ID NO: 7258 - RNA, 20 nt, Artificial Sequence
  source: /note="Description of Artificial Sequence: Synthetic oligonucleotide"
gugacugaguccgaacucaa

SEQ ID NO: 7259 - RNA, 20 nt, Artificial Sequence
  source: /note="Description of Artificial Sequence: Synthetic oligonucleotide"
ugugacugaguccgaacuca

SEQ ID NO: 7260 - RNA, 20 nt, Artificial Sequence
  source: /note="Description of Artificial Sequence: Synthetic oligonucleotide"
acccucuucuugugacugag

SEQ ID NO: 7261 - RNA, 20 nt, Artificial Sequence
  source: /note="Description of Artificial Sequence: Synthetic oligonucleotide"
ggucacaaauucaaacacga

SEQ ID NO: 7262 - RNA, 20 nt, Artificial Sequence
  source: /note="Description of Artificial Sequence: Synthetic oligonucleotide"
cggucacaaauucaaacacg

SEQ ID NO: 7263 - RNA, 20 nt, Artificial Sequence
  source: /note="Description of Artificial Sequence: Synthetic oligonucleotide"
gaugaaaguugagguuccca

SEQ ID NO: 7264 - RNA, 20 nt, Artificial Sequence
  source: /note="Description of Artificial Sequence: Synthetic oligonucleotide"
aggggaugaaaguugagguu

SEQ ID NO: 7265 - RNA, 20 nt, Artificial Sequence
  source: /note="Description of Artificial Sequence: Synthetic oligonucleotide"
gaggggaugaaaguugaggu

SEQ ID NO: 7266 - RNA, 20 nt, Artificial Sequence
  source: /note="Description of Artificial Sequence: Synthetic oligonucleotide"
cuccccuccauaguccucac

SEQ ID NO: 7267 - RNA, 20 nt, Artificial Sequence
  source: /note="Description of Artificial Sequence: Synthetic oligonucleotide"
ucucccccuccccuccauag

SEQ ID NO: 7268 - RNA, 20 nt, Artificial Sequence
  source: /note="Description of Artificial Sequence: Synthetic oligonucleotide"
agugccaucucccccucccc

SEQ ID NO: 7269 - RNA, 20 nt, Artificial Sequence
  source: /note="Description of Artificial Sequence: Synthetic oligonucleotide"
acgagugccaucucccccuc

SEQ ID NO: 7270 - RNA, 20 nt, Artificial Sequence
  source: /note="Description of Artificial Sequence: Synthetic oligonucleotide"
cacgagugccaucucccccu

SEQ ID NO: 7271 - RNA, 20 nt, Artificial Sequence
  source: /note="Description of Artificial Sequence: Synthetic oligonucleotide"
ccacgagugccaucuccccc

SEQ ID NO: 7272 - RNA, 20 nt, Artificial Sequence
  source: /note="Description of Artificial Sequence: Synthetic oligonucleotide"
ugaccacgagugccaucucc

SEQ ID NO: 7273 - RNA, 20 nt, Artificial Sequence
  source: /note="Description of Artificial Sequence: Synthetic oligonucleotide"
gugaccacgagugccaucuc

SEQ ID NO: 7274 - RNA, 20 nt, Artificial Sequence
  source: /note="Description of Artificial Sequence: Synthetic oligonucleotide"
cgugaccacgagugccaucu

SEQ ID NO: 7275 - RNA, 20 nt, Artificial Sequence
  source: /note="Description of Artificial Sequence: Synthetic oligonucleotide"
ccgugaccacgagugccauc

SEQ ID NO: 7276 - RNA, 20 nt, Artificial Sequence
  source: /note="Description of Artificial Sequence: Synthetic oligonucleotide"
gaggauccgugaccacgagu

SEQ ID NO: 7277 - RNA, 20 nt, Artificial Sequence
  source: /note="Description of Artificial Sequence: Synthetic oligonucleotide"
gacggguuagaggauccgug

SEQ ID NO: 7278 - RNA, 20 nt, Artificial Sequence
  source: /note="Description of Artificial Sequence: Synthetic oligonucleotide"
agucaggacggguuagagga

SEQ ID NO: 7279 - RNA, 20 nt, Artificial Sequence
  source: /note="Description of Artificial Sequence: Synthetic oligonucleotide"
gucagaacaaguccacgaau

SEQ ID NO: 7280 - RNA, 20 nt, Artificial Sequence
  source: /note="Description of Artificial Sequence: Synthetic oligonucleotide"
uuucaggaggucagaacaag

SEQ ID NO: 7281 - RNA, 20 nt, Artificial Sequence
  source: /note="Description of Artificial Sequence: Synthetic oligonucleotide"
agguuaucggucaguuacgg

SEQ ID NO: 7282 - RNA, 20 nt, Artificial Sequence
  source: /note="Description of Artificial Sequence: Synthetic oligonucleotide"
agccuacggacggagugucu

SEQ ID NO: 7283 - RNA, 20 nt, Artificial Sequence
  source: /note="Description of Artificial Sequence: Synthetic oligonucleotide"
aagccuacggacggaguguc

SEQ ID NO: 7284 - RNA, 20 nt, Artificial Sequence
  source: /note="Description of Artificial Sequence: Synthetic oligonucleotide"
uacaguucuuucggucauaa

SEQ ID NO: 7285 - RNA, 20 nt, Artificial Sequence
  source: /note="Description of Artificial Sequence: Synthetic oligonucleotide"
acacgucacucucgggaaca

SEQ ID NO: 7286 - RNA, 20 nt, Artificial Sequence
  source: /note="Description of Artificial Sequence: Synthetic oligonucleotide"
uccugucuagagaggauagu

SEQ ID NO: 7287 - RNA, 20 nt, Artificial Sequence
  source: /note="Description of Artificial Sequence: Synthetic oligonucleotide"
uuccugucuagagaggauag

SEQ ID NO: 7288 - RNA, 20 nt, Artificial Sequence
  source: /note="Description of Artificial Sequence: Synthetic oligonucleotide"
gauaccacuaucuucuuuau

SEQ ID NO: 7289 - RNA, 20 nt, Artificial Sequence
  source: /note="Description of Artificial Sequence: Synthetic oligonucleotide"
uccguuucgacuucaucgau

SEQ ID NO: 7290 - RNA, 20 nt, Artificial Sequence
  source: /note="Description of Artificial Sequence: Synthetic oligonucleotide"
cugacaccccaccugagucg

SEQ ID NO: 7291 - RNA, 20 nt, Artificial Sequence
  source: /note="Description of Artificial Sequence: Synthetic oligonucleotide"
ucgucuuucucugacacccc

SEQ ID NO: 7292 - RNA, 20 nt, Artificial Sequence
  source: /note="Description of Artificial Sequence: Synthetic oligonucleotide"
gggucgucuuucucugacac

SEQ ID NO: 7293 - RNA, 20 nt, Artificial Sequence
  source: /note="Description of Artificial Sequence: Synthetic oligonucleotide"
ggggucgucuuucucugaca

SEQ ID NO: 7294 - RNA, 20 nt, Artificial Sequence
  source: /note="Description of Artificial Sequence: Synthetic oligonucleotide"
cggggucgucuuucucugac

SEQ ID NO: 7295 - RNA, 20 nt, Artificial Sequence
  source: /note="Description of Artificial Sequence: Synthetic oligonucleotide"
cuaagaaugacaggucccgu

SEQ ID NO: 7296 - RNA, 20 nt, Artificial Sequence
  source: /note="Description of Artificial Sequence: Synthetic oligonucleotide"
augcucuaagaaugacaggu

SEQ ID NO: 7297 - RNA, 20 nt, Artificial Sequence
  source: /note="Description of Artificial Sequence: Synthetic oligonucleotide"
caugcucuaagaaugacagg

SEQ ID NO: 7298 - RNA, 20 nt, Artificial Sequence
  source: /note="Description of Artificial Sequence: Synthetic oligonucleotide"
uugcagaaguuguuuaggcu

SEQ ID NO: 7299 - RNA, 20 nt, Artificial Sequence
  source: /note="Description of Artificial Sequence: Synthetic oligonucleotide"
aaaaauugcagaaguuguuu

SEQ ID NO: 7300 - RNA, 20 nt, Artificial Sequence
  source: /note="Description of Artificial Sequence: Synthetic oligonucleotide"
uccuuacuggaacacugucu

SEQ ID NO: 7301 - RNA, 20 nt, Artificial Sequence
  source: /note="Description of Artificial Sequence: Synthetic oligonucleotide"
ugugagcugguuguccuuac

SEQ ID NO: 7302 - RNA, 20 nt, Artificial Sequence
  source: /note="Description of Artificial Sequence: Synthetic oligonucleotide"
uagaauggauaauugugagc

SEQ ID NO: 7303 - RNA, 20 nt, Artificial Sequence
  source: /note="Description of Artificial Sequence: Synthetic oligonucleotide"
guugacucccauuauuagaa

SEQ ID NO: 7304 - RNA, 20 nt, Artificial Sequence
  source: /note="Description of Artificial Sequence: Synthetic oligonucleotide"
ugguuugaucacacaugacu

SEQ ID NO: 7305 - RNA, 20 nt, Artificial Sequence
  source: /note="Description of Artificial Sequence: Synthetic oligonucleotide"
uuugaauuugggcuuaaagg

SEQ ID NO: 7306 - RNA, 20 nt, Artificial Sequence
  source: /note="Description of Artificial Sequence: Synthetic oligonucleotide"
uggaauuguuuuuugaauuu

SEQ ID NO: 7307 - RNA, 20 nt, Artificial Sequence
  source: /note="Description of Artificial Sequence: Synthetic oligonucleotide"
cuggaauuguuuuuugaauu

SEQ ID NO: 7308 - RNA, 20 nt, Artificial Sequence
  source: /note="Description of Artificial Sequence: Synthetic oligonucleotide"
uaggugaauagacaauaucc

SEQ ID NO: 7309 - RNA, 20 nt, Artificial Sequence
  source: /note="Description of Artificial Sequence: Synthetic oligonucleotide"
uuaaccaaccaguuucuuau

SEQ ID NO: 7310 - RNA, 20 nt, Artificial Sequence
  source: /note="Description of Artificial Sequence: Synthetic oligonucleotide"
agagaucugcauuuaagauc

SEQ ID NO: 7311 - RNA, 20 nt, Artificial Sequence
  source: /note="Description of Artificial Sequence: Synthetic oligonucleotide"
ggaaugccauugaagaugag

SEQ ID NO: 7312 - RNA, 20 nt, Artificial Sequence
  source: /note="Description of Artificial Sequence: Synthetic oligonucleotide"
uuugagggagaaaaauucag

SEQ ID NO: 7313 - RNA, 20 nt, Artificial Sequence
  source: /note="Description of Artificial Sequence: Synthetic oligonucleotide"
auaauauauagauuauuuga

SEQ ID NO: 7314 - RNA, 20 nt, Artificial Sequence
  source: /note="Description of Artificial Sequence: Synthetic oligonucleotide"
aauaauauauagauuauuug

SEQ ID NO: 7315 - RNA, 20 nt, Artificial Sequence
  source: /note="Description of Artificial Sequence: Synthetic oligonucleotide"
uuaaaaucuguuucuuaaaa

SEQ ID NO: 7316 - RNA, 20 nt, Artificial Sequence
  source: /note="Description of Artificial Sequence: Synthetic oligonucleotide"
guuuuucauaauccucagua

SEQ ID NO: 7317 - RNA, 20 nt, Artificial Sequence
  source: /note="Description of Artificial Sequence: Synthetic oligonucleotide"
gguuuuucauaauccucagu

SEQ ID NO: 7318 - RNA, 20 nt, Artificial Sequence
  source: /note="Description of Artificial Sequence: Synthetic oligonucleotide"
ugugcauaggagguuuuguc

SEQ ID NO: 7319 - RNA, 20 nt, Artificial Sequence
  source: /note="Description of Artificial Sequence: Synthetic oligonucleotide"
aucuaaaucaugugcauagg

SEQ ID NO: 7320 - RNA, 20 nt, Artificial Sequence
  source: /note="Description of Artificial Sequence: Synthetic oligonucleotide"
cuaaucuaaaucaugugcau

SEQ ID NO: 7321 - RNA, 20 nt, Artificial Sequence
  source: /note="Description of Artificial Sequence: Synthetic oligonucleotide"
auuucugaaaagguguuaau

SEQ ID NO: 7322 - RNA, 20 nt, Artificial Sequence
  source: /note="Description of Artificial Sequence: Synthetic oligonucleotide"
aaguuccuccauuucugaaa

SEQ ID NO: 7323 - RNA, 20 nt, Artificial Sequence
  source: /note="Description of Artificial Sequence: Synthetic oligonucleotide"
uuuuuauuuuuuuuucuuuu

SEQ ID NO: 7324 - RNA, 20 nt, Artificial Sequence
  source: /note="Description of Artificial Sequence: Synthetic oligonucleotide"
cacccacgucgcguggucgu

SEQ ID NO: 7325 - RNA, 20 nt, Artificial Sequence
  source: /note="Description of Artificial Sequence: Synthetic oligonucleotide"
uacgaucuacugcucaauca

SEQ ID NO: 7326 - RNA, 20 nt, Artificial Sequence
  source: /note="Description of Artificial Sequence: Synthetic oligonucleotide"
uuacgaucuacugcucaauc

SEQ ID NO: 7327 - RNA, 20 nt, Artificial Sequence
  source: /note="Description of Artificial Sequence: Synthetic oligonucleotide"
cugcccccucccuaucguaa

SEQ ID NO: 7328 - RNA, 20 nt, Artificial Sequence
  source: /note="Description of Artificial Sequence: Synthetic oligonucleotide"
ccugcccccucccuaucgua

SEQ ID NO: 7329 - RNA, 20 nt, Artificial Sequence
  source: /note="Description of Artificial Sequence: Synthetic oligonucleotide"
accccaccccccugcccccu

SEQ ID NO: 7330 - RNA, 20 nt, Artificial Sequence
  source: /note="Description of Artificial Sequence: Synthetic oligonucleotide"
caccccaccccccugccccc

SEQ ID NO: 7331 - RNA, 20 nt, Artificial Sequence
  source: /note="Description of Artificial Sequence: Synthetic oligonucleotide"
caacaccccaccccccugcc

SEQ ID NO: 7332 - RNA, 20 nt, Artificial Sequence
  source: /note="Description of Artificial Sequence: Synthetic oligonucleotide"
acaacaccccaccccccugc

SEQ ID NO: 7333 - RNA, 20 nt, Artificial Sequence
  source: /note="Description of Artificial Sequence: Synthetic oligonucleotide"
gacaacaccccaccccccug

SEQ ID NO: 7334 - RNA, 20 nt, Artificial Sequence
  source: /note="Description of Artificial Sequence: Synthetic oligonucleotide"
ugacaacaccccaccccccu

SEQ ID NO: 7335 - RNA, 20 nt, Artificial Sequence
  source: /note="Description of Artificial Sequence: Synthetic oligonucleotide"
ccccugacaacaccccaccc

SEQ ID NO: 7336 - RNA, 20 nt, Artificial Sequence
  source: /note="Description of Artificial Sequence: Synthetic oligonucleotide"
accccugacaacaccccacc

SEQ ID NO: 7337 - RNA, 20 nt, Artificial Sequence
  source: /note="Description of Artificial Sequence: Synthetic oligonucleotide"
gaccccugacaacaccccac

SEQ ID NO: 7338 - RNA, 20 nt, Artificial Sequence
  source: /note="Description of Artificial Sequence: Synthetic oligonucleotide"
agaccccugacaacacccca

SEQ ID NO: 7339 - RNA, 20 nt, Artificial Sequence
  source: /note="Description of Artificial Sequence: Synthetic oligonucleotide"
gagaccccugacaacacccc

SEQ ID NO: 7340 - RNA, 20 nt, Artificial Sequence
  source: /note="Description of Artificial Sequence: Synthetic oligonucleotide"
ugugagaccccugacaacac

SEQ ID NO: 7341 - RNA, 20 nt, Artificial Sequence
  source: /note="Description of Artificial Sequence: Synthetic oligonucleotide"
gugugagaccccugacaaca

SEQ ID NO: 7342 - RNA, 20 nt, Artificial Sequence
  source: /note="Description of Artificial Sequence: Synthetic oligonucleotide"
agugugagaccccugacaac

SEQ ID NO: 7343 - RNA, 20 nt, Artificial Sequence
  source: /note="Description of Artificial Sequence: Synthetic oligonucleotide"
uuccccuuguagugugagac

SEQ ID NO: 7344 - RNA, 20 nt, Artificial Sequence
  source: /note="Description of Artificial Sequence: Synthetic oligonucleotide"
cuuccccuuguagugugaga

SEQ ID NO: 7345 - RNA, 20 nt, Artificial Sequence
  source: /note="Description of Artificial Sequence: Synthetic oligonucleotide"
ccuuccccuuguagugugag

SEQ ID NO: 7346 - RNA, 20 nt, Artificial Sequence
  source: /note="Description of Artificial Sequence: Synthetic oligonucleotide"
cuuguguaccuguguccuuc

SEQ ID NO: 7347 - RNA, 20 nt, Artificial Sequence
  source: /note="Description of Artificial Sequence: Synthetic oligonucleotide"
ucuuguguaccuguguccuu

SEQ ID NO: 7348 - RNA, 20 nt, Artificial Sequence
  source: /note="Description of Artificial Sequence: Synthetic oligonucleotide"
cucuuguguaccuguguccu

SEQ ID NO: 7349 - RNA, 20 nt, Artificial Sequence
  source: /note="Description of Artificial Sequence: Synthetic oligonucleotide"
guuacucuuguguaccugug

SEQ ID NO: 7350 - RNA, 20 nt, Artificial Sequence
  source: /note="Description of Artificial Sequence: Synthetic oligonucleotide"
uuaacuuguuacucuugugu

SEQ ID NO: 7351 - RNA, 20 nt, Artificial Sequence
  source: /note="Description of Artificial Sequence: Synthetic oligonucleotide"
cguauaagagugaguaucca

SEQ ID NO: 7352 - RNA, 20 nt, Artificial Sequence
  source: /note="Description of Artificial Sequence: Synthetic oligonucleotide"
gcguauaagagugaguaucc

SEQ ID NO: 7353 - RNA, 20 nt, Artificial Sequence
  source: /note="Description of Artificial Sequence: Synthetic oligonucleotide"
guggcguauaagagugagua

SEQ ID NO: 7354 - RNA, 20 nt, Artificial Sequence
  source: /note="Description of Artificial Sequence: Synthetic oligonucleotide"
acaucccuguaccuacuuua

SEQ ID NO: 7355 - RNA, 20 nt, Artificial Sequence
  source: /note="Description of Artificial Sequence: Synthetic oligonucleotide"
aguacaggaaacaucccugu

SEQ ID NO: 7356 - RNA, 20 nt, Artificial Sequence
  source: /note="Description of Artificial Sequence: Synthetic oligonucleotide"
uacucaaguacaggaaacau

SEQ ID NO: 7357 - RNA, 20 nt, Artificial Sequence
  source: /note="Description of Artificial Sequence: Synthetic oligonucleotide"
cuacucaaguacaggaaaca

SEQ ID NO: 7358 - RNA, 20 nt, Artificial Sequence
  source: /note="Description of Artificial Sequence: Synthetic oligonucleotide"
uuacaccguguauauguggu

SEQ ID NO: 7359 - RNA, 20 nt, Artificial Sequence
  source: /note="Description of Artificial Sequence: Synthetic oligonucleotide"
aucugaccuaauucuuuuac

SEQ ID NO: 7360 - RNA, 20 nt, Artificial Sequence
  source: /note="Description of Artificial Sequence: Synthetic oligonucleotide"
uuacagguuguuacuaucug

SEQ ID NO: 7361 - RNA, 20 nt, Artificial Sequence
  source: /note="Description of Artificial Sequence: Synthetic oligonucleotide"
auaaguguuaucguuucuga

SEQ ID NO: 7362 - RNA, 20 nt, Artificial Sequence
  source: /note="Description of Artificial Sequence: Synthetic oligonucleotide"
uacgugugcauacaaauaac

SEQ ID NO: 7363 - RNA, 20 nt, Artificial Sequence
  source: /note="Description of Artificial Sequence: Synthetic oligonucleotide"
uaaugacccaaauauggguu

SEQ ID NO: 7364 - RNA, 20 nt, Artificial Sequence
  source: /note="Description of Artificial Sequence: Synthetic oligonucleotide"
cugacucgguaggguaauga

SEQ ID NO: 7365 - RNA, 20 nt, Artificial Sequence
  source: /note="Description of Artificial Sequence: Synthetic oligonucleotide"
acugacucgguaggguaaug

SEQ ID NO: 7366 - RNA, 20 nt, Artificial Sequence
  source: /note="Description of Artificial Sequence: Synthetic oligonucleotide"
cagucacaccgcuaaggagu

SEQ ID NO: 7367 - RNA, 20 nt, Artificial Sequence
  source: /note="Description of Artificial Sequence: Synthetic oligonucleotide"
ucagucacaccgcuaaggag

SEQ ID NO: 7368 - RNA, 20 nt, Artificial Sequence
  source: /note="Description of Artificial Sequence: Synthetic oligonucleotide"
uugguaacaccuucagucac

SEQ ID NO: 7369 - RNA, 20 nt, Artificial Sequence
  source: /note="Description of Artificial Sequence: Synthetic oligonucleotide"
cauuugaucaaguugguaac

SEQ ID NO: 7370 - RNA, 20 nt, Artificial Sequence
  source: /note="Description of Artificial Sequence: Synthetic oligonucleotide"
uugugaaaaugcgacaacca

SEQ ID NO: 7371 - RNA, 20 nt, Artificial Sequence
  source: /note="Description of Artificial Sequence: Synthetic oligonucleotide"
cuugugaaaaugcgacaacc

SEQ ID NO: 7372 - RNA, 20 nt, Artificial Sequence
  source: /note="Description of Artificial Sequence: Synthetic oligonucleotide"
auccuugugaaaaugcgaca

SEQ ID NO: 7373 - RNA, 20 nt, Artificial Sequence
  source: /note="Description of Artificial Sequence: Synthetic oligonucleotide"
accucuccuacaccucuuua

SEQ ID NO: 7374 - RNA, 20 nt, Artificial Sequence
  source: /note="Description of Artificial Sequence: Synthetic oligonucleotide"
uuguucacgaccucuccuac

SEQ ID NO: 7375 - RNA, 20 nt, Artificial Sequence
  source: /note="Description of Artificial Sequence: Synthetic oligonucleotide"
ccuguguuguucacgaccuc

SEQ ID NO: 7376 - RNA, 20 nt, Artificial Sequence
  source: /note="Description of Artificial Sequence: Synthetic oligonucleotide"
ucacuccuguguuguucacg

SEQ ID NO: 7377 - RNA, 20 nt, Artificial Sequence
  source: /note="Description of Artificial Sequence: Synthetic oligonucleotide"
uaccgcuaguaauuuuucac

SEQ ID NO: 7378 - RNA, 20 nt, Artificial Sequence
  source: /note="Description of Artificial Sequence: Synthetic oligonucleotide"
aguagaguguggucaaucuu

SEQ ID NO: 7379 - RNA, 20 nt, Artificial Sequence
  source: /note="Description of Artificial Sequence: Synthetic oligonucleotide"
cuuuuuuacgagugguagug

SEQ ID NO: 7380 - RNA, 20 nt, Artificial Sequence
  source: /note="Description of Artificial Sequence: Synthetic oligonucleotide"
uuuguuaggguaguuuuuca

SEQ ID NO: 7381 - RNA, 20 nt, Artificial Sequence
  source: /note="Description of Artificial Sequence: Synthetic oligonucleotide"
guuuguuaggguaguuuuuc

SEQ ID NO: 7382 - RNA, 20 nt, Artificial Sequence
  source: /note="Description of Artificial Sequence: Synthetic oligonucleotide"
guuggaugaguagacuguuu

SEQ ID NO: 7383 - RNA, 20 nt, Artificial Sequence
  source: /note="Description of Artificial Sequence: Synthetic oligonucleotide"
cguuggaugaguagacuguu

SEQ ID NO: 7384 - RNA, 20 nt, Artificial Sequence
  source: /note="Description of Artificial Sequence: Synthetic oligonucleotide"
acuuguccguuggguguuuu

SEQ ID NO: 7385 - RNA, 20 nt, Artificial Sequence
  source: /note="Description of Artificial Sequence: Synthetic oligonucleotide"
cuugaugguagucucacuug

SEQ ID NO: 7386 - RNA, 20 nt, Artificial Sequence
  source: /note="Description of Artificial Sequence: Synthetic oligonucleotide"
uucucgaagacgugucguuu

SEQ ID NO: 7387 - RNA, 20 nt, Artificial Sequence
  source: /note="Description of Artificial Sequence: Synthetic oligonucleotide"
uuuucgguuuuaacuguuua

SEQ ID NO: 7388 - RNA, 20 nt, Artificial Sequence
  source: /note="Description of Artificial Sequence: Synthetic oligonucleotide"
guuuucgguuuuaacuguuu

SEQ ID NO: 7389 - RNA, 20 nt, Artificial Sequence
  source: /note="Description of Artificial Sequence: Synthetic oligonucleotide"
cagauuuugugguuuucguu

SEQ ID NO: 7390 - RNA, 20 nt, Artificial Sequence
  source: /note="Description of Artificial Sequence: Synthetic oligonucleotide"
agugcuguauccgugcccgu

SEQ ID NO: 7391 - RNA, 20 nt, Artificial Sequence
  source: /note="Description of Artificial Sequence: Synthetic oligonucleotide"
ugguaagugcuguauccgug

SEQ ID NO: 7392 - RNA, 20 nt, Artificial Sequence
  source: /note="Description of Artificial Sequence: Synthetic oligonucleotide"
gugguaagugcuguauccgu

SEQ ID NO: 7393 - RNA, 20 nt, Artificial Sequence
  source: /note="Description of Artificial Sequence: Synthetic oligonucleotide"
ccguugugguaagugcugua

SEQ ID NO: 7394 - RNA, 20 nt, Artificial Sequence
  source: /note="Description of Artificial Sequence: Synthetic oligonucleotide"
uuuugggaucuucuuuugga

SEQ ID NO: 7395 - RNA, 20 nt, Artificial Sequence
  source: /note="Description of Artificial Sequence: Synthetic oligonucleotide"
uauguuuuuaguuaaguucu

SEQ ID NO: 7396 - RNA, 20 nt, Artificial Sequence
  source: /note="Description of Artificial Sequence: Synthetic oligonucleotide"
guauacaccuuucgacuuug

SEQ ID NO: 7397 - RNA, 20 nt, Artificial Sequence
  source: /note="Description of Artificial Sequence: Synthetic oligonucleotide"
cuuuugaccgaucgguauac

SEQ ID NO: 7398 - RNA, 20 nt, Artificial Sequence
  source: /note="Description of Artificial Sequence: Synthetic oligonucleotide"
uauuuaccacgacccuuuug

SEQ ID NO: 7399 - RNA, 20 nt, Artificial Sequence
  source: /note="Description of Artificial Sequence: Synthetic oligonucleotide"
ggauaaauuauuuaccacga

SEQ ID NO: 7400 - RNA, 20 nt, Artificial Sequence
  source: /note="Description of Artificial Sequence: Synthetic oligonucleotide"
gggauaaauuauuuaccacg

SEQ ID NO: 7401 - RNA, 20 nt, Artificial Sequence
  source: /note="Description of Artificial Sequence: Synthetic oligonucleotide"
uccuaagggauaaauuauuu

SEQ ID NO: 7402 - RNA, 20 nt, Artificial Sequence
  source: /note="Description of Artificial Sequence: Synthetic oligonucleotide"
cuuuuuguucuuuaccccuu

SEQ ID NO: 7403 - RNA, 20 nt, Artificial Sequence
  source: /note="Description of Artificial Sequence: Synthetic oligonucleotide"
ggacucuuuuuguucuuuac

SEQ ID NO: 7404 - RNA, 20 nt, Artificial Sequence
  source: /note="Description of Artificial Sequence: Synthetic oligonucleotide"
uggacucuuuuuguucuuua

SEQ ID NO: 7405 - RNA, 20 nt, Artificial Sequence
  source: /note="Description of Artificial Sequence: Synthetic oligonucleotide"
uuggacucuuuuuguucuuu

SEQ ID NO: 7406 - RNA, 20 nt, Artificial Sequence
  source: /note="Description of Artificial Sequence: Synthetic oligonucleotide"
cuugucucgggagucuuuau

SEQ ID NO: 7407 - RNA, 20 nt, Artificial Sequence
  source: /note="Description of Artificial Sequence: Synthetic oligonucleotide"
uuuugucucuauaucuaguu

SEQ ID NO: 7408 - RNA, 20 nt, Artificial Sequence
  source: /note="Description of Artificial Sequence: Synthetic oligonucleotide"
gcugagcaugguccaccacg

SEQ ID NO: 7409 - RNA, 20 nt, Artificial Sequence
  source: /note="Description of Artificial Sequence: Synthetic oligonucleotide"
aggacugcugagcauggucc

SEQ ID NO: 7410 - RNA, 20 nt, Artificial Sequence
  source: /note="Description of Artificial Sequence: Synthetic oligonucleotide"
ugaaaaaggacugcugagca

SEQ ID NO: 7411 - RNA, 20 nt, Artificial Sequence
  source: /note="Description of Artificial Sequence: Synthetic oligonucleotide"
uacuucacaucucuugaaaa

SEQ ID NO: 7412 - RNA, 20 nt, Artificial Sequence
  source: /note="Description of Artificial Sequence: Synthetic oligonucleotide"
aaggugaauuaauauuuuua

SEQ ID NO: 7413 - RNA, 20 nt, Artificial Sequence
  source: /note="Description of Artificial Sequence: Synthetic oligonucleotide"
gauuaaguauggagaauaua

SEQ ID NO: 7414 - RNA, 20 nt, Artificial Sequence
  source: /note="Description of Artificial Sequence: Synthetic oligonucleotide"
uuuccuauauggauuaagua

SEQ ID NO: 7415 - RNA, 20 nt, Artificial Sequence
  source: /note="Description of Artificial Sequence: Synthetic oligonucleotide"
ggaauauaauguuuccuaua

SEQ ID NO: 7416 - RNA, 20 nt, Artificial Sequence
  source: /note="Description of Artificial Sequence: Synthetic oligonucleotide"
agcaagccacauguuagacc

SEQ ID NO: 7417 - RNA, 20 nt, Artificial Sequence
  source: /note="Description of Artificial Sequence: Synthetic oligonucleotide"
uaaagaaaguguuuuuuaua

SEQ ID NO: 7418 - RNA, 20 nt, Artificial Sequence
  source: /note="Description of Artificial Sequence: Synthetic oligonucleotide"
guaaagaaaguguuuuuuau

SEQ ID NO: 7419 - RNA, 20 nt, Artificial Sequence
  source: /note="Description of Artificial Sequence: Synthetic oligonucleotide"
guugccaagucucacucuug

SEQ ID NO: 7420 - RNA, 20 nt, Artificial Sequence
  source: /note="Description of Artificial Sequence: Synthetic oligonucleotide"
auuacuauguaauauuggua

SEQ ID NO: 7421 - RNA, 20 nt, Artificial Sequence
  source: /note="Description of Artificial Sequence: Synthetic oligonucleotide"
uuaaaauuacuauguaauau

SEQ ID NO: 7422 - RNA, 20 nt, Artificial Sequence
  source: /note="Description of Artificial Sequence: Synthetic oligonucleotide"
ucaagaugugugcaaugcua

SEQ ID NO: 7423 - RNA, 20 nt, Artificial Sequence
  source: /note="Description of Artificial Sequence: Synthetic oligonucleotide"
uggauucuuccuaucaacau

SEQ ID NO: 7424 - RNA, 20 nt, Artificial Sequence
  source: /note="Description of Artificial Sequence: Synthetic oligonucleotide"
uuggauucuuccuaucaaca

SEQ ID NO: 7425 - RNA, 20 nt, Artificial Sequence
  source: /note="Description of Artificial Sequence: Synthetic oligonucleotide"
auuauucuccaaaacuauuu

SEQ ID NO: 7426 - RNA, 20 nt, Artificial Sequence
  source: /note="Description of Artificial Sequence: Synthetic oligonucleotide"
ggccacaccuccugcauaga

SEQ ID NO: 7427 - RNA, 20 nt, Artificial Sequence
  source: /note="Description of Artificial Sequence: Synthetic oligonucleotide"
cugaguaaagaugauguaua

SEQ ID NO: 7428 - RNA, 20 nt, Artificial Sequence
  source: /note="Description of Artificial Sequence: Synthetic oligonucleotide"
uauuaguaauucagaguguu

SEQ ID NO: 7429 - RNA, 20 nt, Artificial Sequence
  source: /note="Description of Artificial Sequence: Synthetic oligonucleotide"
ucucugucacuuccacugac

SEQ ID NO: 7430 - RNA, 20 nt, Artificial Sequence
  source: /note="Description of Artificial Sequence: Synthetic oligonucleotide"
uguuucaggaucaaacuuac

SEQ ID NO: 7431 - RNA, 20 nt, Artificial Sequence
  source: /note="Description of Artificial Sequence: Synthetic oligonucleotide"
guguuucaggaucaaacuua

SEQ ID NO: 7432 - RNA, 20 nt, Artificial Sequence
  source: /note="Description of Artificial Sequence: Synthetic oligonucleotide"
ugcuaaaggcacuguguuuc

SEQ ID NO: 7433 - RNA, 20 nt, Artificial Sequence
  source: /note="Description of Artificial Sequence: Synthetic oligonucleotide"
augggaacuauaucugcuaa

SEQ ID NO: 7434 - RNA, 20 nt, Artificial Sequence
  source: /note="Description of Artificial Sequence: Synthetic oligonucleotide"
acuucagacugcuugcuuau

SEQ ID NO: 7435 - RNA, 20 nt, Artificial Sequence
  source: /note="Description of Artificial Sequence: Synthetic oligonucleotide"
uacuucagacugcuugcuua

SEQ ID NO: 7436 - RNA, 20 nt, Artificial Sequence
  source: /note="Description of Artificial Sequence: Synthetic oligonucleotide"
uuauacauucagauuacuga

SEQ ID NO: 7437 - RNA, 20 nt, Artificial Sequence
  source: /note="Description of Artificial Sequence: Synthetic oligonucleotide"
uuuauacauucagauuacug

SEQ ID NO: 7438 - RNA, 20 nt, Artificial Sequence
  source: /note="Description of Artificial Sequence: Synthetic oligonucleotide"
uguauaguugccauacuaua

SEQ ID NO: 7439 - RNA, 20 nt, Artificial Sequence
  source: /note="Description of Artificial Sequence: Synthetic oligonucleotide"
uaugucagcuuuuuuucaag

SEQ ID NO: 7440 - RNA, 20 nt, Artificial Sequence
  source: /note="Description of Artificial Sequence: Synthetic oligonucleotide"
uuaugucagcuuuuuuucaa

SEQ ID NO: 7441 - RNA, 20 nt, Artificial Sequence
  source: /note="Description of Artificial Sequence: Synthetic oligonucleotide"
uuuaugucagcuuuuuuuca

SEQ ID NO: 7442 - RNA, 20 nt, Artificial Sequence
  source: /note="Description of Artificial Sequence: Synthetic oligonucleotide"
aaauaacgaaaacuaggugg

SEQ ID NO: 7443 - RNA, 20 nt, Artificial Sequence
  source: /note="Description of Artificial Sequence: Synthetic oligonucleotide"
caaauaacgaaaacuaggug

SEQ ID NO: 7444 - RNA, 20 nt, Artificial Sequence
  source: /note="Description of Artificial Sequence: Synthetic oligonucleotide"
ccaaauaacgaaaacuaggu

SEQ ID NO: 7445 - RNA, 20 nt, Artificial Sequence
  source: /note="Description of Artificial Sequence: Synthetic oligonucleotide"
accaaauaacgaaaacuagg

SEQ ID NO: 7446 - RNA, 20 nt, Artificial Sequence
  source: /note="Description of Artificial Sequence: Synthetic oligonucleotide"
aaaaccaaauaacgaaaacu

SEQ ID NO: 7447 - RNA, 20 nt, Artificial Sequence
  source: /note="Description of Artificial Sequence: Synthetic oligonucleotide"
aaacaaaaacaaaauaaaaa

SEQ ID NO: 7448 - RNA, 20 nt, Artificial Sequence
  source: /note="Description of Artificial Sequence: Synthetic oligonucleotide"
uaugcucaaauuugugaaga

SEQ ID NO: 7449 - RNA, 20 nt, Artificial Sequence
  source: /note="Description of Artificial Sequence: Synthetic oligonucleotide"
auaugcucaaauuugugaag

SEQ ID NO: 7450 - RNA, 20 nt, Artificial Sequence
  source: /note="Description of Artificial Sequence: Synthetic oligonucleotide"
cucuucggauuacucaagaa

SEQ ID NO: 7451 - RNA, 20 nt, Artificial Sequence
  source: /note="Description of Artificial Sequence: Synthetic oligonucleotide"
cuccauaccauuugacucuu

SEQ ID NO: 7452 - RNA, 20 nt, Artificial Sequence
  source: /note="Description of Artificial Sequence: Synthetic oligonucleotide"
cauuucaccaauaugcauuu

SEQ ID NO: 7453 - RNA, 20 nt, Artificial Sequence
  source: /note="Description of Artificial Sequence: Synthetic oligonucleotide"
auagcacauuagugugcaaa

SEQ ID NO: 7454 - RNA, 20 nt, Artificial Sequence
  source: /note="Description of Artificial Sequence: Synthetic oligonucleotide"
uaauccaucauaauuaugac

SEQ ID NO: 7455 - RNA, 20 nt, Artificial Sequence
  source: /note="Description of Artificial Sequence: Synthetic oligonucleotide"
gugaaacaauuacugcaucu

SEQ ID NO: 7456 - RNA, 20 nt, Artificial Sequence
  source: /note="Description of Artificial Sequence: Synthetic oligonucleotide"
auuauaaauucuagucgcau

SEQ ID NO: 7457 - RNA, 20 nt, Artificial Sequence
  source: /note="Description of Artificial Sequence: Synthetic oligonucleotide"
ugguuuccuaagaccaaaac

SEQ ID NO: 7458 - RNA, 20 nt, Artificial Sequence
  source: /note="Description of Artificial Sequence: Synthetic oligonucleotide"
uugacuacuagcuaacauuu

SEQ ID NO: 7459 - RNA, 20 nt, Artificial Sequence
  source: /note="Description of Artificial Sequence: Synthetic oligonucleotide"
uuuaucucaguugaaaauac

SEQ ID NO: 7460 - RNA, 20 nt, Artificial Sequence
  source: /note="Description of Artificial Sequence: Synthetic oligonucleotide"
accuuuaucuucuaugucag

SEQ ID NO: 7461 - RNA, 20 nt, Artificial Sequence
  source: /note="Description of Artificial Sequence: Synthetic oligonucleotide"
ucucucucucucucucucuc

SEQ ID NO: 7462 - RNA, 20 nt, Artificial Sequence
  source: /note="Description of Artificial Sequence: Synthetic oligonucleotide"
agaaacaugcaacaauuaua

SEQ ID NO: 7463 - RNA, 20 nt, Artificial Sequence
  source: /note="Description of Artificial Sequence: Synthetic oligonucleotide"
cuaaaggucaaauuauaacc

SEQ ID NO: 7464 - RNA, 20 nt, Artificial Sequence
  source: /note="Description of Artificial Sequence: Synthetic oligonucleotide"
auuuuuuucagaaauucuaa

SEQ ID NO: 7465 - RNA, 20 nt, Artificial Sequence
  source: /note="Description of Artificial Sequence: Synthetic oligonucleotide"
uuguaaugcaugggcuucca

SEQ ID NO: 7466 - RNA, 20 nt, Artificial Sequence
  source: /note="Description of Artificial Sequence: Synthetic oligonucleotide"
uaauguucuuuguaaugcau

SEQ ID NO: 7467 - RNA, 20 nt, Artificial Sequence
  source: /note="Description of Artificial Sequence: Synthetic oligonucleotide"
cuaauguucuuuguaaugca

SEQ ID NO: 7468 - RNA, 20 nt, Artificial Sequence
  source: /note="Description of Artificial Sequence: Synthetic oligonucleotide"
aauuaaauuacaauuuuaaa

SEQ ID NO: 7469 - RNA, 20 nt, Artificial Sequence
  source: /note="Description of Artificial Sequence: Synthetic oligonucleotide"
guauuuuuuuaagucuaaaa

SEQ ID NO: 7470 - RNA, 20 nt, Artificial Sequence
  source: /note="Description of Artificial Sequence: Synthetic oligonucleotide"
ugcuaaaguuauaagaacuu

SEQ ID NO: 7471 - RNA, 20 nt, Artificial Sequence
  source: /note="Description of Artificial Sequence: Synthetic oligonucleotide"
ucuucauagguuuaccaaaa

SEQ ID NO: 7472 - RNA, 20 nt, Artificial Sequence
  source: /note="Description of Artificial Sequence: Synthetic oligonucleotide"
gcagcaugagauuucuucau

SEQ ID NO: 7473 - RNA, 20 nt, Artificial Sequence
  source: /note="Description of Artificial Sequence: Synthetic oligonucleotide"
uguguggauuuuuuacuaua

SEQ ID NO: 7474 - RNA, 20 nt, Artificial Sequence
  source: /note="Description of Artificial Sequence: Synthetic oligonucleotide"
ccuuaaccuaggaaaauaca

SEQ ID NO: 7475 - RNA, 20 nt, Artificial Sequence
  source: /note="Description of Artificial Sequence: Synthetic oligonucleotide"
gauuauugaacccuuaaccu

SEQ ID NO: 7476 - RNA, 20 nt, Artificial Sequence
  source: /note="Description of Artificial Sequence: Synthetic oligonucleotide"
uuucaaaaaaacuagugaga

SEQ ID NO: 7477 - RNA, 20 nt, Artificial Sequence
  source: /note="Description of Artificial Sequence: Synthetic oligonucleotide"
ggaggagaaccagugaccua

SEQ ID NO: 7478 - RNA, 20 nt, Artificial Sequence
  source: /note="Description of Artificial Sequence: Synthetic oligonucleotide"
accuacaacauugcugaggg

SEQ ID NO: 7479 - RNA, 20 nt, Artificial Sequence
  source: /note="Description of Artificial Sequence: Synthetic oligonucleotide"
gcuaccuacaacauugcuga

SEQ ID NO: 7480 - RNA, 20 nt, Artificial Sequence
  source: /note="Description of Artificial Sequence: Synthetic oligonucleotide"
agcuaccuacaacauugcug

SEQ ID NO: 7481 - RNA, 20 nt, Artificial Sequence
  source: /note="Description of Artificial Sequence: Synthetic oligonucleotide"
aacacuaagucaaagguaaa

SEQ ID NO: 7482 - RNA, 20 nt, Artificial Sequence
  source: /note="Description of Artificial Sequence: Synthetic oligonucleotide"
agagaaaaacacuaagucaa

SEQ ID NO: 7483 - RNA, 20 nt, Artificial Sequence
  source: /note="Description of Artificial Sequence: Synthetic oligonucleotide"
gcucuugucccugucaaugu

SEQ ID NO: 7484 - RNA, 20 nt, Artificial Sequence
  source: /note="Description of Artificial Sequence: Synthetic oligonucleotide"
agcucuugucccugucaaug

SEQ ID NO: 7485 - RNA, 20 nt, Artificial Sequence
  source: /note="Description of Artificial Sequence: Synthetic oligonucleotide"
gccaugggaauacaggagag

SEQ ID NO: 7486 - RNA, 20 nt, Artificial Sequence
  source: /note="Description of Artificial Sequence: Synthetic oligonucleotide"
ugccaugggaauacaggaga

SEQ ID NO: 7487 - RNA, 20 nt, Artificial Sequence
  source: /note="Description of Artificial Sequence: Synthetic oligonucleotide"
gugccaugggaauacaggag

SEQ ID NO: 7488 - RNA, 20 nt, Artificial Sequence
  source: /note="Description of Artificial Sequence: Synthetic oligonucleotide"
cugaagugccaugggaauac

SEQ ID NO: 7489 - RNA, 20 nt, Artificial Sequence
  source: /note="Description of Artificial Sequence: Synthetic oligonucleotide"
ugagacuacugaagugccau

SEQ ID NO: 7490 - RNA, 20 nt, Artificial Sequence
  source: /note="Description of Artificial Sequence: Synthetic oligonucleotide"
augagacuacugaagugcca

SEQ ID NO: 7491 - RNA, 20 nt, Artificial Sequence
  source: /note="Description of Artificial Sequence: Synthetic oligonucleotide"
ccugaacugugguuauguug

SEQ ID NO: 7492 - RNA, 20 nt, Artificial Sequence
  source: /note="Description of Artificial Sequence: Synthetic oligonucleotide"
uccucuacugcccugaacug

SEQ ID NO: 7493 - RNA, 20 nt, Artificial Sequence
  source: /note="Description of Artificial Sequence: Synthetic oligonucleotide"
ucagugcaguugccauggca

SEQ ID NO: 7494 - RNA, 20 nt, Artificial Sequence
  source: /note="Description of Artificial Sequence: Synthetic oligonucleotide"
cucacucagugcaguugcca

SEQ ID NO: 7495 - RNA, 20 nt, Artificial Sequence
  source: /note="Description of Artificial Sequence: Synthetic oligonucleotide"
gauaaugucacucagagaau

SEQ ID NO: 7496 - RNA, 20 nt, Artificial Sequence
  source: /note="Description of Artificial Sequence: Synthetic oligonucleotide"
auuuuucucuagaauauuug

SEQ ID NO: 7497 - RNA, 20 nt, Artificial Sequence
  source: /note="Description of Artificial Sequence: Synthetic oligonucleotide"
ccagauuaucuuugcaaugc

SEQ ID NO: 7498 - RNA, 20 nt, Artificial Sequence
  source: /note="Description of Artificial Sequence: Synthetic oligonucleotide"
aaacguaaacuuuuaggaca

SEQ ID NO: 7499 - RNA, 20 nt, Artificial Sequence
  source: /note="Description of Artificial Sequence: Synthetic oligonucleotide"
aaaagaaaacguaaacuuuu

SEQ ID NO: 7500 - RNA, 20 nt, Artificial Sequence
  source: /note="Description of Artificial Sequence: Synthetic oligonucleotide"
aucauuucuuuaugugguuu

SEQ ID NO: 7501 - RNA, 20 nt, Artificial Sequence
  source: /note="Description of Artificial Sequence: Synthetic oligonucleotide"
aaucauuucuuuaugugguu

SEQ ID NO: 7502 - RNA, 20 nt, Artificial Sequence
  source: /note="Description of Artificial Sequence: Synthetic oligonucleotide"
caacaaaucauuucuuuaug

SEQ ID NO: 7503 - RNA, 20 nt, Artificial Sequence
  source: /note="Description of Artificial Sequence: Synthetic oligonucleotide"
guaauuauuaagaugauuaa

SEQ ID NO: 7504 - RNA, 20 nt, Artificial Sequence
  source: /note="Description of Artificial Sequence: Synthetic oligonucleotide"
uguaauuauuaagaugauua

SEQ ID NO: 7505 - RNA, 20 nt, Artificial Sequence
  source: /note="Description of Artificial Sequence: Synthetic oligonucleotide"
uauuuuggcuacguaucugu

SEQ ID NO: 7506 - RNA, 20 nt, Artificial Sequence
  source: /note="Description of Artificial Sequence: Synthetic oligonucleotide"
ggauuaaaaaacaaguauuu

SEQ ID NO: 7507 - RNA, 20 nt, Artificial Sequence
  source: /note="Description of Artificial Sequence: Synthetic oligonucleotide"
aagcuuuuuuuuuaagguuu

SEQ ID NO: 7508 - RNA, 20 nt, Artificial Sequence
  source: /note="Description of Artificial Sequence: Synthetic oligonucleotide"
caauuuaagcuuuuuuuuua

SEQ ID NO: 7509 - RNA, 20 nt, Artificial Sequence
  source: /note="Description of Artificial Sequence: Synthetic oligonucleotide"
aaagacaagugcauaauuaa

SEQ ID NO: 7510 - RNA, 20 nt, Artificial Sequence
  source: /note="Description of Artificial Sequence: Synthetic oligonucleotide"
cccugauccggauucgugag

SEQ ID NO: 7511 - RNA, 20 nt, Artificial Sequence
  source: /note="Description of Artificial Sequence: Synthetic oligonucleotide"
gucuccgagggugucccuga

SEQ ID NO: 7512 - RNA, 20 nt, Artificial Sequence
  source: /note="Description of Artificial Sequence: Synthetic oligonucleotide"
gguuuugucuccgagggugu

SEQ ID NO: 7513 - RNA, 20 nt, Artificial Sequence
  source: /note="Description of Artificial Sequence: Synthetic oligonucleotide"
ugguuuugucuccgagggug

SEQ ID NO: 7514 - RNA, 20 nt, Artificial Sequence
  source: /note="Description of Artificial Sequence: Synthetic oligonucleotide"
uaccacuucgugguuuuguc

SEQ ID NO: 7515 - RNA, 20 nt, Artificial Sequence
  source: /note="Description of Artificial Sequence: Synthetic oligonucleotide"
uuuugacuccuuagacgggu

SEQ ID NO: 7516 - RNA, 20 nt, Artificial Sequence
  source: /note="Description of Artificial Sequence: Synthetic oligonucleotide"
aaaauuucuacacuuuugac

SEQ ID NO: 7517 - RNA, 20 nt, Artificial Sequence
  source: /note="Description of Artificial Sequence: Synthetic oligonucleotide"
aacauuucagaguagcagcu

SEQ ID NO: 7518 - RNA, 20 nt, Artificial Sequence
  source: /note="Description of Artificial Sequence: Synthetic oligonucleotide"
uaaguaauaauauguaacaa

SEQ ID NO: 7519 - RNA, 20 nt, Artificial Sequence
  source: /note="Description of Artificial Sequence: Synthetic oligonucleotide"
gucacggcuaagaaauucua

SEQ ID NO: 7520 - RNA, 20 nt, Artificial Sequence
  source: /note="Description of Artificial Sequence: Synthetic oligonucleotide"
uuguugguuugguauaguca

SEQ ID NO: 7521 - RNA, 20 nt, Artificial Sequence
  source: /note="Description of Artificial Sequence: Synthetic oligonucleotide"
auaaaguuguccucuaaauc

SEQ ID NO: 7522 - RNA, 20 nt, Artificial Sequence
  source: /note="Description of Artificial Sequence: Synthetic oligonucleotide"
ugaccccuaauauaaaguug

SEQ ID NO: 7523 - RNA, 20 nt, Artificial Sequence
  source: /note="Description of Artificial Sequence: Synthetic oligonucleotide"
ccggggguggagguugugac

SEQ ID NO: 7524 - RNA, 20 nt, Artificial Sequence
  source: /note="Description of Artificial Sequence: Synthetic oligonucleotide"
uccggggguggagguuguga

SEQ ID NO: 7525 - RNA, 20 nt, Artificial Sequence
  source: /note="Description of Artificial Sequence: Synthetic oligonucleotide"
guccggggguggagguugug

SEQ ID NO: 7526 - RNA, 20 nt, Artificial Sequence
  source: /note="Description of Artificial Sequence: Synthetic oligonucleotide"
auuagguuugugaagggugg

SEQ ID NO: 7527 - RNA, 20 nt, Artificial Sequence
  source: /note="Description of Artificial Sequence: Synthetic oligonucleotide"
uccugucgugguacgguacu

SEQ ID NO: 7528 - RNA, 20 nt, Artificial Sequence
  source: /note="Description of Artificial Sequence: Synthetic oligonucleotide"
cuccugucgugguacgguac

SEQ ID NO: 7529 - RNA, 20 nt, Artificial Sequence
  source: /note="Description of Artificial Sequence: Synthetic oligonucleotide"
gaacucuugagugauagucc

SEQ ID NO: 7530 - RNA, 20 nt, Artificial Sequence
  source: /note="Description of Artificial Sequence: Synthetic oligonucleotide"
agagaacucuugagugauag

SEQ ID NO: 7531 - RNA, 20 nt, Artificial Sequence
  source: /note="Description of Artificial Sequence: Synthetic oligonucleotide"
cucccuuccucugucccucc

SEQ ID NO: 7532 - RNA, 20 nt, Artificial Sequence
  source: /note="Description of Artificial Sequence: Synthetic oligonucleotide"
ccucccuuccucugucccuc

SEQ ID NO: 7533 - RNA, 20 nt, Artificial Sequence
  source: /note="Description of Artificial Sequence: Synthetic oligonucleotide"
cccucccuuccucugucccu

SEQ ID NO: 7534 - RNA, 20 nt, Artificial Sequence
  source: /note="Description of Artificial Sequence: Synthetic oligonucleotide"
ucccucccuuccucuguccc

SEQ ID NO: 7535 - RNA, 20 nt, Artificial Sequence
  source: /note="Description of Artificial Sequence: Synthetic oligonucleotide"
cucucccucccuuccucugu

SEQ ID NO: 7536 - RNA, 20 nt, Artificial Sequence
  source: /note="Description of Artificial Sequence: Synthetic oligonucleotide"
ucucucccucccuuccucug

SEQ ID NO: 7537 - RNA, 20 nt, Artificial Sequence
  source: /note="Description of Artificial Sequence: Synthetic oligonucleotide"
cccuuccucucucccucccu

SEQ ID NO: 7538 - RNA, 20 nt, Artificial Sequence
  source: /note="Description of Artificial Sequence: Synthetic oligonucleotide"
cccucccuuccucucucccu

SEQ ID NO: 7539 - RNA, 20 nt, Artificial Sequence
  source: /note="Description of Artificial Sequence: Synthetic oligonucleotide"
ucccucccuuccucucuccc

SEQ ID NO: 7540 - RNA, 20 nt, Artificial Sequence
  source: /note="Description of Artificial Sequence: Synthetic oligonucleotide"
gucucccucccuuccucucu

SEQ ID NO: 7541 - RNA, 20 nt, Artificial Sequence
  source: /note="Description of Artificial Sequence: Synthetic oligonucleotide"
ugucucccucccuuccucuc

SEQ ID NO: 7542 - RNA, 20 nt, Artificial Sequence
  source: /note="Description of Artificial Sequence: Synthetic oligonucleotide"
cccuuccugucucccucccu

SEQ ID NO: 7543 - RNA, 20 nt, Artificial Sequence
  source: /note="Description of Artificial Sequence: Synthetic oligonucleotide"
cccucccuuccugucucccu

SEQ ID NO: 7544 - RNA, 20 nt, Artificial Sequence
  source: /note="Description of Artificial Sequence: Synthetic oligonucleotide"
ucccucccuuccugucuccc

SEQ ID NO: 7545 - RNA, 20 nt, Artificial Sequence
  source: /note="Description of Artificial Sequence: Synthetic oligonucleotide"
uucucccucccuuccugucu

SEQ ID NO: 7546 - RNA, 20 nt, Artificial Sequence
  source: /note="Description of Artificial Sequence: Synthetic oligonucleotide"
cuucucccucccuuccuguc

SEQ ID NO: 7547 - RNA, 20 nt, Artificial Sequence
  source: /note="Description of Artificial Sequence: Synthetic oligonucleotide"
cucccuccuucucccucccu

SEQ ID NO: 7548 - RNA, 20 nt, Artificial Sequence
  source: /note="Description of Artificial Sequence: Synthetic oligonucleotide"
ccuucucccuccuucucccu

SEQ ID NO: 7549 - RNA, 20 nt, Artificial Sequence
  source: /note="Description of Artificial Sequence: Synthetic oligonucleotide"
uccuucucccuccuucuccc

SEQ ID NO: 7550 - RNA, 20 nt, Artificial Sequence
  source: /note="Description of Artificial Sequence: Synthetic oligonucleotide"
cucuccuucucccuccuucu

SEQ ID NO: 7551 - RNA, 20 nt, Artificial Sequence
  source: /note="Description of Artificial Sequence: Synthetic oligonucleotide"
ucucuccuucucccuccuuc

SEQ ID NO: 7552 - RNA, 20 nt, Artificial Sequence
  source: /note="Description of Artificial Sequence: Synthetic oligonucleotide"
uuuuucucucuccuucuccc

SEQ ID NO: 7553 - RNA, 20 nt, Artificial Sequence
  source: /note="Description of Artificial Sequence: Synthetic oligonucleotide"
cucuuuuucucucuccuucu

SEQ ID NO: 7554 - RNA, 20 nt, Artificial Sequence
  source: /note="Description of Artificial Sequence: Synthetic oligonucleotide"
ccucuuuuucucucuccuuc

SEQ ID NO: 7555 - RNA, 20 nt, Artificial Sequence
  source: /note="Description of Artificial Sequence: Synthetic oligonucleotide"
ccucacccucuuuuucucuc

SEQ ID NO: 7556 - RNA, 20 nt, Artificial Sequence
  source: /note="Description of Artificial Sequence: Synthetic oligonucleotide"
cguagauuguaccgaccuca

SEQ ID NO: 7557 - RNA, 20 nt, Artificial Sequence
  source: /note="Description of Artificial Sequence: Synthetic oligonucleotide"
ccguagauuguaccgaccuc

SEQ ID NO: 7558 - RNA, 20 nt, Artificial Sequence
  source: /note="Description of Artificial Sequence: Synthetic oligonucleotide"
cucguccguagauuguaccg

SEQ ID NO: 7559 - RNA, 20 nt, Artificial Sequence
  source: /note="Description of Artificial Sequence: Synthetic oligonucleotide"
uccccucguccguagauugu

SEQ ID NO: 7560 - RNA, 20 nt, Artificial Sequence
  source: /note="Description of Artificial Sequence: Synthetic oligonucleotide"
cgucuuucguuuuccccucg

SEQ ID NO: 7561 - RNA, 20 nt, Artificial Sequence
  source: /note="Description of Artificial Sequence: Synthetic oligonucleotide"
uaguaccgucuuucguuuuc

SEQ ID NO: 7562 - RNA, 20 nt, Artificial Sequence
  source: /note="Description of Artificial Sequence: Synthetic oligonucleotide"
uuaguaccgucuuucguuuu

SEQ ID NO: 7563 - RNA, 20 nt, Artificial Sequence
  source: /note="Description of Artificial Sequence: Synthetic oligonucleotide"
auuaguaccgucuuucguuu

SEQ ID NO: 7564 - RNA, 20 nt, Artificial Sequence
  source: /note="Description of Artificial Sequence: Synthetic oligonucleotide"
ggaauguuuugaauauuagu

SEQ ID NO: 7565 - RNA, 20 nt, Artificial Sequence
  source: /note="Description of Artificial Sequence: Synthetic oligonucleotide"
ugaccguagacgaaacccac

SEQ ID NO: 7566 - RNA, 20 nt, Artificial Sequence
  source: /note="Description of Artificial Sequence: Synthetic oligonucleotide"
uuucgugaccguagacgaaa

SEQ ID NO: 7567 - RNA, 20 nt, Artificial Sequence
  source: /note="Description of Artificial Sequence: Synthetic oligonucleotide"
guuucgugaccguagacgaa

SEQ ID NO: 7568 - RNA, 20 nt, Artificial Sequence
  source: /note="Description of Artificial Sequence: Synthetic oligonucleotide"
gacauauccuccguuucgug

SEQ ID NO: 7569 - RNA, 20 nt, Artificial Sequence
  source: /note="Description of Artificial Sequence: Synthetic oligonucleotide"
ccaagacguccgacauaucc

SEQ ID NO: 7570 - RNA, 20 nt, Artificial Sequence
  source: /note="Description of Artificial Sequence: Synthetic oligonucleotide"
guaccaagacguccgacaua

SEQ ID NO: 7571 - RNA, 20 nt, Artificial Sequence
  source: /note="Description of Artificial Sequence: Synthetic oligonucleotide"
auuaaccgaguaccaagacg

SEQ ID NO: 7572 - RNA, 20 nt, Artificial Sequence
  source: /note="Description of Artificial Sequence: Synthetic oligonucleotide"
uuuauccaaauuaaccgagu

SEQ ID NO: 7573 - RNA, 20 nt, Artificial Sequence
  source: /note="Description of Artificial Sequence: Synthetic oligonucleotide"
auauucuuuuauccaaauua

SEQ ID NO: 7574 - RNA, 20 nt, Artificial Sequence
  source: /note="Description of Artificial Sequence: Synthetic oligonucleotide"
acccauuaaauauucuuuua

SEQ ID NO: 7575 - RNA, 20 nt, Artificial Sequence
  source: /note="Description of Artificial Sequence: Synthetic oligonucleotide"
gauauuucuuuaucgacaga

SEQ ID NO: 7576 - RNA, 20 nt, Artificial Sequence
  source: /note="Description of Artificial Sequence: Synthetic oligonucleotide"
cgauauuucuuuaucgacag

SEQ ID NO: 7577 - RNA, 20 nt, Artificial Sequence
  source: /note="Description of Artificial Sequence: Synthetic oligonucleotide"
aaccuuuugaaaggauacaa

SEQ ID NO: 7578 - RNA, 20 nt, Artificial Sequence
  source: /note="Description of Artificial Sequence: Synthetic oligonucleotide"
uagcauuuuaaccuuuugaa

SEQ ID NO: 7579 - RNA, 20 nt, Artificial Sequence
  source: /note="Description of Artificial Sequence: Synthetic oligonucleotide"
ggacaaagagaucuugcuuc

SEQ ID NO: 7580 - RNA, 20 nt, Artificial Sequence
  source: /note="Description of Artificial Sequence: Synthetic oligonucleotide"
caucuuuauuuccagaauuc

SEQ ID NO: 7581 - RNA, 20 nt, Artificial Sequence
  source: /note="Description of Artificial Sequence: Synthetic oligonucleotide"
aaauacaugccauauuauuu

SEQ ID NO: 7582 - RNA, 20 nt, Artificial Sequence
  source: /note="Description of Artificial Sequence: Synthetic oligonucleotide"
guguuacacgagaacucuug

SEQ ID NO: 7583 - RNA, 20 nt, Artificial Sequence
  source: /note="Description of Artificial Sequence: Synthetic oligonucleotide"
augcucuuauggguuauagc

SEQ ID NO: 7584 - RNA, 20 nt, Artificial Sequence
  source: /note="Description of Artificial Sequence: Synthetic oligonucleotide"
uccucaggagaugcucuuau

SEQ ID NO: 7585 - RNA, 20 nt, Artificial Sequence
  source: /note="Description of Artificial Sequence: Synthetic oligonucleotide"
uuccucaggagaugcucuua

SEQ ID NO: 7586 - RNA, 20 nt, Artificial Sequence
  source: /note="Description of Artificial Sequence: Synthetic oligonucleotide"
caguuuuuaacauauuccuc

SEQ ID NO: 7587 - RNA, 20 nt, Artificial Sequence
  source: /note="Description of Artificial Sequence: Synthetic oligonucleotide"
agugacuaauuguuuaccca

SEQ ID NO: 7588 - RNA, 20 nt, Artificial Sequence
  source: /note="Description of Artificial Sequence: Synthetic oligonucleotide"
gagugacuaauuguuuaccc

SEQ ID NO: 7589 - RNA, 20 nt, Artificial Sequence
  source: /note="Description of Artificial Sequence: Synthetic oligonucleotide"
gaagaaccuuugggaaaacc

SEQ ID NO: 7590 - RNA, 20 nt, Artificial Sequence
  source: /note="Description of Artificial Sequence: Synthetic oligonucleotide"
acagagacagaagaaccuuu

SEQ ID NO: 7591 - RNA, 20 nt, Artificial Sequence
  source: /note="Description of Artificial Sequence: Synthetic oligonucleotide"
aacagagacagaagaaccuu

SEQ ID NO: 7592 - RNA, 20 nt, Artificial Sequence
  source: /note="Description of Artificial Sequence: Synthetic oligonucleotide"
cuuuuuugggguuguuaaac

SEQ ID NO: 7593 - RNA, 20 nt, Artificial Sequence
  source: /note="Description of Artificial Sequence: Synthetic oligonucleotide"
caaaauuaaggccuuuuuug

SEQ ID NO: 7594 - RNA, 20 nt, Artificial Sequence
  source: /note="Description of Artificial Sequence: Synthetic oligonucleotide"
ucaaaauuaaggccuuuuuu

SEQ ID NO: 7595 - RNA, 20 nt, Artificial Sequence
  source: /note="Description of Artificial Sequence: Synthetic oligonucleotide"
aucaaaauuaaggccuuuuu

SEQ ID NO: 7596 - RNA, 20 nt, Artificial Sequence
  source: /note="Description of Artificial Sequence: Synthetic oligonucleotide"
augcuggccaaucaaaauua

SEQ ID NO: 7597 - RNA, 20 nt, Artificial Sequence
  source: /note="Description of Artificial Sequence: Synthetic oligonucleotide"
ugucuuuccuaagaggaugc

SEQ ID NO: 7598 - RNA, 20 nt, Artificial Sequence
  source: /note="Description of Artificial Sequence: Synthetic oligonucleotide"
auggcaaugucuuuccuaag

SEQ ID NO: 7599 - RNA, 20 nt, Artificial Sequence
  source: /note="Description of Artificial Sequence: Synthetic oligonucleotide"
gaagcaacuuuacaagagga

SEQ ID NO: 7600 - RNA, 20 nt, Artificial Sequence
  source: /note="Description of Artificial Sequence: Synthetic oligonucleotide"
augagaagcaacuuuacaag

SEQ ID NO: 7601 - RNA, 20 nt, Artificial Sequence
  source: /note="Description of Artificial Sequence: Synthetic oligonucleotide"
uauaaaaaucauucccuaga

SEQ ID NO: 7602 - RNA, 20 nt, Artificial Sequence
  source: /note="Description of Artificial Sequence: Synthetic oligonucleotide"
uucaaacaccuugcuauuga

SEQ ID NO: 7603 - RNA, 20 nt, Artificial Sequence
  source: /note="Description of Artificial Sequence: Synthetic oligonucleotide"
cagagaacacaaaauuaaua

SEQ ID NO: 7604 - RNA, 20 nt, Artificial Sequence
  source: /note="Description of Artificial Sequence: Synthetic oligonucleotide"
auaaauauaaauuuuugcua

SEQ ID NO: 7605 - RNA, 20 nt, Artificial Sequence
  source: /note="Description of Artificial Sequence: Synthetic oligonucleotide"
uucaugcuguaguuuuuaug

SEQ ID NO: 7606 - RNA, 20 nt, Artificial Sequence
  source: /note="Description of Artificial Sequence: Synthetic oligonucleotide"
uuucaugcuguaguuuuuau

SEQ ID NO: 7607 - RNA, 20 nt, Artificial Sequence
  source: /note="Description of Artificial Sequence: Synthetic oligonucleotide"
cuuucaugcuguaguuuuua

SEQ ID NO: 7608 - RNA, 20 nt, Artificial Sequence
  source: /note="Description of Artificial Sequence: Synthetic oligonucleotide"
auuuugcuuaauaaaagaga

SEQ ID NO: 7609 - RNA, 20 nt, Artificial Sequence
  source: /note="Description of Artificial Sequence: Synthetic oligonucleotide"
cacuuuuuauauacauaccc

SEQ ID NO: 7610 - RNA, 20 nt, Artificial Sequence
  source: /note="Description of Artificial Sequence: Synthetic oligonucleotide"
uaauaaacugccauuuuaga

SEQ ID NO: 7611 - RNA, 20 nt, Artificial Sequence
  source: /note="Description of Artificial Sequence: Synthetic oligonucleotide"
uggucuuuaaaucuuauuuc

SEQ ID NO: 7612 - RNA, 20 nt, Artificial Sequence
  source: /note="Description of Artificial Sequence: Synthetic oligonucleotide"
gaaugaggaaaauuuguuau

SEQ ID NO: 7613 - RNA, 20 nt, Artificial Sequence
  source: /note="Description of Artificial Sequence: Synthetic oligonucleotide"
gaaaguuauauguuagaaug

SEQ ID NO: 7614 - RNA, 20 nt, Artificial Sequence
  source: /note="Description of Artificial Sequence: Synthetic oligonucleotide"
aacuuuuucacaagaagggc

SEQ ID NO: 7615 - RNA, 20 nt, Artificial Sequence
  source: /note="Description of Artificial Sequence: Synthetic oligonucleotide"
gguuaacuuuuucacaagaa

SEQ ID NO: 7616 - RNA, 20 nt, Artificial Sequence
  source: /note="Description of Artificial Sequence: Synthetic oligonucleotide"
ugguuaacuuuuucacaaga

SEQ ID NO: 7617 - RNA, 20 nt, Artificial Sequence
  source: /note="Description of Artificial Sequence: Synthetic oligonucleotide"
cauuugugugaaaaguuuaa

SEQ ID NO: 7618 - RNA, 20 nt, Artificial Sequence
  source: /note="Description of Artificial Sequence: Synthetic oligonucleotide"
auauggaguuuuaaacacaa

SEQ ID NO: 7619 - RNA, 20 nt, Artificial Sequence
  source: /note="Description of Artificial Sequence: Synthetic oligonucleotide"
aaaagaaauguauuucaaua

SEQ ID NO: 7620 - RNA, 20 nt, Artificial Sequence
  source: /note="Description of Artificial Sequence: Synthetic oligonucleotide"
uaauagcuacuaagaaauga

SEQ ID NO: 7621 - RNA, 20 nt, Artificial Sequence
  source: /note="Description of Artificial Sequence: Synthetic oligonucleotide"
gacauucuuuaaagugucaa

SEQ ID NO: 7622 - RNA, 20 nt, Artificial Sequence
  source: /note="Description of Artificial Sequence: Synthetic oligonucleotide"
ggacauucuuuaaaguguca

SEQ ID NO: 7623 - RNA, 20 nt, Artificial Sequence
  source: /note="Description of Artificial Sequence: Synthetic oligonucleotide"
uaauccauuccacauaauuu

SEQ ID NO: 7624 - RNA, 20 nt, Artificial Sequence
  source: /note="Description of Artificial Sequence: Synthetic oligonucleotide"
acauguuuuucuacuuucua

SEQ ID NO: 7625 - RNA, 20 nt, Artificial Sequence
  source: /note="Description of Artificial Sequence: Synthetic oligonucleotide"
auaaauuauauaaaauuugu

SEQ ID NO: 7626 - RNA, 20 nt, Artificial Sequence
  source: /note="Description of Artificial Sequence: Synthetic oligonucleotide"
ucauauacagagcaaucaaa

SEQ ID NO: 7627 - RNA, 20 nt, Artificial Sequence
  source: /note="Description of Artificial Sequence: Synthetic oligonucleotide"
aaaaaaaggcacuuuucuuu

SEQ ID NO: 7628 - RNA, 20 nt, Artificial Sequence
  source: /note="Description of Artificial Sequence: Synthetic oligonucleotide"
guccagauacuaccaaaaaa

SEQ ID NO: 7629 - RNA, 20 nt, Artificial Sequence
  source: /note="Description of Artificial Sequence: Synthetic oligonucleotide"
cuaucacuuuucaaaaauua

SEQ ID NO: 7630 - RNA, 20 nt, Artificial Sequence
  source: /note="Description of Artificial Sequence: Synthetic oligonucleotide"
ugagaggcuucuccaaaauc

SEQ ID NO: 7631 - RNA, 20 nt, Artificial Sequence
  source: /note="Description of Artificial Sequence: Synthetic oligonucleotide"
uuuguagucuuugauaugag

SEQ ID NO: 7632 - RNA, 20 nt, Artificial Sequence
  source: /note="Description of Artificial Sequence: Synthetic oligonucleotide"
acaccuaauaaagaaacuuu

SEQ ID NO: 7633 - RNA, 20 nt, Artificial Sequence
  source: /note="Description of Artificial Sequence: Synthetic oligonucleotide"
agaaaauuugggugagacaa

SEQ ID NO: 7634 - RNA, 20 nt, Artificial Sequence
  source: /note="Description of Artificial Sequence: Synthetic oligonucleotide"
uaacuuguaguagaaaauuu

SEQ ID NO: 7635 - RNA, 20 nt, Artificial Sequence
  source: /note="Description of Artificial Sequence: Synthetic oligonucleotide"
auaacuuguaguagaaaauu

SEQ ID NO: 7636 - RNA, 20 nt, Artificial Sequence
  source: /note="Description of Artificial Sequence: Synthetic oligonucleotide"
ucuuuuacauuuuaagguac

SEQ ID NO: 7637 - RNA, 20 nt, Artificial Sequence
  source: /note="Description of Artificial Sequence: Synthetic oligonucleotide"
acuugauaaaauuuacauaa

SEQ ID NO: 7638 - RNA, 20 nt, Artificial Sequence
  source: /note="Description of Artificial Sequence: Synthetic oligonucleotide"
aacuugauaaaauuuacaua

SEQ ID NO: 7639 - RNA, 20 nt, Artificial Sequence
  source: /note="Description of Artificial Sequence: Synthetic oligonucleotide"
uagauacuuuuguaaaucaa

SEQ ID NO: 7640 - RNA, 20 nt, Artificial Sequence
  source: /note="Description of Artificial Sequence: Synthetic oligonucleotide"
cagaucagguuuaacucuac

SEQ ID NO: 7641 - RNA, 20 nt, Artificial Sequence
  source: /note="Description of Artificial Sequence: Synthetic oligonucleotide"
uccuuccauacauuaacucu

SEQ ID NO: 7642 - RNA, 20 nt, Artificial Sequence
  source: /note="Description of Artificial Sequence: Synthetic oligonucleotide"
uuauuuguuauaacucauau

SEQ ID NO: 7643 - RNA, 20 nt, Artificial Sequence
  source: /note="Description of Artificial Sequence: Synthetic oligonucleotide"
gcgcggugacgugaggucgg

SEQ ID NO: 7644 - RNA, 20 nt, Artificial Sequence
  source: /note="Description of Artificial Sequence: Synthetic oligonucleotide"
guaaacuuggguccuccgcc

SEQ ID NO: 7645 - RNA, 20 nt, Artificial Sequence
  source: /note="Description of Artificial Sequence: Synthetic oligonucleotide"
uuaguaaacuuggguccucc

SEQ ID NO: 7646 - RNA, 20 nt, Artificial Sequence
  source: /note="Description of Artificial Sequence: Synthetic oligonucleotide"
cucuuaguaaacuugggucc

SEQ ID NO: 7647 - RNA, 20 nt, Artificial Sequence
  source: /note="Description of Artificial Sequence: Synthetic oligonucleotide"
guccucuuaguaaacuuggg

SEQ ID NO: 7648 - RNA, 20 nt, Artificial Sequence
  source: /note="Description of Artificial Sequence: Synthetic oligonucleotide"
caaugaacccuccgacuccg

SEQ ID NO: 7649 - RNA, 20 nt, Artificial Sequence
  source: /note="Description of Artificial Sequence: Synthetic oligonucleotide"
gggucaaugaacccuccgac

SEQ ID NO: 7650 - RNA, 20 nt, Artificial Sequence
  source: /note="Description of Artificial Sequence: Synthetic oligonucleotide"
acaucagggucaaugaaccc

SEQ ID NO: 7651 - RNA, 20 nt, Artificial Sequence
  source: /note="Description of Artificial Sequence: Synthetic oligonucleotide"
cggacaucagggucaaugaa

SEQ ID NO: 7652 - RNA, 20 nt, Artificial Sequence
  source: /note="Description of Artificial Sequence: Synthetic oligonucleotide"
acggacaucagggucaauga

SEQ ID NO: 7653 - RNA, 20 nt, Artificial Sequence
  source: /note="Description of Artificial Sequence: Synthetic oligonucleotide"
guuuuucaucgacccguacc

SEQ ID NO: 7654 - RNA, 20 nt, Artificial Sequence
  source: /note="Description of Artificial Sequence: Synthetic oligonucleotide"
uauguuuuucaucgacccgu

SEQ ID NO: 7655 - RNA, 20 nt, Artificial Sequence
  source: /note="Description of Artificial Sequence: Synthetic oligonucleotide"
auuuuuauguuuuucaucga

SEQ ID NO: 7656 - RNA, 20 nt, Artificial Sequence
  source: /note="Description of Artificial Sequence: Synthetic oligonucleotide"
gauuuuuauguuuuucaucg

SEQ ID NO: 7657 - RNA, 20 nt, Artificial Sequence
  source: /note="Description of Artificial Sequence: Synthetic oligonucleotide"
gcucugguagaaccgguugc

SEQ ID NO: 7658 - RNA, 20 nt, Artificial Sequence
  source: /note="Description of Artificial Sequence: Synthetic oligonucleotide"
aguucucuagcucugguaga

SEQ ID NO: 7659 - RNA, 20 nt, Artificial Sequence
  source: /note="Description of Artificial Sequence: Synthetic oligonucleotide"
cgacuccguccgucuagugc

SEQ ID NO: 7660 - RNA, 20 nt, Artificial Sequence
  source: /note="Description of Artificial Sequence: Synthetic oligonucleotide"
cgugaaacccuccgacuccg

SEQ ID NO: 7661 - RNA, 20 nt, Artificial Sequence
  source: /note="Description of Artificial Sequence: Synthetic oligonucleotide"
gggucgugaaacccuccgac

SEQ ID NO: 7662 - RNA, 20 nt, Artificial Sequence
  source: /note="Description of Artificial Sequence: Synthetic oligonucleotide"
acaucagggucgugaaaccc

SEQ ID NO: 7663 - RNA, 20 nt, Artificial Sequence
  source: /note="Description of Artificial Sequence: Synthetic oligonucleotide"
cggacaucagggucgugaaa

SEQ ID NO: 7664 - RNA, 20 nt, Artificial Sequence
  source: /note="Description of Artificial Sequence: Synthetic oligonucleotide"
gcggacaucagggucgugaa

SEQ ID NO: 7665 - RNA, 20 nt, Artificial Sequence
  source: /note="Description of Artificial Sequence: Synthetic oligonucleotide"
uuuauuuaccgguccgugcc

SEQ ID NO: 7666 - RNA, 20 nt, Artificial Sequence
  source: /note="Description of Artificial Sequence: Synthetic oligonucleotide"
uauuuuauuuaccgguccgu

SEQ ID NO: 7667 - RNA, 20 nt, Artificial Sequence
  source: /note="Description of Artificial Sequence: Synthetic oligonucleotide"
uuauuuauuuuauuuaccgg

SEQ ID NO: 7668 - RNA, 20 nt, Artificial Sequence
  source: /note="Description of Artificial Sequence: Synthetic oligonucleotide"
augaauuauuuauuuuauuu

SEQ ID NO: 7669 - RNA, 20 nt, Artificial Sequence
  source: /note="Description of Artificial Sequence: Synthetic oligonucleotide"
accucuuuucgugacccucc

SEQ ID NO: 7670 - RNA, 20 nt, Artificial Sequence
  source: /note="Description of Artificial Sequence: Synthetic oligonucleotide"
gaccucuuuucgugacccuc

SEQ ID NO: 7671 - RNA, 20 nt, Artificial Sequence
  source: /note="Description of Artificial Sequence: Synthetic oligonucleotide"
cgaccucuuuucgugacccu

SEQ ID NO: 7672 - RNA, 20 nt, Artificial Sequence
  source: /note="Description of Artificial Sequence: Synthetic oligonucleotide"
ucgaccucuuuucgugaccc

SEQ ID NO: 7673 - RNA, 20 nt, Artificial Sequence
  source: /note="Description of Artificial Sequence: Synthetic oligonucleotide"
ccgucgaccucuuuucguga

SEQ ID NO: 7674 - RNA, 20 nt, Artificial Sequence
  source: /note="Description of Artificial Sequence: Synthetic oligonucleotide"
cccgucgaccucuuuucgug

SEQ ID NO: 7675 - RNA, 20 nt, Artificial Sequence
  source: /note="Description of Artificial Sequence: Synthetic oligonucleotide"
uccuuuuccuuaccccgucg

SEQ ID NO: 7676 - RNA, 20 nt, Artificial Sequence
  source: /note="Description of Artificial Sequence: Synthetic oligonucleotide"
acggagguccuuuuccuuac

SEQ ID NO: 7677 - RNA, 20 nt, Artificial Sequence
  source: /note="Description of Artificial Sequence: Synthetic oligonucleotide"
aacggagguccuuuuccuua

SEQ ID NO: 7678 - RNA, 20 nt, Artificial Sequence
  source: /note="Description of Artificial Sequence: Synthetic oligonucleotide"
aaacggagguccuuuuccuu

SEQ ID NO: 7679 - RNA, 20 nt, Artificial Sequence
  source: /note="Description of Artificial Sequence: Synthetic oligonucleotide"
uuauuaaacggagguccuuu

SEQ ID NO: 7680 - RNA, 20 nt, Artificial Sequence
  source: /note="Description of Artificial Sequence: Synthetic oligonucleotide"
ccgguauuauuaaacggagg

SEQ ID NO: 7681 - RNA, 20 nt, Artificial Sequence
  source: /note="Description of Artificial Sequence: Synthetic oligonucleotide"
gaccucuuauauauuacuug

SEQ ID NO: 7682 - RNA, 20 nt, Artificial Sequence
  source: /note="Description of Artificial Sequence: Synthetic oligonucleotide"
aaauaaaaaaaaaucuagag

SEQ ID NO: 7683 - RNA, 20 nt, Artificial Sequence
  source: /note="Description of Artificial Sequence: Synthetic oligonucleotide"
ggucauuaauuuaccuuauu

SEQ ID NO: 7684 - RNA, 20 nt, Artificial Sequence
  source: /note="Description of Artificial Sequence: Synthetic oligonucleotide"
ucauagagggucauuaauuu

SEQ ID NO: 7685 - RNA, 20 nt, Artificial Sequence
  source: /note="Description of Artificial Sequence: Synthetic oligonucleotide"
ucauagagauauaaaagucu

SEQ ID NO: 7686 - RNA, 20 nt, Artificial Sequence
  source: /note="Description of Artificial Sequence: Synthetic oligonucleotide"
cccaauacaauuuauuaaau

SEQ ID NO: 7687 - RNA, 20 nt, Artificial Sequence
  source: /note="Description of Artificial Sequence: Synthetic oligonucleotide"
cuuuguuggauguaguuauu

SEQ ID NO: 7688 - RNA, 20 nt, Artificial Sequence
  source: /note="Description of Artificial Sequence: Synthetic oligonucleotide"
ucuuuguuggauguaguuau

SEQ ID NO: 7689 - RNA, 20 nt, Artificial Sequence
  source: /note="Description of Artificial Sequence: Synthetic oligonucleotide"
guuagaaaacgucauuauuu

SEQ ID NO: 7690 - RNA, 20 nt, Artificial Sequence
  source: /note="Description of Artificial Sequence: Synthetic oligonucleotide"
uauauauguaauuuacuaca

SEQ ID NO: 7691 - RNA, 20 nt, Artificial Sequence
  source: /note="Description of Artificial Sequence: Synthetic oligonucleotide"
cacuacgacgugaggucgga

SEQ ID NO: 7692 - RNA, 20 nt, Artificial Sequence
  source: /note="Description of Artificial Sequence: Synthetic oligonucleotide"
acacuacgacgugaggucgg

SEQ ID NO: 7693 - RNA, 20 nt, Artificial Sequence
  source: /note="Description of Artificial Sequence: Synthetic oligonucleotide"
uccuccaccugugacgucac

SEQ ID NO: 7694 - RNA, 20 nt, Artificial Sequence
  source: /note="Description of Artificial Sequence: Synthetic oligonucleotide"
uuaguggacuuggguccucc

SEQ ID NO: 7695 - RNA, 20 nt, Artificial Sequence
  source: /note="Description of Artificial Sequence: Synthetic oligonucleotide"
uucuuaguggacuugggucc

SEQ ID NO: 7696 - RNA, 20 nt, Artificial Sequence
  source: /note="Description of Artificial Sequence: Synthetic oligonucleotide"
uucuucuuaguggacuuggg

SEQ ID NO: 7697 - RNA, 20 nt, Artificial Sequence
  source: /note="Description of Artificial Sequence: Synthetic oligonucleotide"
gggucaaugaacccuccgac

SEQ ID NO: 7698 - RNA, 20 nt, Artificial Sequence
  source: /note="Description of Artificial Sequence: Synthetic oligonucleotide"
acauuagggucaaugaaccc

SEQ ID NO: 7699 - RNA, 20 nt, Artificial Sequence
  source: /note="Description of Artificial Sequence: Synthetic oligonucleotide"
uggacauuagggucaaugaa

SEQ ID NO: 7700 - RNA, 20 nt, Artificial Sequence
  source: /note="Description of Artificial Sequence: Synthetic oligonucleotide"
guggacauuagggucaauga

SEQ ID NO: 7701 - RNA, 20 nt, Artificial Sequence
  source: /note="Description of Artificial Sequence: Synthetic oligonucleotide"
uuaaucgucccguaccacca

SEQ ID NO: 7702 - RNA, 20 nt, Artificial Sequence
  source: /note="Description of Artificial Sequence: Synthetic oligonucleotide"
guuuuuaaucgucccguacc

SEQ ID NO: 7703 - RNA, 20 nt, Artificial Sequence
  source: /note="Description of Artificial Sequence: Synthetic oligonucleotide"
uauguuuuuaaucgucccgu

SEQ ID NO: 7704 - RNA, 20 nt, Artificial Sequence
  source: /note="Description of Artificial Sequence: Synthetic oligonucleotide"
uuuucuauguuuuuaaucgu

SEQ ID NO: 7705 - RNA, 20 nt, Artificial Sequence
  source: /note="Description of Artificial Sequence: Synthetic oligonucleotide"
uuuuucuauguuuuuaaucg

SEQ ID NO: 7706 - RNA, 20 nt, Artificial Sequence
  source: /note="Description of Artificial Sequence: Synthetic oligonucleotide"
gaucugguuggaccgguugu

SEQ ID NO: 7707 - RNA, 20 nt, Artificial Sequence
  source: /note="Description of Artificial Sequence: Synthetic oligonucleotide"
gguccucaagaucugguugg

SEQ ID NO: 7708 - RNA, 20 nt, Artificial Sequence
  source: /note="Description of Artificial Sequence: Synthetic oligonucleotide"
ggucaccuaguggacuccgg

SEQ ID NO: 7709 - RNA, 20 nt, Artificial Sequence
  source: /note="Description of Artificial Sequence: Synthetic oligonucleotide"
auuccggucaccuaguggac

SEQ ID NO: 7710 - RNA, 20 nt, Artificial Sequence
  source: /note="Description of Artificial Sequence: Synthetic oligonucleotide"
gaaacccuucgauuccgguc

SEQ ID NO: 7711 - RNA, 20 nt, Artificial Sequence
  source: /note="Description of Artificial Sequence: Synthetic oligonucleotide"
gggucgugaaacccuucgau

SEQ ID NO: 7712 - RNA, 20 nt, Artificial Sequence
  source: /note="Description of Artificial Sequence: Synthetic oligonucleotide"
cggauauuagggucgugaaa

SEQ ID NO: 7713 - RNA, 20 nt, Artificial Sequence
  source: /note="Description of Artificial Sequence: Synthetic oligonucleotide"
gcggauauuagggucgugaa

SEQ ID NO: 7714 - RNA, 20 nt, Artificial Sequence
  source: /note="Description of Artificial Sequence: Synthetic oligonucleotide"
aaauagacuguccgacccac

SEQ ID NO: 7715 - RNA, 20 nt, Artificial Sequence
  source: /note="Description of Artificial Sequence: Synthetic oligonucleotide"
uucuuaaauagacuguccga

SEQ ID NO: 7716 - RNA, 20 nt, Artificial Sequence
  source: /note="Description of Artificial Sequence: Synthetic oligonucleotide"
auucuuaaauagacuguccg

SEQ ID NO: 7717 - RNA, 20 nt, Artificial Sequence
  source: /note="Description of Artificial Sequence: Synthetic oligonucleotide"
gaaaauucuuaaauagacug

SEQ ID NO: 7718 - RNA, 20 nt, Artificial Sequence
  source: /note="Description of Artificial Sequence: Synthetic oligonucleotide"
auaguacauccuacuguuaa

SEQ ID NO: 7719 - RNA, 20 nt, Artificial Sequence
  source: /note="Description of Artificial Sequence: Synthetic oligonucleotide"
uugacgguguuuauaguaca

SEQ ID NO: 7720 - RNA, 20 nt, Artificial Sequence
  source: /note="Description of Artificial Sequence: Synthetic oligonucleotide"
uuuugucuaugagagaguac

SEQ ID NO: 7721 - RNA, 20 nt, Artificial Sequence
  source: /note="Description of Artificial Sequence: Synthetic oligonucleotide"
ugauacaaaccguucguaca

SEQ ID NO: 7722 - RNA, 20 nt, Artificial Sequence
  source: /note="Description of Artificial Sequence: Synthetic oligonucleotide"
augauacaaaccguucguac

SEQ ID NO: 7723 - RNA, 20 nt, Artificial Sequence
  source: /note="Description of Artificial Sequence: Synthetic oligonucleotide"
cgaacuaugauaugauacaa

SEQ ID NO: 7724 - RNA, 20 nt, Artificial Sequence
  source: /note="Description of Artificial Sequence: Synthetic oligonucleotide"
acguuuaauuuugacguugu

SEQ ID NO: 7725 - RNA, 20 nt, Artificial Sequence
  source: /note="Description of Artificial Sequence: Synthetic oligonucleotide"
guaucuuuuacuuuacacuu

SEQ ID NO: 7726 - RNA, 20 nt, Artificial Sequence
  source: /note="Description of Artificial Sequence: Synthetic oligonucleotide"
auuuuuuaccuguucccugu

SEQ ID NO: 7727 - RNA, 20 nt, Artificial Sequence
  source: /note="Description of Artificial Sequence: Synthetic oligonucleotide"
uguaugauuuuuuaccuguu

SEQ ID NO: 7728 - RNA, 20 nt, Artificial Sequence
  source: /note="Description of Artificial Sequence: Synthetic oligonucleotide"
guguaugauuuuuuaccugu

SEQ ID NO: 7729 - RNA, 20 nt, Artificial Sequence
  source: /note="Description of Artificial Sequence: Synthetic oligonucleotide"
uuauugguguaugauuuuuu

SEQ ID NO: 7730 - RNA, 20 nt, Artificial Sequence
  source: /note="Description of Artificial Sequence: Synthetic oligonucleotide"
uaaaacaaaagaauuguaua

SEQ ID NO: 7731 - RNA, 20 nt, Artificial Sequence
  source: /note="Description of Artificial Sequence: Synthetic oligonucleotide"
aucuagaagucauaaaagau

SEQ ID NO: 7732 - RNA, 20 nt, Artificial Sequence
  source: /note="Description of Artificial Sequence: Synthetic oligonucleotide"
aaucuagaagucauaaaaga

SEQ ID NO: 7733 - RNA, 20 nt, Artificial Sequence
  source: /note="Description of Artificial Sequence: Synthetic oligonucleotide"
acuuaaaaaaaucuaaugac

SEQ ID NO: 7734 - RNA, 20 nt, Artificial Sequence
  source: /note="Description of Artificial Sequence: Synthetic oligonucleotide"
acuuaaauuauaaacuuaug

SEQ ID NO: 7735 - RNA, 20 nt, Artificial Sequence
  source: /note="Description of Artificial Sequence: Synthetic oligonucleotide"
aggacuuuuuuacuauuuca

SEQ ID NO: 7736 - RNA, 20 nt, Artificial Sequence
  source: /note="Description of Artificial Sequence: Synthetic oligonucleotide"
gaggacuuuuuuacuauuuc

SEQ ID NO: 7737 - RNA, 20 nt, Artificial Sequence
  source: /note="Description of Artificial Sequence: Synthetic oligonucleotide"
augaacuauaaucuuguuga

SEQ ID NO: 7738 - RNA, 20 nt, Artificial Sequence
  source: /note="Description of Artificial Sequence: Synthetic oligonucleotide"
uaugaacuauaaucuuguug

SEQ ID NO: 7739 - RNA, 20 nt, Artificial Sequence
  source: /note="Description of Artificial Sequence: Synthetic oligonucleotide"
uauacgauguucuauuccua

SEQ ID NO: 7740 - RNA, 20 nt, Artificial Sequence
  source: /note="Description of Artificial Sequence: Synthetic oligonucleotide"
uuauacgauguucuauuccu

SEQ ID NO: 7741 - RNA, 20 nt, Artificial Sequence
  source: /note="Description of Artificial Sequence: Synthetic oligonucleotide"
gucuuuauacgauguucuau

SEQ ID NO: 7742 - RNA, 20 nt, Artificial Sequence
  source: /note="Description of Artificial Sequence: Synthetic oligonucleotide"
auauuauaauuauacuaguu

SEQ ID NO: 7743 - RNA, 20 nt, Artificial Sequence
  source: /note="Description of Artificial Sequence: Synthetic oligonucleotide"
aagacuuuuucuuaacauac

SEQ ID NO: 7744 - RNA, 20 nt, Artificial Sequence
  source: /note="Description of Artificial Sequence: Synthetic oligonucleotide"
uaagacuuuuucuuaacaua

SEQ ID NO: 7745 - RNA, 20 nt, Artificial Sequence
  source: /note="Description of Artificial Sequence: Synthetic oligonucleotide"
auaagacuuuuucuuaacau

SEQ ID NO: 7746 - RNA, 20 nt, Artificial Sequence
  source: /note="Description of Artificial Sequence: Synthetic oligonucleotide"
uuauuuguuuaacccaucgg

SEQ ID NO: 7747 - RNA, 20 nt, Artificial Sequence
  source: /note="Description of Artificial Sequence: Synthetic oligonucleotide"
aaaccuuuuuauuuguuuaa

SEQ ID NO: 7748 - RNA, 20 nt, Artificial Sequence
  source: /note="Description of Artificial Sequence: Synthetic oligonucleotide"
uaaaccuuuuuauuuguuua

SEQ ID NO: 7749 - RNA, 20 nt, Artificial Sequence
  source: /note="Description of Artificial Sequence: Synthetic oligonucleotide"
ucaacugagguuucaaguaa

SEQ ID NO: 7750 - RNA, 20 nt, Artificial Sequence
  source: /note="Description of Artificial Sequence: Synthetic oligonucleotide"
gucuuauaaaacuccuuaau

SEQ ID NO: 7751 - RNA, 20 nt, Artificial Sequence
  source: /note="Description of Artificial Sequence: Synthetic oligonucleotide"
ucaugaacgucuuauaaaac

SEQ ID NO: 7752 - RNA, 20 nt, Artificial Sequence
  source: /note="Description of Artificial Sequence: Synthetic oligonucleotide"
auucauguuuuuguuuuguu

SEQ ID NO: 7753 - RNA, 20 nt, Artificial Sequence
  source: /note="Description of Artificial Sequence: Synthetic oligonucleotide"
uauucauguuuuuguuuugu

SEQ ID NO: 7754 - RNA, 20 nt, Artificial Sequence
  source: /note="Description of Artificial Sequence: Synthetic oligonucleotide"
uccuuauucaaaaauuuuac

SEQ ID NO: 7755 - RNA, 20 nt, Artificial Sequence
  source: /note="Description of Artificial Sequence: Synthetic oligonucleotide"
uaucuucuuuaauuauguga

SEQ ID NO: 7756 - RNA, 20 nt, Artificial Sequence
  source: /note="Description of Artificial Sequence: Synthetic oligonucleotide"
guuggucagucuucaaaaug

SEQ ID NO: 7757 - RNA, 20 nt, Artificial Sequence
  source: /note="Description of Artificial Sequence: Synthetic oligonucleotide"
gaucucuuaguucauuuuuu

SEQ ID NO: 7758 - RNA, 20 nt, Artificial Sequence
  source: /note="Description of Artificial Sequence: Synthetic oligonucleotide"
gucuauuuuucuaauauaug

SEQ ID NO: 7759 - RNA, 20 nt, Artificial Sequence
  source: /note="Description of Artificial Sequence: Synthetic oligonucleotide"
agaaagacuauuuucuuuuu

SEQ ID NO: 7760 - RNA, 20 nt, Artificial Sequence
  source: /note="Description of Artificial Sequence: Synthetic oligonucleotide"
aagaaagacuauuuucuuuu

SEQ ID NO: 7761 - RNA, 20 nt, Artificial Sequence
  source: /note="Description of Artificial Sequence: Synthetic oligonucleotide"
aaaaauuaauccauuguaua

SEQ ID NO: 7762 - RNA, 20 nt, Artificial Sequence
  source: /note="Description of Artificial Sequence: Synthetic oligonucleotide"
auagagaaagccagaagaaa

SEQ ID NO: 7763 - RNA, 20 nt, Artificial Sequence
  source: /note="Description of Artificial Sequence: Synthetic oligonucleotide"
cagacaugugguuugggggu

SEQ ID NO: 7764 - RNA, 20 nt, Artificial Sequence
  source: /note="Description of Artificial Sequence: Synthetic oligonucleotide"
uucaugaugcgaauaaugga

SEQ ID NO: 7765 - RNA, 20 nt, Artificial Sequence
  source: /note="Description of Artificial Sequence: Synthetic oligonucleotide"
auucaugaugcgaauaaugg

SEQ ID NO: 7766 - RNA, 20 nt, Artificial Sequence
  source: /note="Description of Artificial Sequence: Synthetic oligonucleotide"
aacuccuacccucuucccuc

SEQ ID NO: 7767 - RNA, 20 nt, Artificial Sequence
  source: /note="Description of Artificial Sequence: Synthetic oligonucleotide"
uaugaaacuccuacccucuu

SEQ ID NO: 7768 - RNA, 20 nt, Artificial Sequence
  source: /note="Description of Artificial Sequence: Synthetic oligonucleotide"
cuaugaaacuccuacccucu

SEQ ID NO: 7769 - RNA, 20 nt, Artificial Sequence
  source: /note="Description of Artificial Sequence: Synthetic oligonucleotide"
ucgucccuaugaaacuccua

SEQ ID NO: 7770 - RNA, 20 nt, Artificial Sequence
  source: /note="Description of Artificial Sequence: Synthetic oligonucleotide"
gucgucccuaugaaacuccu

SEQ ID NO: 7771 - RNA, 20 nt, Artificial Sequence
  source: /note="Description of Artificial Sequence: Synthetic oligonucleotide"
gucugucgucccuaugaaac

SEQ ID NO: 7772 - RNA, 20 nt, Artificial Sequence
  source: /note="Description of Artificial Sequence: Synthetic oligonucleotide"
ucccccuuguugucugucgu

SEQ ID NO: 7773 - RNA, 20 nt, Artificial Sequence
  source: /note="Description of Artificial Sequence: Synthetic oligonucleotide"
cucccccuuguugucugucg

SEQ ID NO: 7774 - RNA, 20 nt, Artificial Sequence
  source: /note="Description of Artificial Sequence: Synthetic oligonucleotide"
uuguguaccuguguuucucc

SEQ ID NO: 7775 - RNA, 20 nt, Artificial Sequence
  source: /note="Description of Artificial Sequence: Synthetic oligonucleotide"
cuuguguaccuguguuucuc

SEQ ID NO: 7776 - RNA, 20 nt, Artificial Sequence
  source: /note="Description of Artificial Sequence: Synthetic oligonucleotide"
ucuuguguaccuguguuucu

SEQ ID NO: 7777 - RNA, 20 nt, Artificial Sequence
  source: /note="Description of Artificial Sequence: Synthetic oligonucleotide"
uucuuguguaccuguguuuc

SEQ ID NO: 7778 - RNA, 20 nt, Artificial Sequence
  source: /note="Description of Artificial Sequence: Synthetic oligonucleotide"
ucgauuugucguucuugugu

SEQ ID NO: 7779 - RNA, 20 nt, Artificial Sequence
  source: /note="Description of Artificial Sequence: Synthetic oligonucleotide"
uaugguguacaagagaauuc

SEQ ID NO: 7780 - RNA, 20 nt, Artificial Sequence
  source: /note="Description of Artificial Sequence: Synthetic oligonucleotide"
auaggauuuguuugauuguu

SEQ ID NO: 7781 - RNA, 20 nt, Artificial Sequence
  source: /note="Description of Artificial Sequence: Synthetic oligonucleotide"
ucguuguaccuaccucgacc

SEQ ID NO: 7782 - RNA, 20 nt, Artificial Sequence
  source: /note="Description of Artificial Sequence: Synthetic oligonucleotide"
acgucguuguaccuaccucg

SEQ ID NO: 7783 - RNA, 20 nt, Artificial Sequence
  source: /note="Description of Artificial Sequence: Synthetic oligonucleotide"
caagacacgucguuguaccu

SEQ ID NO: 7784 - RNA, 20 nt, Artificial Sequence
  source: /note="Description of Artificial Sequence: Synthetic oligonucleotide"
agcacaagacacgucguugu

SEQ ID NO: 7785 - RNA, 20 nt, Artificial Sequence
  source: /note="Description of Artificial Sequence: Synthetic oligonucleotide"
uuucacaauguauauguggu

SEQ ID NO: 7786 - RNA, 20 nt, Artificial Sequence
  source: /note="Description of Artificial Sequence: Synthetic oligonucleotide"
uuacaggcauucaucaucug

SEQ ID NO: 7787 - RNA, 20 nt, Artificial Sequence
  source: /note="Description of Artificial Sequence: Synthetic oligonucleotide"
auaauuacuaucgcuucugu

SEQ ID NO: 7788 - RNA, 20 nt, Artificial Sequence
  source: /note="Description of Artificial Sequence: Synthetic oligonucleotide"
auauuuaguaagaugguauu

SEQ ID NO: 7789 - RNA, 20 nt, Artificial Sequence
  source: /note="Description of Artificial Sequence: Synthetic oligonucleotide"
auaagccguauaauggguuu

SEQ ID NO: 7790 - RNA, 20 nt, Artificial Sequence
  source: /note="Description of Artificial Sequence: Synthetic oligonucleotide"
aauaagccguauaauggguu

SEQ ID NO: 7791 - RNA, 20 nt, Artificial Sequence
  source: /note="Description of Artificial Sequence: Synthetic oligonucleotide"
cuggcucguuaggguaauaa

SEQ ID NO: 7792 - RNA, 20 nt, Artificial Sequence
  source: /note="Description of Artificial Sequence: Synthetic oligonucleotide"
uucgucacgccauuaaaguc

SEQ ID NO: 7793 - RNA, 20 nt, Artificial Sequence
  source: /note="Description of Artificial Sequence: Synthetic oligonucleotide"
ucgacaacaccuuucgucac

SEQ ID NO: 7794 - RNA, 20 nt, Artificial Sequence
  source: /note="Description of Artificial Sequence: Synthetic oligonucleotide"
cauuugaucaagucgacaac

SEQ ID NO: 7795 - RNA, 20 nt, Artificial Sequence
  source: /note="Description of Artificial Sequence: Synthetic oligonucleotide"
gaauaggggaauaacgaaca

SEQ ID NO: 7796 - RNA, 20 nt, Artificial Sequence
  source: /note="Description of Artificial Sequence: Synthetic oligonucleotide"
ugaauaggggaauaacgaac

SEQ ID NO: 7797 - RNA, 20 nt, Artificial Sequence
  source: /note="Description of Artificial Sequence: Synthetic oligonucleotide"
aaucauuccacgucucuuuu

SEQ ID NO: 7798 - RNA, 20 nt, Artificial Sequence
  source: /note="Description of Artificial Sequence: Synthetic oligonucleotide"
uaaucauuccacgucucuuu

SEQ ID NO: 7799 - RNA, 20 nt, Artificial Sequence
  source: /note="Description of Artificial Sequence: Synthetic oligonucleotide"
ggagucuauaguagaaggga

SEQ ID NO: 7800 - RNA, 20 nt, Artificial Sequence
  source: /note="Description of Artificial Sequence: Synthetic oligonucleotide"
caaagucucgaaguacggaa

SEQ ID NO: 7801 - RNA, 20 nt, Artificial Sequence
  source: /note="Description of Artificial Sequence: Synthetic oligonucleotide"
guuuucuuccccccgcauac

SEQ ID NO: 7802 - RNA, 20 nt, Artificial Sequence
  source: /note="Description of Artificial Sequence: Synthetic oligonucleotide"
auguuuuucucuagaggggc

SEQ ID NO: 7803 - RNA, 20 nt, Artificial Sequence
  source: /note="Description of Artificial Sequence: Synthetic oligonucleotide"
uucuauguuuuucucuagag

SEQ ID NO: 7804 - RNA, 20 nt, Artificial Sequence
  source: /note="Description of Artificial Sequence: Synthetic oligonucleotide"
auucuauguuuuucucuaga

SEQ ID NO: 7805 - RNA, 20 nt, Artificial Sequence
  source: /note="Description of Artificial Sequence: Synthetic oligonucleotide"
gauucuauguuuuucucuag

SEQ ID NO: 7806 - RNA, 20 nt, Artificial Sequence
  source: /note="Description of Artificial Sequence: Synthetic oligonucleotide"
cuuuaugaaaaacccuuucu

SEQ ID NO: 7807 - RNA, 20 nt, Artificial Sequence
  source: /note="Description of Artificial Sequence: Synthetic oligonucleotide"
uauuccaggugacagaauag

SEQ ID NO: 7808 - RNA, 20 nt, Artificial Sequence
  source: /note="Description of Artificial Sequence: Synthetic oligonucleotide"
auauuccaggugacagaaua

SEQ ID NO: 7809 - RNA, 20 nt, Artificial Sequence
  source: /note="Description of Artificial Sequence: Synthetic oligonucleotide"
aauauuccaggugacagaau

SEQ ID NO: 7810 - RNA, 20 nt, Artificial Sequence
  source: /note="Description of Artificial Sequence: Synthetic oligonucleotide"
uucaguguuaucaauauucc

SEQ ID NO: 7811 - RNA, 20 nt, Artificial Sequence
  source: /note="Description of Artificial Sequence: Synthetic oligonucleotide"
ccaaauacaccugagagaua

SEQ ID NO: 7812 - RNA, 20 nt, Artificial Sequence
  source: /note="Description of Artificial Sequence: Synthetic oligonucleotide"
cuggcuuaaacuugccugca

SEQ ID NO: 7813 - RNA, 20 nt, Artificial Sequence
  source: /note="Description of Artificial Sequence: Synthetic oligonucleotide"
ucauauucucuuuaacacac

SEQ ID NO: 7814 - RNA, 20 nt, Artificial Sequence
  source: /note="Description of Artificial Sequence: Synthetic oligonucleotide"
agguucccuuuguuaucaaa

SEQ ID NO: 7815 - RNA, 20 nt, Artificial Sequence
  source: /note="Description of Artificial Sequence: Synthetic oligonucleotide"
ccuuccccuccagcccuuua

SEQ ID NO: 7816 - RNA, 20 nt, Artificial Sequence
  source: /note="Description of Artificial Sequence: Synthetic oligonucleotide"
ggugcaguagcuuuuuaaaa

SEQ ID NO: 7817 - RNA, 20 nt, Artificial Sequence
  source: /note="Description of Artificial Sequence: Synthetic oligonucleotide"
uggugcaguagcuuuuuaaa

SEQ ID NO: 7818 - RNA, 20 nt, Artificial Sequence
  source: /note="Description of Artificial Sequence: Synthetic oligonucleotide"
aggguuucacgacccuaaug

SEQ ID NO: 7819 - RNA, 20 nt, Artificial Sequence
  source: /note="Description of Artificial Sequence: Synthetic oligonucleotide"
ggaaccggaggguuucacga

SEQ ID NO: 7820 - RNA, 20 nt, Artificial Sequence
  source: /note="Description of Artificial Sequence: Synthetic oligonucleotide"
cggaaccggaggguuucacg

SEQ ID NO: 7821 - RNA, 20 nt, Artificial Sequence
  source: /note="Description of Artificial Sequence: Synthetic oligonucleotide"
gaguccacuagacggacgga

SEQ ID NO: 7822 - RNA, 20 nt, Artificial Sequence
  source: /note="Description of Artificial Sequence: Synthetic oligonucleotide"
ccagaacuugaggacuggag

SEQ ID NO: 7823 - RNA, 20 nt, Artificial Sequence
  source: /note="Description of Artificial Sequence: Synthetic oligonucleotide"
aaaaugauacaaccgguccg

SEQ ID NO: 7824 - RNA, 20 nt, Artificial Sequence
  source: /note="Description of Artificial Sequence: Synthetic oligonucleotide"
ccccaaaaugauacaaccgg

SEQ ID NO: 7825 - RNA, 20 nt, Artificial Sequence
  source: /note="Description of Artificial Sequence: Synthetic oligonucleotide"
cucuaccccaaaaugauaca

SEQ ID NO: 7826 - RNA, 20 nt, Artificial Sequence
  source: /note="Description of Artificial Sequence: Synthetic oligonucleotide"
aacauaaaaaucaucucuac

SEQ ID NO: 7827 - RNA, 20 nt, Artificial Sequence
  source: /note="Description of Artificial Sequence: Synthetic oligonucleotide"
aaacauaaaaaucaucucua

SEQ ID NO: 7828 - RNA, 20 nt, Artificial Sequence
  source: /note="Description of Artificial Sequence: Synthetic oligonucleotide"
aaaacauaaaaaucaucucu

SEQ ID NO: 7829 - RNA, 20 nt, Artificial Sequence
  source: /note="Description of Artificial Sequence: Synthetic oligonucleotide"
aggguucaucgacucuaaug

SEQ ID NO: 7830 - RNA, 20 nt, Artificial Sequence
  source: /note="Description of Artificial Sequence: Synthetic oligonucleotide"
gugacguuggagacggaggg

SEQ ID NO: 7831 - RNA, 20 nt, Artificial Sequence
  source: /note="Description of Artificial Sequence: Synthetic oligonucleotide"
ccucacgucgccguguuaga

SEQ ID NO: 7832 - RNA, 20 nt, Artificial Sequence
  source: /note="Description of Artificial Sequence: Synthetic oligonucleotide"
aacggguccgaccucacguc

SEQ ID NO: 7833 - RNA, 20 nt, Artificial Sequence
  source: /note="Description of Artificial Sequence: Synthetic oligonucleotide"
agagugagagaacggguccg

SEQ ID NO: 7834 - RNA, 20 nt, Artificial Sequence
  source: /note="Description of Artificial Sequence: Synthetic oligonucleotide"
ccucagagugagagaacggg

SEQ ID NO: 7835 - RNA, 20 nt, Artificial Sequence
  source: /note="Description of Artificial Sequence: Synthetic oligonucleotide"
aaaaaaaaaaaaaaaacucu

SEQ ID NO: 7836 - RNA, 20 nt, Artificial Sequence
  source: /note="Description of Artificial Sequence: Synthetic oligonucleotide"
ucaaaauuaccagcuaaugu

SEQ ID NO: 7837 - RNA, 20 nt, Artificial Sequence
  source: /note="Description of Artificial Sequence: Synthetic oligonucleotide"
aucaaaauuaccagcuaaug

SEQ ID NO: 7838 - RNA, 20 nt, Artificial Sequence
  source: /note="Description of Artificial Sequence: Synthetic oligonucleotide"
uuuauggucauggagaacaa

SEQ ID NO: 7839 - RNA, 20 nt, Artificial Sequence
  source: /note="Description of Artificial Sequence: Synthetic oligonucleotide"
auuuauggucauggagaaca

SEQ ID NO: 7840 - RNA, 20 nt, Artificial Sequence
  source: /note="Description of Artificial Sequence: Synthetic oligonucleotide"
cucuaaaauauuuaugguca

SEQ ID NO: 7841 - RNA, 20 nt, Artificial Sequence
  source: /note="Description of Artificial Sequence: Synthetic oligonucleotide"
uagcaacucuaaaauauuua

SEQ ID NO: 7842 - RNA, 20 nt, Artificial Sequence
  source: /note="Description of Artificial Sequence: Synthetic oligonucleotide"
gugacaacugacagcuacuc

SEQ ID NO: 7843 - RNA, 20 nt, Artificial Sequence
  source: /note="Description of Artificial Sequence: Synthetic oligonucleotide"
gaauaauuguggauaaauau

SEQ ID NO: 7844 - RNA, 20 nt, Artificial Sequence
  source: /note="Description of Artificial Sequence: Synthetic oligonucleotide"
uauaucuuaaggaauaauug

SEQ ID NO: 7845 - RNA, 20 nt, Artificial Sequence
  source: /note="Description of Artificial Sequence: Synthetic oligonucleotide"
aaaaauacuaauauaucuua

SEQ ID NO: 7846 - RNA, 20 nt, Artificial Sequence
  source: /note="Description of Artificial Sequence: Synthetic oligonucleotide"
cagaaauguacugagacaca

SEQ ID NO: 7847 - RNA, 20 nt, Artificial Sequence
  source: /note="Description of Artificial Sequence: Synthetic oligonucleotide"
agcaaauuuaucuucagaua

SEQ ID NO: 7848 - RNA, 20 nt, Artificial Sequence
  source: /note="Description of Artificial Sequence: Synthetic oligonucleotide"
gcaaauuuaucuucagauau

SEQ ID NO: 7849 - RNA, 20 nt, Artificial Sequence
  source: /note="Description of Artificial Sequence: Synthetic oligonucleotide"
cuuuuuuuaaaucuugaguc

SEQ ID NO: 7850 - RNA, 20 nt, Artificial Sequence
  source: /note="Description of Artificial Sequence: Synthetic oligonucleotide"
agucuggcagcaauuuguaa

SEQ ID NO: 7851 - RNA, 20 nt, Artificial Sequence
  source: /note="Description of Artificial Sequence: Synthetic oligonucleotide"
gcucuuuguauauuaucucc

SEQ ID NO: 7852 - RNA, 20 nt, Artificial Sequence
  source: /note="Description of Artificial Sequence: Synthetic oligonucleotide"
uaucuccuggagagacagcu

SEQ ID NO: 7853 - RNA, 20 nt, Artificial Sequence
  source: /note="Description of Artificial Sequence: Synthetic oligonucleotide"
aaugagaaaauaacgaccau

SEQ ID NO: 7854 - RNA, 20 nt, Artificial Sequence
  source: /note="Description of Artificial Sequence: Synthetic oligonucleotide"
uuuaaauauuuuuuaauuca

SEQ ID NO: 7855 - RNA, 20 nt, Artificial Sequence
  source: /note="Description of Artificial Sequence: Synthetic oligonucleotide"
uauuaguuucacaagauuuc

SEQ ID NO: 7856 - RNA, 20 nt, Artificial Sequence
  source: /note="Description of Artificial Sequence: Synthetic oligonucleotide"
ucacaagauuucuggcuaau

SEQ ID NO: 7857 - RNA, 20 nt, Artificial Sequence
  source: /note="Description of Artificial Sequence: Synthetic oligonucleotide"
cacaagauuucuggcuaaua

SEQ ID NO: 7858 - RNA, 20 nt, Artificial Sequence
  source: /note="Description of Artificial Sequence: Synthetic oligonucleotide"
uaucuucagucuucaugagu

SEQ ID NO: 7859 - RNA, 20 nt, Artificial Sequence
  source: /note="Description of Artificial Sequence: Synthetic oligonucleotide"
aucuucagucuucaugaguu

SEQ ID NO: 7860 - RNA, 20 nt, Artificial Sequence
  source: /note="Description of Artificial Sequence: Synthetic oligonucleotide"
ucuucagucuucaugaguug

SEQ ID NO: 7861 - RNA, 20 nt, Artificial Sequence
  source: /note="Description of Artificial Sequence: Synthetic oligonucleotide"
cuucagucuucaugaguugg

SEQ ID NO: 7862 - RNA, 20 nt, Artificial Sequence
  source: /note="Description of Artificial Sequence: Synthetic oligonucleotide"
cuuuucuccauuuauacauu

SEQ ID NO: 7863 - RNA, 20 nt, Artificial Sequence
  source: /note="Description of Artificial Sequence: Synthetic oligonucleotide"
uugauuaaaaaauaugauac

SEQ ID NO: 7864 - RNA, 20 nt, Artificial Sequence
  source: /note="Description of Artificial Sequence: Synthetic oligonucleotide"
ggcauaccucagagauauug

SEQ ID NO: 7865 - RNA, 20 nt, Artificial Sequence
  source: /note="Description of Artificial Sequence: Synthetic oligonucleotide"
gcauaccucagagauauugu

SEQ ID NO: 7866 - RNA, 20 nt, Artificial Sequence
  source: /note="Description of Artificial Sequence: Synthetic oligonucleotide"
ccucagagauauuguggguu

SEQ ID NO: 7867 - RNA, 20 nt, Artificial Sequence
  source: /note="Description of Artificial Sequence: Synthetic oligonucleotide"
uuacaauaaagcaaguugua

SEQ ID NO: 7868 - RNA, 20 nt, Artificial Sequence
  source: /note="Description of Artificial Sequence: Synthetic oligonucleotide"
agcaaguuguaaggacuuuu

SEQ ID NO: 7869 - RNA, 20 nt, Artificial Sequence
  source: /note="Description of Artificial Sequence: Synthetic oligonucleotide"
aaaaaaugccaacaauuauc

SEQ ID NO: 7870 - RNA, 20 nt, Artificial Sequence
  source: /note="Description of Artificial Sequence: Synthetic oligonucleotide"
aaaaaugccaacaauuaucu

SEQ ID NO: 7871 - RNA, 20 nt, Artificial Sequence
  source: /note="Description of Artificial Sequence: Synthetic oligonucleotide"
gugagugcuaaucuuuuugc

SEQ ID NO: 7872 - RNA, 20 nt, Artificial Sequence
  source: /note="Description of Artificial Sequence: Synthetic oligonucleotide"
agugcuaaucuuuuugcugg

SEQ ID NO: 7873 - RNA, 20 nt, Artificial Sequence
  source: /note="Description of Artificial Sequence: Synthetic oligonucleotide"
gcuaaucuuuuugcuggugg

SEQ ID NO: 7874 - RNA, 20 nt, Artificial Sequence
  source: /note="Description of Artificial Sequence: Synthetic oligonucleotide"
cuaaucuuuuugcuggugga

SEQ ID NO: 7875 - RNA, 20 nt, Artificial Sequence
  source: /note="Description of Artificial Sequence: Synthetic oligonucleotide"
ugcuucaguauugaucgcug

SEQ ID NO: 7876 - RNA, 20 nt, Artificial Sequence
  source: /note="Description of Artificial Sequence: Synthetic oligonucleotide"
ugaucgcuguggacugauca

SEQ ID NO: 7877 - RNA, 20 nt, Artificial Sequence
  source: /note="Description of Artificial Sequence: Synthetic oligonucleotide"
ucgcuguggacugaucaugg

SEQ ID NO: 7878 - RNA, 20 nt, Artificial Sequence
  source: /note="Description of Artificial Sequence: Synthetic oligonucleotide"
aucauggugguaguugcuga

SEQ ID NO: 7879 - RNA, 20 nt, Artificial Sequence
  source: /note="Description of Artificial Sequence: Synthetic oligonucleotide"
ugguaguugcugaagguugc

SEQ ID NO: 7880 - RNA, 20 nt, Artificial Sequence
  source: /note="Description of Artificial Sequence: Synthetic oligonucleotide"
gguaguugcugaagguugcu

SEQ ID NO: 7881 - RNA, 20 nt, Artificial Sequence
  source: /note="Description of Artificial Sequence: Synthetic oligonucleotide"
guugcugaagguugcuggga

SEQ ID NO: 7882 - RNA, 20 nt, Artificial Sequence
  source: /note="Description of Artificial Sequence: Synthetic oligonucleotide"
ugcugggauggcugugugug

SEQ ID NO: 7883 - RNA, 20 nt, Artificial Sequence
  source: /note="Description of Artificial Sequence: Synthetic oligonucleotide"
agcagaauuucuuugaaaau

SEQ ID NO: 7884 - RNA, 20 nt, Artificial Sequence
  source: /note="Description of Artificial Sequence: Synthetic oligonucleotide"
gcaguuuacagcaucuucau

SEQ ID NO: 7885 - RNA, 20 nt, Artificial Sequence
  source: /note="Description of Artificial Sequence: Synthetic oligonucleotide"
aguaacucagccccaucuuc

SEQ ID NO: 7886 - RNA, 20 nt, Artificial Sequence
  source: /note="Description of Artificial Sequence: Synthetic oligonucleotide"
ucaggcucuacuucuaauuc

SEQ ID NO: 7887 - RNA, 20 nt, Artificial Sequence
  source: /note="Description of Artificial Sequence: Synthetic oligonucleotide"
caucugcagugaccucucca

SEQ ID NO: 7888 - RNA, 20 nt, Artificial Sequence
  source: /note="Description of Artificial Sequence: Synthetic oligonucleotide"
acuccucaaaguaauccaug

SEQ ID NO: 7889 - RNA, 20 nt, Artificial Sequence
  source: /note="Description of Artificial Sequence: Synthetic oligonucleotide"
cuccucaaaguaauccauga

SEQ ID NO: 7890 - RNA, 20 nt, Artificial Sequence
  source: /note="Description of Artificial Sequence: Synthetic oligonucleotide"
ucaaaguaauccaugagggu

SEQ ID NO: 7891 - RNA, 20 nt, Artificial Sequence
  source: /note="Description of Artificial Sequence: Synthetic oligonucleotide"
uguucuuaauaacuucuaaa

SEQ ID NO: 7892 - RNA, 20 nt, Artificial Sequence
  source: /note="Description of Artificial Sequence: Synthetic oligonucleotide"
aauggugauaccuuuccaga

SEQ ID NO: 7893 - RNA, 20 nt, Artificial Sequence
  source: /note="Description of Artificial Sequence: Synthetic oligonucleotide"
ggcuuucaauguacuuugcc

SEQ ID NO: 7894 - RNA, 20 nt, Artificial Sequence
  source: /note="Description of Artificial Sequence: Synthetic oligonucleotide"
gauccaucagaagacuaucu

SEQ ID NO: 7895 - RNA, 20 nt, Artificial Sequence
  source: /note="Description of Artificial Sequence: Synthetic oligonucleotide"
aaaaguacuccuuaauccau

SEQ ID NO: 7896 - RNA, 20 nt, Artificial Sequence
  source: /note="Description of Artificial Sequence: Synthetic oligonucleotide"
agaaucaauguuguauuaac

SEQ ID NO: 7897 - RNA, 20 nt, Artificial Sequence
  source: /note="Description of Artificial Sequence: Synthetic oligonucleotide"
uuaaucuugugcaucuccau

SEQ ID NO: 7898 - RNA, 20 nt, Artificial Sequence
  source: /note="Description of Artificial Sequence: Synthetic oligonucleotide"
ugcaucuccaucggagcucu

SEQ ID NO: 7899 - RNA, 20 nt, Artificial Sequence
  source: /note="Description of Artificial Sequence: Synthetic oligonucleotide"
gcaucuccaucggagcucuu

SEQ ID NO: 7900 - RNA, 20 nt, Artificial Sequence
  source: /note="Description of Artificial Sequence: Synthetic oligonucleotide"
aucggagcucuugggugacu

SEQ ID NO: 7901 - RNA, 20 nt, Artificial Sequence
  source: /note="Description of Artificial Sequence: Synthetic oligonucleotide"
uugagcaguaauauuuugaa

SEQ ID NO: 7902 - RNA, 20 nt, Artificial Sequence
  source: /note="Description of Artificial Sequence: Synthetic oligonucleotide"
agcaguaauauuuugaaagg

SEQ ID NO: 7903 - RNA, 20 nt, Artificial Sequence
  source: /note="Description of Artificial Sequence: Synthetic oligonucleotide"
aauauuuugaaaggagguuu

SEQ ID NO: 7904 - RNA, 20 nt, Artificial Sequence
  source: /note="Description of Artificial Sequence: Synthetic oligonucleotide"
uuagcaguaagucucaacac

SEQ ID NO: 7905 - RNA, 20 nt, Artificial Sequence
  source: /note="Description of Artificial Sequence: Synthetic oligonucleotide"
uagcaguaagucucaacacu

SEQ ID NO: 7906 - RNA, 20 nt, Artificial Sequence
  source: /note="Description of Artificial Sequence: Synthetic oligonucleotide"
uuccauuacucuacacaagc

SEQ ID NO: 7907 - RNA, 20 nt, Artificial Sequence
  source: /note="Description of Artificial Sequence: Synthetic oligonucleotide"
uccauuacucuacacaagca

SEQ ID NO: 7908 - RNA, 20 nt, Artificial Sequence
  source: /note="Description of Artificial Sequence: Synthetic oligonucleotide"
uacacuuagcauaauucuua

SEQ ID NO: 7909 - RNA, 20 nt, Artificial Sequence
  source: /note="Description of Artificial Sequence: Synthetic oligonucleotide"
acacuuagcauaauucuuaa

SEQ ID NO: 7910 - RNA, 20 nt, Artificial Sequence
  source: /note="Description of Artificial Sequence: Synthetic oligonucleotide"
agcauaauucuuaagggccu

SEQ ID NO: 7911 - RNA, 20 nt, Artificial Sequence
  source: /note="Description of Artificial Sequence: Synthetic oligonucleotide"
gggccuuggaauuuucagaa

SEQ ID NO: 7912 - RNA, 20 nt, Artificial Sequence
  source: /note="Description of Artificial Sequence: Synthetic oligonucleotide"
uucagaaugguaaaugagua

SEQ ID NO: 7913 - RNA, 20 nt, Artificial Sequence
  source: /note="Description of Artificial Sequence: Synthetic oligonucleotide"
ucagaaugguaaaugaguau

SEQ ID NO: 7914 - RNA, 20 nt, Artificial Sequence
  source: /note="Description of Artificial Sequence: Synthetic oligonucleotide"
ucagccuguccuuugaagca

SEQ ID NO: 7915 - RNA, 20 nt, Artificial Sequence
  source: /note="Description of Artificial Sequence: Synthetic oligonucleotide"
cuaucuaugaaagucuuaga

SEQ ID NO: 7916 - RNA, 20 nt, Artificial Sequence
  source: /note="Description of Artificial Sequence: Synthetic oligonucleotide"
uggcaccuuguuucaauagu

SEQ ID NO: 7917 - RNA, 20 nt, Artificial Sequence
  source: /note="Description of Artificial Sequence: Synthetic oligonucleotide"
cauucucuucauagaacuga

SEQ ID NO: 7918 - RNA, 20 nt, Artificial Sequence
  source: /note="Description of Artificial Sequence: Synthetic oligonucleotide"
auucucuucauagaacugaa

SEQ ID NO: 7919 - RNA, 20 nt, Artificial Sequence
  source: /note="Description of Artificial Sequence: Synthetic oligonucleotide"
cauagaacugaagggaguca

SEQ ID NO: 7920 - RNA, 20 nt, Artificial Sequence
  source: /note="Description of Artificial Sequence: Synthetic oligonucleotide"
agggagucaaggccuugcuc

SEQ ID NO: 7921 - RNA, 20 nt, Artificial Sequence
  source: /note="Description of Artificial Sequence: Synthetic oligonucleotide"
ccuugcucuggauuaagcuu

SEQ ID NO: 7922 - RNA, 20 nt, Artificial Sequence
  source: /note="Description of Artificial Sequence: Synthetic oligonucleotide"
cuggauuaagcuuuggcuua

SEQ ID NO: 7923 - RNA, 20 nt, Artificial Sequence
  source: /note="Description of Artificial Sequence: Synthetic oligonucleotide"
cuuuggcuuaaggaauguug

SEQ ID NO: 7924 - RNA, 20 nt, Artificial Sequence
  source: /note="Description of Artificial Sequence: Synthetic oligonucleotide"
cgcucuccauaucagcaaua

SEQ ID NO: 7925 - RNA, 20 nt, Artificial Sequence
  source: /note="Description of Artificial Sequence: Synthetic oligonucleotide"
cuuaccuuucauguguucac

SEQ ID NO: 7926 - RNA, 20 nt, Artificial Sequence
  source: /note="Description of Artificial Sequence: Synthetic oligonucleotide"
uuuccuuuacauucacaacu

SEQ ID NO: 7927 - RNA, 20 nt, Artificial Sequence
  source: /note="Description of Artificial Sequence: Synthetic oligonucleotide"
acauucacaacuuggcuaac

SEQ ID NO: 7928 - RNA, 20 nt, Artificial Sequence
  source: /note="Description of Artificial Sequence: Synthetic oligonucleotide"
acuuggcuaacuggcaugca

SEQ ID NO: 7929 - RNA, 20 nt, Artificial Sequence
  source: /note="Description of Artificial Sequence: Synthetic oligonucleotide"
gccuagcuuucagccugucu

SEQ ID NO: 7930 - RNA, 20 nt, Artificial Sequence
  source: /note="Description of Artificial Sequence: Synthetic oligonucleotide"
aucuagcuuuugauuuaaag

SEQ ID NO: 7931 - RNA, 20 nt, Artificial Sequence
  source: /note="Description of Artificial Sequence: Synthetic oligonucleotide"
agcuuuugauuuaaaguggc

SEQ ID NO: 7932 - RNA, 20 nt, Artificial Sequence
  source: /note="Description of Artificial Sequence: Synthetic oligonucleotide"
ccuuucacuugaacacuuag

SEQ ID NO: 7933 - RNA, 20 nt, Artificial Sequence
  source: /note="Description of Artificial Sequence: Synthetic oligonucleotide"
gaacacuuagaggccacugu

SEQ ID NO: 7934 - RNA, 20 nt, Artificial Sequence
  source: /note="Description of Artificial Sequence: Synthetic oligonucleotide"
aacacuuagaggccacugua

SEQ ID NO: 7935 - RNA, 20 nt, Artificial Sequence
  source: /note="Description of Artificial Sequence: Synthetic oligonucleotide"
gccacuguaggguuauuaau

SEQ ID NO: 7936 - RNA, 20 nt, Artificial Sequence
  source: /note="Description of Artificial Sequence: Synthetic oligonucleotide"
uuucaauauuguuguguuuu

SEQ ID NO: 7937 - RNA, 20 nt, Artificial Sequence
  source: /note="Description of Artificial Sequence: Synthetic oligonucleotide"
uucaauauuguuguguuuua

SEQ ID NO: 7938 - RNA, 20 nt, Artificial Sequence
  source: /note="Description of Artificial Sequence: Synthetic oligonucleotide"
uuguguuuuagggaauagag

SEQ ID NO: 7939 - RNA, 20 nt, Artificial Sequence
  source: /note="Description of Artificial Sequence: Synthetic oligonucleotide"
uuuagggaauagagaggccc

SEQ ID NO: 7940 - RNA, 20 nt, Artificial Sequence
  source: /note="Description of Artificial Sequence: Synthetic oligonucleotide"
uuagggaauagagaggccca

SEQ ID NO: 7941 - RNA, 20 nt, Artificial Sequence
  source: /note="Description of Artificial Sequence: Synthetic oligonucleotide"
gaauagagaggcccagggag

SEQ ID NO: 7942 - RNA, 20 nt, Artificial Sequence
  source: /note="Description of Artificial Sequence: Synthetic oligonucleotide"
aauagagaggcccagggaga

SEQ ID NO: 7943 - RNA, 20 nt, Artificial Sequence
  source: /note="Description of Artificial Sequence: Synthetic oligonucleotide"
ggagagggagagagcccaaa

SEQ ID NO: 7944 - RNA, 20 nt, Artificial Sequence
  source: /note="Description of Artificial Sequence: Synthetic oligonucleotide"
agggagagagcccaaacggc

SEQ ID NO: 7945 - RNA, 20 nt, Artificial Sequence
  source: /note="Description of Artificial Sequence: Synthetic oligonucleotide"
aaacggcugguugauagagc

SEQ ID NO: 7946 - RNA, 20 nt, Artificial Sequence
  source: /note="Description of Artificial Sequence: Synthetic oligonucleotide"
uugcaccauuuaccagauua

SEQ ID NO: 7947 - RNA, 20 nt, Artificial Sequence
  source: /note="Description of Artificial Sequence: Synthetic oligonucleotide"
ugcaccauuuaccagauuau

SEQ ID NO: 7948 - RNA, 20 nt, Artificial Sequence
  source: /note="Description of Artificial Sequence: Synthetic oligonucleotide"
cauuuaccagauuaugggua

SEQ ID NO: 7949 - RNA, 20 nt, Artificial Sequence
  source: /note="Description of Artificial Sequence: Synthetic oligonucleotide"
cagauuauggguacgguuug

SEQ ID NO: 7950 - RNA, 20 nt, Artificial Sequence
  source: /note="Description of Artificial Sequence: Synthetic oligonucleotide"
ugauagacauacuuaacacg

SEQ ID NO: 7951 - RNA, 20 nt, Artificial Sequence
  source: /note="Description of Artificial Sequence: Synthetic oligonucleotide"
gauagacauacuuaacacgu

SEQ ID NO: 7952 - RNA, 20 nt, Artificial Sequence
  source: /note="Description of Artificial Sequence: Synthetic oligonucleotide"
gaacaaagcacaauaaaacg

SEQ ID NO: 7953 - RNA, 20 nt, Artificial Sequence
  source: /note="Description of Artificial Sequence: Synthetic oligonucleotide"
aaagcuuuuuguuaaaauuc

SEQ ID NO: 7954 - RNA, 20 nt, Artificial Sequence
  source: /note="Description of Artificial Sequence: Synthetic oligonucleotide"
uaaaauucaggauauguaau

SEQ ID NO: 7955 - RNA, 20 nt, Artificial Sequence
  source: /note="Description of Artificial Sequence: Synthetic oligonucleotide"
aggauauguaauaggucugu

SEQ ID NO: 7956 - RNA, 20 nt, Artificial Sequence
  source: /note="Description of Artificial Sequence: Synthetic oligonucleotide"
uagugaaauauuuuugcuga

SEQ ID NO: 7957 - RNA, 20 nt, Artificial Sequence
  source: /note="Description of Artificial Sequence: Synthetic oligonucleotide"
gauggauguagauauauacg

SEQ ID NO: 7958 - RNA, 20 nt, Artificial Sequence
  source: /note="Description of Artificial Sequence: Synthetic oligonucleotide"
agacaaauguuaaauuagug

SEQ ID NO: 7959 - RNA, 20 nt, Artificial Sequence
  source: /note="Description of Artificial Sequence: Synthetic oligonucleotide"
gauaccccacacuguguaga

SEQ ID NO: 7960 - RNA, 20 nt, Artificial Sequence
  source: /note="Description of Artificial Sequence: Synthetic oligonucleotide"
ccccacacuguguagaagga

SEQ ID NO: 7961 - RNA, 20 nt, Artificial Sequence
  source: /note="Description of Artificial Sequence: Synthetic oligonucleotide"
cacacuguguagaaggaugg

SEQ ID NO: 7962 - RNA, 20 nt, Artificial Sequence
  source: /note="Description of Artificial Sequence: Synthetic oligonucleotide"
acacuguguagaaggaugga

SEQ ID NO: 7963 - RNA, 20 nt, Artificial Sequence
  source: /note="Description of Artificial Sequence: Synthetic oligonucleotide"
cuguguagaaggauggaggg

SEQ ID NO: 7964 - RNA, 20 nt, Artificial Sequence
  source: /note="Description of Artificial Sequence: Synthetic oligonucleotide"
cuacugucccucuuugcgug

SEQ ID NO: 7965 - RNA, 20 nt, Artificial Sequence
  source: /note="Description of Artificial Sequence: Synthetic oligonucleotide"
ugguuauuaaguugccucac

SEQ ID NO: 7966 - RNA, 20 nt, Artificial Sequence
  source: /note="Description of Artificial Sequence: Synthetic oligonucleotide"
gguuauuaaguugccucacu

SEQ ID NO: 7967 - RNA, 20 nt, Artificial Sequence
  source: /note="Description of Artificial Sequence: Synthetic oligonucleotide"
cacaucucauagauaauauu

SEQ ID NO: 7968 - RNA, 20 nt, Artificial Sequence
  source: /note="Description of Artificial Sequence: Synthetic oligonucleotide"
ucccacuuuuccaucuuugu

SEQ ID NO: 7969 - RNA, 20 nt, Artificial Sequence
  source: /note="Description of Artificial Sequence: Synthetic oligonucleotide"
uucuuuuugccugacucucc

SEQ ID NO: 7970 - RNA, 20 nt, Artificial Sequence
  source: /note="Description of Artificial Sequence: Synthetic oligonucleotide"
uucuaaaguacauacuaaua

SEQ ID NO: 7971 - RNA, 20 nt, Artificial Sequence
  source: /note="Description of Artificial Sequence: Synthetic oligonucleotide"
ucuaaaguacauacuaauau

SEQ ID NO: 7972 - RNA, 20 nt, Artificial Sequence
  source: /note="Description of Artificial Sequence: Synthetic oligonucleotide"
aguacauacuaauauggguc

SEQ ID NO: 7973 - RNA, 20 nt, Artificial Sequence
  source: /note="Description of Artificial Sequence: Synthetic oligonucleotide"
aaacagcaauuaaauguuau

SEQ ID NO: 7974 - RNA, 20 nt, Artificial Sequence
  source: /note="Description of Artificial Sequence: Synthetic oligonucleotide"
aacagcaauuaaauguuaua

SEQ ID NO: 7975 - RNA, 20 nt, Artificial Sequence
  source: /note="Description of Artificial Sequence: Synthetic oligonucleotide"
auuaaauguuauagggaagu

SEQ ID NO: 7976 - RNA, 20 nt, Artificial Sequence
  source: /note="Description of Artificial Sequence: Synthetic oligonucleotide"
auagggaaguaggaagaaaa

SEQ ID NO: 7977 - RNA, 20 nt, Artificial Sequence
  source: /note="Description of Artificial Sequence: Synthetic oligonucleotide"
uagggaaguaggaagaaaaa

SEQ ID NO: 7978 - RNA, 20 nt, Artificial Sequence
  source: /note="Description of Artificial Sequence: Synthetic oligonucleotide"
agggaaguaggaagaaaaag

SEQ ID NO: 7979 - RNA, 20 nt, Artificial Sequence
  source: /note="Description of Artificial Sequence: Synthetic oligonucleotide"
caauaaaccaagcaauauuc

SEQ ID NO: 7980 - RNA, 20 nt, Artificial Sequence
  source: /note="Description of Artificial Sequence: Synthetic oligonucleotide"
aauaaaccaagcaauauucu

SEQ ID NO: 7981 - RNA, 20 nt, Artificial Sequence
  source: /note="Description of Artificial Sequence: Synthetic oligonucleotide"
auaaaccaagcaauauucug

SEQ ID NO: 7982 - RNA, 20 nt, Artificial Sequence
  source: /note="Description of Artificial Sequence: Synthetic oligonucleotide"
uaaaccaagcaauauucugg

SEQ ID NO: 7983 - RNA, 20 nt, Artificial Sequence
  source: /note="Description of Artificial Sequence: Synthetic oligonucleotide"
accaagcaauauucuggggg

SEQ ID NO: 7984 - RNA, 20 nt, Artificial Sequence
  source: /note="Description of Artificial Sequence: Synthetic oligonucleotide"
ccaagcaauauucugggggu

SEQ ID NO: 7985 - RNA, 20 nt, Artificial Sequence
  source: /note="Description of Artificial Sequence: Synthetic oligonucleotide"
uucugggggugggauagagc

SEQ ID NO: 7986 - RNA, 20 nt, Artificial Sequence
  source: /note="Description of Artificial Sequence: Synthetic oligonucleotide"
ucuuuuaaaauccaaguaau

SEQ ID NO: 7987 - RNA, 20 nt, Artificial Sequence
  source: /note="Description of Artificial Sequence: Synthetic oligonucleotide"
uuaaaauccaaguaauaggu

SEQ ID NO: 7988 - RNA, 20 nt, Artificial Sequence
  source: /note="Description of Artificial Sequence: Synthetic oligonucleotide"
uuuuuuccagcucaaaaaau

SEQ ID NO: 7989 - RNA, 20 nt, Artificial Sequence
  source: /note="Description of Artificial Sequence: Synthetic oligonucleotide"
uuuguuuaguuucauuuauu

SEQ ID NO: 7990 - RNA, 20 nt, Artificial Sequence
  source: /note="Description of Artificial Sequence: Synthetic oligonucleotide"
uguacauauacuuaauuaug

SEQ ID NO: 7991 - RNA, 20 nt, Artificial Sequence
  source: /note="Description of Artificial Sequence: Synthetic oligonucleotide"
uagagcccuuaauguguagu

SEQ ID NO: 7992 - RNA, 20 nt, Artificial Sequence
  source: /note="Description of Artificial Sequence: Synthetic oligonucleotide"
agagcccuuaauguguaguu

SEQ ID NO: 7993 - RNA, 20 nt, Artificial Sequence
  source: /note="Description of Artificial Sequence: Synthetic oligonucleotide"
gagcccuuaauguguaguug

SEQ ID NO: 7994 - RNA, 20 nt, Artificial Sequence
  source: /note="Description of Artificial Sequence: Synthetic oligonucleotide"
agcccuuaauguguaguugg

SEQ ID NO: 7995 - RNA, 20 nt, Artificial Sequence
  source: /note="Description of Artificial Sequence: Synthetic oligonucleotide"
uaguuggggguuaagcuuug

SEQ ID NO: 7996 - RNA, 20 nt, Artificial Sequence
  source: /note="Description of Artificial Sequence: Synthetic oligonucleotide"
cuuuauauuuaguauaauug

SEQ ID NO: 7997 - RNA, 20 nt, Artificial Sequence
  source: /note="Description of Artificial Sequence: Synthetic oligonucleotide"
caugugucucaguacauuuc

SEQ ID NO: 7998 - RNA, 20 nt, Artificial Sequence
  source: /note="Description of Artificial Sequence: Synthetic oligonucleotide"
gaagauaaauuugcuaauuc

SEQ ID NO: 7999 - RNA, 20 nt, Artificial Sequence
  source: /note="Description of Artificial Sequence: Synthetic oligonucleotide"
acucaagauuuaaaaaaaga

SEQ ID NO: 8000 - RNA, 20 nt, Artificial Sequence
  source: /note="Description of Artificial Sequence: Synthetic oligonucleotide"
cuuucacaagacacaagcau

SEQ ID NO: 8001 - RNA, 20 nt, Artificial Sequence
  source: /note="Description of Artificial Sequence: Synthetic oligonucleotide"
gcacgauuauuuaauucuuu

SEQ ID NO: 8002 - RNA, 20 nt, Artificial Sequence
  source: /note="Description of Artificial Sequence: Synthetic oligonucleotide"
uuuuacaggaucugaagaga

SEQ ID NO: 8003 - RNA, 20 nt, Artificial Sequence
  source: /note="Description of Artificial Sequence: Synthetic oligonucleotide"
auuuuacaggaucugaagag

SEQ ID NO: 8004 - RNA, 20 nt, Artificial Sequence
  source: /note="Description of Artificial Sequence: Synthetic oligonucleotide"
cagauacauucaaauuuuac

SEQ ID NO: 8005 - RNA, 20 nt, Artificial Sequence
  source: /note="Description of Artificial Sequence: Synthetic oligonucleotide"
uaauauacaaagagcuaaau

SEQ ID NO: 8006 - RNA, 20 nt, Artificial Sequence
  source: /note="Description of Artificial Sequence: Synthetic oligonucleotide"
ugcugccuagcugucucucc

SEQ ID NO: 8007 - RNA, 20 nt, Artificial Sequence
  source: /note="Description of Artificial Sequence: Synthetic oligonucleotide"
uucguacauuagacugccua

SEQ ID NO: 8008 - RNA, 20 nt, Artificial Sequence
  source: /note="Description of Artificial Sequence: Synthetic oligonucleotide"
aauggagaaaaggaaacuuu

SEQ ID NO: 8009 - RNA, 20 nt, Artificial Sequence
  source: /note="Description of Artificial Sequence: Synthetic oligonucleotide"
caaauguauaaauggagaaa

SEQ ID NO: 8010 - RNA, 20 nt, Artificial Sequence
  source: /note="Description of Artificial Sequence: Synthetic oligonucleotide"
caacauuccaaauguauaaa

SEQ ID NO: 8011 - RNA, 20 nt, Artificial Sequence
  source: /note="Description of Artificial Sequence: Synthetic oligonucleotide"
agaugaaauuuuagagaaaa

SEQ ID NO: 8012 - RNA, 20 nt, Artificial Sequence
  source: /note="Description of Artificial Sequence: Synthetic oligonucleotide"
aagaugaaauuuuagagaaa

SEQ ID NO: 8013 - RNA, 20 nt, Artificial Sequence
  source: /note="Description of Artificial Sequence: Synthetic oligonucleotide"
gguuuggguguuauagagac

SEQ ID NO: 8014 - RNA, 20 nt, Artificial Sequence
  source: /note="Description of Artificial Sequence: Synthetic oligonucleotide"
uauaaguaaaauaacaccau

SEQ ID NO: 8015 - RNA, 20 nt, Artificial Sequence
  source: /note="Description of Artificial Sequence: Synthetic oligonucleotide"
aacauuauaaguaaaauaac

SEQ ID NO: 8016 - RNA, 20 nt, Artificial Sequence
  source: /note="Description of Artificial Sequence: Synthetic oligonucleotide"
gauuuccgggucuauuaaca

SEQ ID NO: 8017 - RNA, 20 nt, Artificial Sequence
  source: /note="Description of Artificial Sequence: Synthetic oligonucleotide"
uuuucuaaucgugagugauu

SEQ ID NO: 8018 - RNA, 20 nt, Artificial Sequence
  source: /note="Description of Artificial Sequence: Synthetic oligonucleotide"
ugucucuuuagaaaacacuu

SEQ ID NO: 8019 - RNA, 20 nt, Artificial Sequence
  source: /note="Description of Artificial Sequence: Synthetic oligonucleotide"
aaaguuucuuuaagacgaca

SEQ ID NO: 8020 - RNA, 20 nt, Artificial Sequence
  source: /note="Description of Artificial Sequence: Synthetic oligonucleotide"
aaaaguuucuuuaagacgac

SEQ ID NO: 8021 - RNA, 20 nt, Artificial Sequence
  source: /note="Description of Artificial Sequence: Synthetic oligonucleotide"
uucgucgucgugucaaacuc

SEQ ID NO: 8022 - RNA, 20 nt, Artificial Sequence
  source: /note="Description of Artificial Sequence: Synthetic oligonucleotide"
uugacgacuuuacuguuguu

SEQ ID NO: 8023 - RNA, 20 nt, Artificial Sequence
  source: /note="Description of Artificial Sequence: Synthetic oligonucleotide"
acuuguuucuuacaaacucu

SEQ ID NO: 8024 - RNA, 20 nt, Artificial Sequence
  source: /note="Description of Artificial Sequence: Synthetic oligonucleotide"
acuauucuucaacgaagaau

SEQ ID NO: 8025 - RNA, 20 nt, Artificial Sequence
  source: /note="Description of Artificial Sequence: Synthetic oligonucleotide"
ucuucaucucggacuucuac

SEQ ID NO: 8026 - RNA, 20 nt, Artificial Sequence
  source: /note="Description of Artificial Sequence: Synthetic oligonucleotide"
aucuucaucucggacuucua

SEQ ID NO: 8027 - RNA, 20 nt, Artificial Sequence
  source: /note="Description of Artificial Sequence: Synthetic oligonucleotide"
aaucuucaucucggacuucu

SEQ ID NO: 8028 - RNA, 20 nt, Artificial Sequence
  source: /note="Description of Artificial Sequence: Synthetic oligonucleotide"
ccucuccagugacgucuacu

SEQ ID NO: 8029 - RNA, 20 nt, Artificial Sequence
  source: /note="Description of Artificial Sequence: Synthetic oligonucleotide"
accucuccagugacgucuac

SEQ ID NO: 8030 - RNA, 20 nt, Artificial Sequence
  source: /note="Description of Artificial Sequence: Synthetic oligonucleotide"
ucaaguucugaaggcaccuc

SEQ ID NO: 8031 - RNA, 20 nt, Artificial Sequence
  source: /note="Description of Artificial Sequence: Synthetic oligonucleotide"
acuccucaaguucugaaggc

SEQ ID NO: 8032 - RNA, 20 nt, Artificial Sequence
  source: /note="Description of Artificial Sequence: Synthetic oligonucleotide"
uugggaguaccuaaugaaac

SEQ ID NO: 8033 - RNA, 20 nt, Artificial Sequence
  source: /note="Description of Artificial Sequence: Synthetic oligonucleotide"
cuucaacuaagguugggagu

SEQ ID NO: 8034 - RNA, 20 nt, Artificial Sequence
  source: /note="Description of Artificial Sequence: Synthetic oligonucleotide"
caguuauauaguuguaauug

SEQ ID NO: 8035 - RNA, 20 nt, Artificial Sequence
  source: /note="Description of Artificial Sequence: Synthetic oligonucleotide"
guaaguauuaaguacccucc

SEQ ID NO: 8036 - RNA, 20 nt, Artificial Sequence
  source: /note="Description of Artificial Sequence: Synthetic oligonucleotide"
uguaaguauuaaguacccuc

SEQ ID NO: 8037 - RNA, 20 nt, Artificial Sequence
  source: /note="Description of Artificial Sequence: Synthetic oligonucleotide"
uuguaaguauuaaguacccu

SEQ ID NO: 8038 - RNA, 20 nt, Artificial Sequence
  source: /note="Description of Artificial Sequence: Synthetic oligonucleotide"
cuuguaaguauuaaguaccc

SEQ ID NO: 8039 - RNA, 20 nt, Artificial Sequence
  source: /note="Description of Artificial Sequence: Synthetic oligonucleotide"
auucuuguaaguauuaagua

SEQ ID NO: 8040 - RNA, 20 nt, Artificial Sequence
  source: /note="Description of Artificial Sequence: Synthetic oligonucleotide"
aauucuuguaaguauuaagu

SEQ ID NO: 8041 - RNA, 20 nt, Artificial Sequence
  source: /note="Description of Artificial Sequence: Synthetic oligonucleotide"
uguaacuuucggaagaccuu

SEQ ID NO: 8042 - RNA, 20 nt, Artificial Sequence
  source: /note="Description of Artificial Sequence: Synthetic oligonucleotide"
uuucauguaacuuucggaag

SEQ ID NO: 8043 - RNA, 20 nt, Artificial Sequence
  source: /note="Description of Artificial Sequence: Synthetic oligonucleotide"
cuaucagaagacuaccuagg

SEQ ID NO: 8044 - RNA, 20 nt, Artificial Sequence
  source: /note="Description of Artificial Sequence: Synthetic oligonucleotide"
ucuaucagaagacuaccuag

SEQ ID NO: 8045 - RNA, 20 nt, Artificial Sequence
  source: /note="Description of Artificial Sequence: Synthetic oligonucleotide"
gacgguucuaucagaagacu

SEQ ID NO: 8046 - RNA, 20 nt, Artificial Sequence
  source: /note="Description of Artificial Sequence: Synthetic oligonucleotide"
uaagacgucggauaccuaau

SEQ ID NO: 8047 - RNA, 20 nt, Artificial Sequence
  source: /note="Description of Artificial Sequence: Synthetic oligonucleotide"
uuguaacuaagacgucggau

SEQ ID NO: 8048 - RNA, 20 nt, Artificial Sequence
  source: /note="Description of Artificial Sequence: Synthetic oligonucleotide"
aucaguggguucucgaggcu

SEQ ID NO: 8049 - RNA, 20 nt, Artificial Sequence
  source: /note="Description of Artificial Sequence: Synthetic oligonucleotide"
aaaguuuuauaaugacgagu

SEQ ID NO: 8050 - RNA, 20 nt, Artificial Sequence
  source: /note="Description of Artificial Sequence: Synthetic oligonucleotide"
ucauuaccuuguuguuucag

SEQ ID NO: 8051 - RNA, 20 nt, Artificial Sequence
  source: /note="Description of Artificial Sequence: Synthetic oligonucleotide"
ugggacgaacacaucucauu

SEQ ID NO: 8052 - RNA, 20 nt, Artificial Sequence
  source: /note="Description of Artificial Sequence: Synthetic oligonucleotide"
aaugguaagacuuuuaaggu

SEQ ID NO: 8053 - RNA, 20 nt, Artificial Sequence
  source: /note="Description of Artificial Sequence: Synthetic oligonucleotide"
guccgacugagagaacaaug

SEQ ID NO: 8054 - RNA, 20 nt, Artificial Sequence
  source: /note="Description of Artificial Sequence: Synthetic oligonucleotide"
uuacggaacgaaguuuccug

SEQ ID NO: 8055 - RNA, 20 nt, Artificial Sequence
  source: /note="Description of Artificial Sequence: Synthetic oligonucleotide"
uucaguuacggaacgaaguu

SEQ ID NO: 8056 - RNA, 20 nt, Artificial Sequence
  source: /note="Description of Artificial Sequence: Synthetic oligonucleotide"
uugucggaugauaacuuugu

SEQ ID NO: 8057 - RNA, 20 nt, Artificial Sequence
  source: /note="Description of Artificial Sequence: Synthetic oligonucleotide"
cgauucuagugacuacuucc

SEQ ID NO: 8058 - RNA, 20 nt, Artificial Sequence
  source: /note="Description of Artificial Sequence: Synthetic oligonucleotide"
gaucgauucuagugacuacu

SEQ ID NO: 8059 - RNA, 20 nt, Artificial Sequence
  source: /note="Description of Artificial Sequence: Synthetic oligonucleotide"
auuguauuuuccuguuccac

SEQ ID NO: 8060 - RNA, 20 nt, Artificial Sequence
  source: /note="Description of Artificial Sequence: Synthetic oligonucleotide"
gagauauuguauuuuccugu

SEQ ID NO: 8061 - RNA, 20 nt, Artificial Sequence
  source: /note="Description of Artificial Sequence: Synthetic oligonucleotide"
ucgacagagauauuguauuu

SEQ ID NO: 8062 - RNA, 20 nt, Artificial Sequence
  source: /note="Description of Artificial Sequence: Synthetic oligonucleotide"
ucaaccuucgaucgucuuca

SEQ ID NO: 8063 - RNA, 20 nt, Artificial Sequence
  source: /note="Description of Artificial Sequence: Synthetic oligonucleotide"
ccuucgacgucuucucuuca

SEQ ID NO: 8064 - RNA, 20 nt, Artificial Sequence
  source: /note="Description of Artificial Sequence: Synthetic oligonucleotide"
agucaagauacuucucuuac

SEQ ID NO: 8065 - RNA, 20 nt, Artificial Sequence
  source: /note="Description of Artificial Sequence: Synthetic oligonucleotide"
gguuucgaauuaggucucgu

SEQ ID NO: 8066 - RNA, 20 nt, Artificial Sequence
  source: /note="Description of Artificial Sequence: Synthetic oligonucleotide"
accucucgcgaaaucaccag

SEQ ID NO: 8067 - RNA, 20 nt, Artificial Sequence
  source: /note="Description of Artificial Sequence: Synthetic oligonucleotide"
acuauaccucucgcgaaauc

SEQ ID NO: 8068 - RNA, 20 nt, Artificial Sequence
  source: /note="Description of Artificial Sequence: Synthetic oligonucleotide"
uuugccggaauaacgacuau

SEQ ID NO: 8069 - RNA, 20 nt, Artificial Sequence
  source: /note="Description of Artificial Sequence: Synthetic oligonucleotide"
acuuuccauucuuucguuuu

SEQ ID NO: 8070 - RNA, 20 nt, Artificial Sequence
  source: /note="Description of Artificial Sequence: Synthetic oligonucleotide"
augaggucacuuguguacuu

SEQ ID NO: 8071 - RNA, 20 nt, Artificial Sequence
  source: /note="Description of Artificial Sequence: Synthetic oligonucleotide"
acauuuccuuuuuaagaacu

SEQ ID NO: 8072 - RNA, 20 nt, Artificial Sequence
  source: /note="Description of Artificial Sequence: Synthetic oligonucleotide"
aucgguucaacacuuacauu

SEQ ID NO: 8073 - RNA, 20 nt, Artificial Sequence
  source: /note="Description of Artificial Sequence: Synthetic oligonucleotide"
cgguucuguccgacuuucga

SEQ ID NO: 8074 - RNA, 20 nt, Artificial Sequence
  source: /note="Description of Artificial Sequence: Synthetic oligonucleotide"
ccguacaguuuucgguucug

SEQ ID NO: 8075 - RNA, 20 nt, Artificial Sequence
  source: /note="Description of Artificial Sequence: Synthetic oligonucleotide"
auacugcucgauucacuccu

SEQ ID NO: 8076 - RNA, 20 nt, Artificial Sequence
  source: /note="Description of Artificial Sequence: Synthetic oligonucleotide"
aucuauacugcucgauucac

SEQ ID NO: 8077 - RNA, 20 nt, Artificial Sequence
  source: /note="Description of Artificial Sequence: Synthetic oligonucleotide"
ggagauucacaaguucacuu

SEQ ID NO: 8078 - RNA, 20 nt, Artificial Sequence
  source: /note="Description of Artificial Sequence: Synthetic oligonucleotide"
cgguuaauuauugggauguc

SEQ ID NO: 8079 - RNA, 20 nt, Artificial Sequence
  source: /note="Description of Artificial Sequence: Synthetic oligonucleotide"
uuguguuguuauaacuuuaa

SEQ ID NO: 8080 - RNA, 20 nt, Artificial Sequence
  source: /note="Description of Artificial Sequence: Synthetic oligonucleotide"
acccgagagagggagaggga

SEQ ID NO: 8081 - RNA, 20 nt, Artificial Sequence
  source: /note="Description of Artificial Sequence: Synthetic oligonucleotide"
aacccgagagagggagaggg

SEQ ID NO: 8082 - RNA, 20 nt, Artificial Sequence
  source: /note="Description of Artificial Sequence: Synthetic oligonucleotide"
cgagauaguuggucggcaaa

SEQ ID NO: 8083 - RNA, 20 nt, Artificial Sequence
  source: /note="Description of Artificial Sequence: Synthetic oligonucleotide"
acgagauaguuggucggcaa

SEQ ID NO: 8084 - RNA, 20 nt, Artificial Sequence
  source: /note="Description of Artificial Sequence: Synthetic oligonucleotide"
gcauggguauuagaccauuu

SEQ ID NO: 8085 - RNA, 20 nt, Artificial Sequence
  source: /note="Description of Artificial Sequence: Synthetic oligonucleotide"
guguuuggcauggguauuag

SEQ ID NO: 8086 - RNA, 20 nt, Artificial Sequence
  source: /note="Description of Artificial Sequence: Synthetic oligonucleotide"
aaugauaagauuaaaaaccc

SEQ ID NO: 8087 - RNA, 20 nt, Artificial Sequence
  source: /note="Description of Artificial Sequence: Synthetic oligonucleotide"
caaugauaagauuaaaaacc

SEQ ID NO: 8088 - RNA, 20 nt, Artificial Sequence
  source: /note="Description of Artificial Sequence: Synthetic oligonucleotide"
acaaugauaagauuaaaaac

SEQ ID NO: 8089 - RNA, 20 nt, Artificial Sequence
  source: /note="Description of Artificial Sequence: Synthetic oligonucleotide"
uacaaugauaagauuaaaaa

SEQ ID NO: 8090 - RNA, 20 nt, Artificial Sequence
  source: /note="Description of Artificial Sequence: Synthetic oligonucleotide"
cuacaaugauaagauuaaaa

SEQ ID NO: 8091 - RNA, 20 nt, Artificial Sequence
  source: /note="Description of Artificial Sequence: Synthetic oligonucleotide"
caaauaauaauaaauacaau

SEQ ID NO: 8092 - RNA, 20 nt, Artificial Sequence
  source: /note="Description of Artificial Sequence: Synthetic oligonucleotide"
guacagagacauaguguaaa

SEQ ID NO: 8093 - RNA, 20 nt, Artificial Sequence
  source: /note="Description of Artificial Sequence: Synthetic oligonucleotide"
aaaauguuugacuuccaaac

SEQ ID NO: 8094 - RNA, 20 nt, Artificial Sequence
  source: /note="Description of Artificial Sequence: Synthetic oligonucleotide"
gacacugaaaauguuugacu

SEQ ID NO: 8095 - RNA, 20 nt, Artificial Sequence
  source: /note="Description of Artificial Sequence: Synthetic oligonucleotide"
aaagcuuuuuuuaaaaauag

SEQ ID NO: 8096 - RNA, 20 nt, Artificial Sequence
  source: /note="Description of Artificial Sequence: Synthetic oligonucleotide"
agggaaaacauggcacgggu

SEQ ID NO: 8097 - RNA, 20 nt, Artificial Sequence
  source: /note="Description of Artificial Sequence: Synthetic oligonucleotide"
caagagggaaaacauggcac

SEQ ID NO: 8098 - RNA, 20 nt, Artificial Sequence
  source: /note="Description of Artificial Sequence: Synthetic oligonucleotide"
gcaagagggaaaacauggca

SEQ ID NO: 8099 - RNA, 20 nt, Artificial Sequence
  source: /note="Description of Artificial Sequence: Synthetic oligonucleotide"
ucauugcaagagggaaaaca

SEQ ID NO: 8100 - RNA, 20 nt, Artificial Sequence
  source: /note="Description of Artificial Sequence: Synthetic oligonucleotide"
ugggguaucucauugcaaga

SEQ ID NO: 8101 - RNA, 20 nt, Artificial Sequence
  source: /note="Description of Artificial Sequence: Synthetic oligonucleotide"
gugggguaucucauugcaag

SEQ ID NO: 8102 - RNA, 20 nt, Artificial Sequence
  source: /note="Description of Artificial Sequence: Synthetic oligonucleotide"
ccauccuucuacacagugug

SEQ ID NO: 8103 - RNA, 20 nt, Artificial Sequence
  source: /note="Description of Artificial Sequence: Synthetic oligonucleotide"
uccauccuucuacacagugu

SEQ ID NO: 8104 - RNA, 20 nt, Artificial Sequence
  source: /note="Description of Artificial Sequence: Synthetic oligonucleotide"
cuccauccuucuacacagug

SEQ ID NO: 8105 - RNA, 20 nt, Artificial Sequence
  source: /note="Description of Artificial Sequence: Synthetic oligonucleotide"
cacacgcaaagagggacagu

SEQ ID NO: 8106 - RNA, 20 nt, Artificial Sequence
  source: /note="Description of Artificial Sequence: Synthetic oligonucleotide"
uuaauaaccacacgcaaaga

SEQ ID NO: 8107 - RNA, 20 nt, Artificial Sequence
  source: /note="Description of Artificial Sequence: Synthetic oligonucleotide"
cuuaauaaccacacgcaaag

SEQ ID NO: 8108 - RNA, 20 nt, Artificial Sequence
  source: /note="Description of Artificial Sequence: Synthetic oligonucleotide"
ugugguguuuuagcccagug

SEQ ID NO: 8109 - RNA, 20 nt, Artificial Sequence
  source: /note="Description of Artificial Sequence: Synthetic oligonucleotide"
aauauuaucuaugagaugug

SEQ ID NO: 8110 - RNA, 20 nt, Artificial Sequence
  source: /note="Description of Artificial Sequence: Synthetic oligonucleotide"
aaaagugggaagauaggggu

SEQ ID NO: 8111 - RNA, 20 nt, Artificial Sequence
  source: /note="Description of Artificial Sequence: Synthetic oligonucleotide"
gaaaagugggaagauagggg

SEQ ID NO: 8112 - RNA, 20 nt, Artificial Sequence
  source: /note="Description of Artificial Sequence: Synthetic oligonucleotide"
auggaaaagugggaagauag

SEQ ID NO: 8113 - RNA, 20 nt, Artificial Sequence
  source: /note="Description of Artificial Sequence: Synthetic oligonucleotide"
gauggaaaagugggaagaua

SEQ ID NO: 8114 - RNA, 20 nt, Artificial Sequence
  source: /note="Description of Artificial Sequence: Synthetic oligonucleotide"
agauggaaaagugggaagau

SEQ ID NO: 8115 - RNA, 20 nt, Artificial Sequence
  source: /note="Description of Artificial Sequence: Synthetic oligonucleotide"
accaacaaagauggaaaagu

SEQ ID NO: 8116 - RNA, 20 nt, Artificial Sequence
  source: /note="Description of Artificial Sequence: Synthetic oligonucleotide"
aaccaacaaagauggaaaag

SEQ ID NO: 8117 - RNA, 20 nt, Artificial Sequence
  source: /note="Description of Artificial Sequence: Synthetic oligonucleotide"
cuguugcaaaccaacaaaga

SEQ ID NO: 8118 - RNA, 20 nt, Artificial Sequence
  source: /note="Description of Artificial Sequence: Synthetic oligonucleotide"
gagagucaggcaaaaagaag

SEQ ID NO: 8119 - RNA, 20 nt, Artificial Sequence
  source: /note="Description of Artificial Sequence: Synthetic oligonucleotide"
ggagagucaggcaaaaagaa

SEQ ID NO: 8120 - RNA, 20 nt, Artificial Sequence
  source: /note="Description of Artificial Sequence: Synthetic oligonucleotide"
uggagagucaggcaaaaaga

SEQ ID NO: 8121 - RNA, 20 nt, Artificial Sequence
  source: /note="Description of Artificial Sequence: Synthetic oligonucleotide"
agagaaaauccuggagaguc

SEQ ID NO: 8122 - RNA, 20 nt, Artificial Sequence
  source: /note="Description of Artificial Sequence: Synthetic oligonucleotide"
uuuaugaugagagaaaaucc

SEQ ID NO: 8123 - RNA, 20 nt, Artificial Sequence
  source: /note="Description of Artificial Sequence: Synthetic oligonucleotide"
uauugcuugguuuauuguca

SEQ ID NO: 8124 - RNA, 20 nt, Artificial Sequence
  source: /note="Description of Artificial Sequence: Synthetic oligonucleotide"
cccacccccagaauauugcu

SEQ ID NO: 8125 - RNA, 20 nt, Artificial Sequence
  source: /note="Description of Artificial Sequence: Synthetic oligonucleotide"
cuggaagccuaccuauuacu

SEQ ID NO: 8126 - RNA, 20 nt, Artificial Sequence
  source: /note="Description of Artificial Sequence: Synthetic oligonucleotide"
aaaaaacauuuaaagcuaac

SEQ ID NO: 8127 - RNA, 20 nt, Artificial Sequence
  source: /note="Description of Artificial Sequence: Synthetic oligonucleotide"
uacaauccaauuuuuugagc

SEQ ID NO: 8128 - RNA, 20 nt, Artificial Sequence
  source: /note="Description of Artificial Sequence: Synthetic oligonucleotide"
cuaaacaaagaauacaguga

SEQ ID NO: 8129 - RNA, 20 nt, Artificial Sequence
  source: /note="Description of Artificial Sequence: Synthetic oligonucleotide"
acuaaacaaagaauacagug

SEQ ID NO: 8130 - RNA, 20 nt, Artificial Sequence
  source: /note="Description of Artificial Sequence: Synthetic oligonucleotide"
auauauuacauuucagauau

SEQ ID NO: 8131 - RNA, 20 nt, Artificial Sequence
  source: /note="Description of Artificial Sequence: Synthetic oligonucleotide"
aauauauuacauuucagaua

SEQ ID NO: 8132 - RNA, 20 nt, Artificial Sequence
  source: /note="Description of Artificial Sequence: Synthetic oligonucleotide"
uauauguacaugcugguugu

SEQ ID NO: 8133 - RNA, 20 nt, Artificial Sequence
  source: /note="Description of Artificial Sequence: Synthetic oligonucleotide"
aauuaaguauauguacaugc

SEQ ID NO: 8134 - RNA, 20 nt, Artificial Sequence
  source: /note="Description of Artificial Sequence: Synthetic oligonucleotide"
cuuuaaaaugaguagauuga

SEQ ID NO: 8135 - RNA, 20 nt, Artificial Sequence
  source: /note="Description of Artificial Sequence: Synthetic oligonucleotide"
aacccccaacuacacauuaa

SEQ ID NO: 8136 - RNA, 20 nt, Artificial Sequence
  source: /note="Description of Artificial Sequence: Synthetic oligonucleotide"
uaacccccaacuacacauua

SEQ ID NO: 8137 - RNA, 20 nt, Artificial Sequence
  source: /note="Description of Artificial Sequence: Synthetic oligonucleotide"
cucaauuauacuaaauauaa

SEQ ID NO: 8138 - RNA, 20 nt, Artificial Sequence
  source: /note="Description of Artificial Sequence: Synthetic oligonucleotide"
aagaaagguaauuaacgcaa

SEQ ID NO: 8139 - RNA, 20 nt, Artificial Sequence
  source: /note="Description of Artificial Sequence: Synthetic oligonucleotide"
gguaauuaacgcaaaggcac

SEQ ID NO: 8140 - RNA, 20 nt, Artificial Sequence
  source: /note="Description of Artificial Sequence: Synthetic oligonucleotide"
guaauuaacgcaaaggcaca

SEQ ID NO: 8141 - RNA, 20 nt, Artificial Sequence
  source: /note="Description of Artificial Sequence: Synthetic oligonucleotide"
uaaauugaguaauuauuagu

SEQ ID NO: 8142 - RNA, 20 nt, Artificial Sequence
  source: /note="Description of Artificial Sequence: Synthetic oligonucleotide"
uuaguaggcuuagcuauucu

SEQ ID NO: 8143 - RNA, 20 nt, Artificial Sequence
  source: /note="Description of Artificial Sequence: Synthetic oligonucleotide"
uaguaggcuuagcuauucua

SEQ ID NO: 8144 - RNA, 20 nt, Artificial Sequence
  source: /note="Description of Artificial Sequence: Synthetic oligonucleotide"
agagagucacaauauuugac

SEQ ID NO: 8145 - RNA, 20 nt, Artificial Sequence
  source: /note="Description of Artificial Sequence: Synthetic oligonucleotide"
aggacuaauagucugcuagc

SEQ ID NO: 8146 - RNA, 20 nt, Artificial Sequence
  source: /note="Description of Artificial Sequence: Synthetic oligonucleotide"
aauagucugcuagcuggcac

SEQ ID NO: 8147 - RNA, 20 nt, Artificial Sequence
  source: /note="Description of Artificial Sequence: Synthetic oligonucleotide"
acaggcugcccacuuugcga

SEQ ID NO: 8148 - RNA, 20 nt, Artificial Sequence
  source: /note="Description of Artificial Sequence: Synthetic oligonucleotide"
cgauggaugccagaaaaccc

SEQ ID NO: 8149 - RNA, 20 nt, Artificial Sequence
  source: /note="Description of Artificial Sequence: Synthetic oligonucleotide"
cagaaaacccaggcaugaac

SEQ ID NO: 8150 - RNA, 20 nt, Artificial Sequence
  source: /note="Description of Artificial Sequence: Synthetic oligonucleotide"
acccaggcaugaacaggaau

SEQ ID NO: 8151 - RNA, 20 nt, Artificial Sequence
  source: /note="Description of Artificial Sequence: Synthetic oligonucleotide"
ugaacaggaaucggccagcc

SEQ ID NO: 8152 - RNA, 20 nt, Artificial Sequence
  source: /note="Description of Artificial Sequence: Synthetic oligonucleotide"
cagccaggcugccagccaca

SEQ ID NO: 8153 - RNA, 20 nt, Artificial Sequence
  source: /note="Description of Artificial Sequence: Synthetic oligonucleotide"
ggcugccagccacaagguac

SEQ ID NO: 8154 - RNA, 20 nt, Artificial Sequence
  source: /note="Description of Artificial Sequence: Synthetic oligonucleotide"
cagccacaagguacuggcac

SEQ ID NO: 8155 - RNA, 20 nt, Artificial Sequence
  source: /note="Description of Artificial Sequence: Synthetic oligonucleotide"
cuggcacaggcuccaacgag

SEQ ID NO: 8156 - RNA, 20 nt, Artificial Sequence
  source: /note="Description of Artificial Sequence: Synthetic oligonucleotide"
uccaacgagaggucccacuc

SEQ ID NO: 8157 - RNA, 20 nt, Artificial Sequence
  source: /note="Description of Artificial Sequence: Synthetic oligonucleotide"
aagugucaaagcagaaagac

SEQ ID NO: 8158 - RNA, 20 nt, Artificial Sequence
  source: /note="Description of Artificial Sequence: Synthetic oligonucleotide"
gcagaaagacugguaaagug

SEQ ID NO: 8159 - RNA, 20 nt, Artificial Sequence
  source: /note="Description of Artificial Sequence: Synthetic oligonucleotide"
uuuuuuucgcuaucaaucac

SEQ ID NO: 8160 - RNA, 20 nt, Artificial Sequence
  source: /note="Description of Artificial Sequence: Synthetic oligonucleotide"
ugagcgagauaaugcagaga

SEQ ID NO: 8161 - RNA, 20 nt, Artificial Sequence
  source: /note="Description of Artificial Sequence: Synthetic oligonucleotide"
cucugagcuguucuucuucu

SEQ ID NO: 8162 - RNA, 20 nt, Artificial Sequence
  source: /note="Description of Artificial Sequence: Synthetic oligonucleotide"
ucugagcuguucuucuucua

SEQ ID NO: 8163 - RNA, 20 nt, Artificial Sequence
  source: /note="Description of Artificial Sequence: Synthetic oligonucleotide"
uagggugccuuuucauuaag

SEQ ID NO: 8164 - RNA, 20 nt, Artificial Sequence
  source: /note="Description of Artificial Sequence: Synthetic oligonucleotide"
gugccuuuucauuaagaggu

SEQ ID NO: 8165 - RNA, 20 nt, Artificial Sequence
  source: /note="Description of Artificial Sequence: Synthetic oligonucleotide"
guauuauuauuaaaguacuu

SEQ ID NO: 8166 - RNA, 20 nt, Artificial Sequence
  source: /note="Description of Artificial Sequence: Synthetic oligonucleotide"
uuaaaguacuuaggauacau

SEQ ID NO: 8167 - RNA, 20 nt, Artificial Sequence
  source: /note="Description of Artificial Sequence: Synthetic oligonucleotide"
uaaaguacuuaggauacauu

SEQ ID NO: 8168 - RNA, 20 nt, Artificial Sequence
  source: /note="Description of Artificial Sequence: Synthetic oligonucleotide"
aaaguacuuaggauacauug

SEQ ID NO: 8169 - RNA, 20 nt, Artificial Sequence
  source: /note="Description of Artificial Sequence: Synthetic oligonucleotide"
uaggauacauuggggcagcu

SEQ ID NO: 8170 - RNA, 20 nt, Artificial Sequence
  source: /note="Description of Artificial Sequence: Synthetic oligonucleotide"
uucacuaaauaaucaucuag

SEQ ID NO: 8171 - RNA, 20 nt, Artificial Sequence
  source: /note="Description of Artificial Sequence: Synthetic oligonucleotide"
uaaauaaucaucuaguggcc

SEQ ID NO: 8172 - RNA, 20 nt, Artificial Sequence
  source: /note="Description of Artificial Sequence: Synthetic oligonucleotide"
uuguuuuuuaaacaagcagu

SEQ ID NO: 8173 - RNA, 20 nt, Artificial Sequence
  source: /note="Description of Artificial Sequence: Synthetic oligonucleotide"
uuuuuuaaacaagcaguagg

SEQ ID NO: 8174 - RNA, 20 nt, Artificial Sequence
  source: /note="Description of Artificial Sequence: Synthetic oligonucleotide"
acaagcaguagguggugcuu

SEQ ID NO: 8175 - RNA, 20 nt, Artificial Sequence
  source: /note="Description of Artificial Sequence: Synthetic oligonucleotide"
uagguggugcuuuggucaua

SEQ ID NO: 8176 - RNA, 20 nt, Artificial Sequence
  source: /note="Description of Artificial Sequence: Synthetic oligonucleotide"
agguggugcuuuggucauaa

SEQ ID NO: 8177 - RNA, 20 nt, Artificial Sequence
  source: /note="Description of Artificial Sequence: Synthetic oligonucleotide"
ggaagauauagucuauuucu

SEQ ID NO: 8178 - RNA, 20 nt, Artificial Sequence
  source: /note="Description of Artificial Sequence: Synthetic oligonucleotide"
acuauuccauauuuuccaug

SEQ ID NO: 8179 - RNA, 20 nt, Artificial Sequence
  source: /note="Description of Artificial Sequence: Synthetic oligonucleotide"
uuccauauuuuccauguggc

SEQ ID NO: 8180 - RNA, 20 nt, Artificial Sequence
  source: /note="Description of Artificial Sequence: Synthetic oligonucleotide"
ucuaaauugugagacauucu

SEQ ID NO: 8181 - RNA, 20 nt, Artificial Sequence
  source: /note="Description of Artificial Sequence: Synthetic oligonucleotide"
aaauugugagacauucuugg

SEQ ID NO: 8182 - RNA, 20 nt, Artificial Sequence
  source: /note="Description of Artificial Sequence: Synthetic oligonucleotide"
uaaaauagcuaaauuuagua

SEQ ID NO: 8183 - RNA, 20 nt, Artificial Sequence
  source: /note="Description of Artificial Sequence: Synthetic oligonucleotide"
aaaauagcuaaauuuaguaa

SEQ ID NO: 8184 - RNA, 20 nt, Artificial Sequence
  source: /note="Description of Artificial Sequence: Synthetic oligonucleotide"
aucuguacauuuugauauug

SEQ ID NO: 8185 - RNA, 20 nt, Artificial Sequence
  source: /note="Description of Artificial Sequence: Synthetic oligonucleotide"
uuugauauugaggaaaaaca

SEQ ID NO: 8186 - RNA, 20 nt, Artificial Sequence
  source: /note="Description of Artificial Sequence: Synthetic oligonucleotide"
aaaccauuauccaguuugcu

SEQ ID NO: 8187 - RNA, 20 nt, Artificial Sequence
  source: /note="Description of Artificial Sequence: Synthetic oligonucleotide"
uaauaaaccguucauuucuc

SEQ ID NO: 8188 - RNA, 20 nt, Artificial Sequence
  source: /note="Description of Artificial Sequence: Synthetic oligonucleotide"
accguucauuucucaggaug

SEQ ID NO: 8189 - RNA, 20 nt, Artificial Sequence
  source: /note="Description of Artificial Sequence: Synthetic oligonucleotide"
aaaauucugacauauacaaa

SEQ ID NO: 8190 - RNA, 20 nt, Artificial Sequence
  source: /note="Description of Artificial Sequence: Synthetic oligonucleotide"
acugcuuugugugugaaggc

SEQ ID NO: 8191 - RNA, 20 nt, Artificial Sequence
  source: /note="Description of Artificial Sequence: Synthetic oligonucleotide"
guuuacugcuuuguguguga

SEQ ID NO: 8192 - RNA, 20 nt, Artificial Sequence
  source: /note="Description of Artificial Sequence: Synthetic oligonucleotide"
aauagcacaguguguagugu

SEQ ID NO: 8193 - RNA, 20 nt, Artificial Sequence
  source: /note="Description of Artificial Sequence: Synthetic oligonucleotide"
ugucaaauauugugacucuc

SEQ ID NO: 8194 - RNA, 20 nt, Artificial Sequence
  source: /note="Description of Artificial Sequence: Synthetic oligonucleotide"
ucuggcauccaucgcaaagu

SEQ ID NO: 8195 - RNA, 20 nt, Artificial Sequence
  source: /note="Description of Artificial Sequence: Synthetic oligonucleotide"
uucuggcauccaucgcaaag

SEQ ID NO: 8196 - RNA, 20 nt, Artificial Sequence
  source: /note="Description of Artificial Sequence: Synthetic oligonucleotide"
cuguucaugccuggguuuuc

SEQ ID NO: 8197 - RNA, 20 nt, Artificial Sequence
  source: /note="Description of Artificial Sequence: Synthetic oligonucleotide"
gccgauuccuguucaugccu

SEQ ID NO: 8198 - RNA, 20 nt, Artificial Sequence
  source: /note="Description of Artificial Sequence: Synthetic oligonucleotide"
ggccgauuccuguucaugcc

SEQ ID NO: 8199 - RNA, 20 nt, Artificial Sequence
  source: /note="Description of Artificial Sequence: Synthetic oligonucleotide"
cuuguggcuggcagccuggc

SEQ ID NO: 8200 - RNA, 20 nt, Artificial Sequence
  source: /note="Description of Artificial Sequence: Synthetic oligonucleotide"
guaccuuguggcuggcagcc

SEQ ID NO: 8201 - RNA, 20 nt, Artificial Sequence
  source: /note="Description of Artificial Sequence: Synthetic oligonucleotide"
cugugccaguaccuuguggc

SEQ ID NO: 8202 - RNA, 20 nt, Artificial Sequence
  source: /note="Description of Artificial Sequence: Synthetic oligonucleotide"
gagccugugccaguaccuug

SEQ ID NO: 8203 - RNA, 20 nt, Artificial Sequence
  source: /note="Description of Artificial Sequence: Synthetic oligonucleotide"
gccagagugggaccucucgu

SEQ ID NO: 8204 - RNA, 20 nt, Artificial Sequence
  source: /note="Description of Artificial Sequence: Synthetic oligonucleotide"
ucaggugggaaagccagagu

SEQ ID NO: 8205 - RNA, 20 nt, Artificial Sequence
  source: /note="Description of Artificial Sequence: Synthetic oligonucleotide"
aucaggugggaaagccagag

SEQ ID NO: 8206 - RNA, 20 nt, Artificial Sequence
  source: /note="Description of Artificial Sequence: Synthetic oligonucleotide"
uugacacuuuauuaucaggu

SEQ ID NO: 8207 - RNA, 20 nt, Artificial Sequence
  source: /note="Description of Artificial Sequence: Synthetic oligonucleotide"
uuugacacuuuauuaucagg

SEQ ID NO: 8208 - RNA, 20 nt, Artificial Sequence
  source: /note="Description of Artificial Sequence: Synthetic oligonucleotide"
ugcuuugacacuuuauuauc

SEQ ID NO: 8209 - RNA, 20 nt, Artificial Sequence
  source: /note="Description of Artificial Sequence: Synthetic oligonucleotide"
acuaggugaauuuaauucag

SEQ ID NO: 8210 - RNA, 20 nt, Artificial Sequence
  source: /note="Description of Artificial Sequence: Synthetic oligonucleotide"
aaguacucauuugcaacacu

SEQ ID NO: 8211 - RNA, 20 nt, Artificial Sequence
  source: /note="Description of Artificial Sequence: Synthetic oligonucleotide"
ucacacuugcucucuuuuua

SEQ ID NO: 8212 - RNA, 20 nt, Artificial Sequence
  source: /note="Description of Artificial Sequence: Synthetic oligonucleotide"
auagcgaaaaaaaaaaaaaa

SEQ ID NO: 8213 - RNA, 20 nt, Artificial Sequence
  source: /note="Description of Artificial Sequence: Synthetic oligonucleotide"
ucuucuacaugcaggaguaa

SEQ ID NO: 8214 - RNA, 20 nt, Artificial Sequence
  source: /note="Description of Artificial Sequence: Synthetic oligonucleotide"
cauaagagucuucuacaugc

SEQ ID NO: 8215 - RNA, 20 nt, Artificial Sequence
  source: /note="Description of Artificial Sequence: Synthetic oligonucleotide"
gcuguauaaauuuauaugaa

SEQ ID NO: 8216 - RNA, 20 nt, Artificial Sequence
  source: /note="Description of Artificial Sequence: Synthetic oligonucleotide"
cugccuaccucuuaaugaaa

SEQ ID NO: 8217 - RNA, 20 nt, Artificial Sequence
  source: /note="Description of Artificial Sequence: Synthetic oligonucleotide"
agaaaugaauaauuuggaaa

SEQ ID NO: 8218 - RNA, 20 nt, Artificial Sequence
  source: /note="Description of Artificial Sequence: Synthetic oligonucleotide"
uaauuuagaaaugaauaauu

SEQ ID NO: 8219 - RNA, 20 nt, Artificial Sequence
  source: /note="Description of Artificial Sequence: Synthetic oligonucleotide"
ggaaauucacuauuucugcc

SEQ ID NO: 8220 - RNA, 20 nt, Artificial Sequence
  source: /note="Description of Artificial Sequence: Synthetic oligonucleotide"
guuguuuuuuuuggcacuua

SEQ ID NO: 8221 - RNA, 20 nt, Artificial Sequence
  source: /note="Description of Artificial Sequence: Synthetic oligonucleotide"
uguuguuuuuuuuggcacuu

SEQ ID NO: 8222 - RNA, 20 nt, Artificial Sequence
  source: /note="Description of Artificial Sequence: Synthetic oligonucleotide"
uguuuuuuuguuguuuuuuu

SEQ ID NO: 8223 - RNA, 20 nt, Artificial Sequence
  source: /note="Description of Artificial Sequence: Synthetic oligonucleotide"
auccagccacauggaaaaua

SEQ ID NO: 8224 - RNA, 20 nt, Artificial Sequence
  source: /note="Description of Artificial Sequence: Synthetic oligonucleotide"
auaguuaguauccagccaca

SEQ ID NO: 8225 - RNA, 20 nt, Artificial Sequence
  source: /note="Description of Artificial Sequence: Synthetic oligonucleotide"
cacaauuuagaaaaggaggc

SEQ ID NO: 8226 - RNA, 20 nt, Artificial Sequence
  source: /note="Description of Artificial Sequence: Synthetic oligonucleotide"
gucucacaauuuagaaaagg

SEQ ID NO: 8227 - RNA, 20 nt, Artificial Sequence
  source: /note="Description of Artificial Sequence: Synthetic oligonucleotide"
aaugucucacaauuuagaaa

SEQ ID NO: 8228 - RNA, 20 nt, Artificial Sequence
  source: /note="Description of Artificial Sequence: Synthetic oligonucleotide"
uuuagcuauuuuaaaacuug

SEQ ID NO: 8229 - RNA, 20 nt, Artificial Sequence
  source: /note="Description of Artificial Sequence: Synthetic oligonucleotide"
auuuagcuauuuuaaaacuu

SEQ ID NO: 8230 - RNA, 20 nt, Artificial Sequence
  source: /note="Description of Artificial Sequence: Synthetic oligonucleotide"
aauuuagcuauuuuaaaacu

SEQ ID NO: 8231 - RNA, 20 nt, Artificial Sequence
  source: /note="Description of Artificial Sequence: Synthetic oligonucleotide"
uuucacaaagcacaaaauuc

SEQ ID NO: 8232 - RNA, 20 nt, Artificial Sequence
  source: /note="Description of Artificial Sequence: Synthetic oligonucleotide"
aauuacaugugggugaaaau

SEQ ID NO: 8233 - RNA, 20 nt, Artificial Sequence
  source: /note="Description of Artificial Sequence: Synthetic oligonucleotide"
aaauuacaugugggugaaaa

SEQ ID NO: 8234 - RNA, 20 nt, Artificial Sequence
  source: /note="Description of Artificial Sequence: Synthetic oligonucleotide"
cuauuuuguaaauuacaugu

SEQ ID NO: 8235 - RNA, 20 nt, Artificial Sequence
  source: /note="Description of Artificial Sequence: Synthetic oligonucleotide"
acuauuuuguaaauuacaug

SEQ ID NO: 8236 - RNA, 20 nt, Artificial Sequence
  source: /note="Description of Artificial Sequence: Synthetic oligonucleotide"
acgccaagcaaacuggauaa

SEQ ID NO: 8237 - RNA, 20 nt, Artificial Sequence
  source: /note="Description of Artificial Sequence: Synthetic oligonucleotide"
caggucuacgccaagcaaac

SEQ ID NO: 8238 - RNA, 20 nt, Artificial Sequence
  source: /note="Description of Artificial Sequence: Synthetic oligonucleotide"
cgguuuauuauuuuuuaaac

SEQ ID NO: 8239 - RNA, 20 nt, Artificial Sequence
  source: /note="Description of Artificial Sequence: Synthetic oligonucleotide"
accacauccugagaaaugaa

SEQ ID NO: 8240 - RNA, 20 nt, Artificial Sequence
  source: /note="Description of Artificial Sequence: Synthetic oligonucleotide"
aauuagcaaaugaauucaag

SEQ ID NO: 8241 - RNA, 20 nt, Artificial Sequence
  source: /note="Description of Artificial Sequence: Synthetic oligonucleotide"
gugugacuugauaaagccuu

SEQ ID NO: 8242 - RNA, 20 nt, Artificial Sequence
  source: /note="Description of Artificial Sequence: Synthetic oligonucleotide"
aagccuuuggucuuaaaucu

SEQ ID NO: 8243 - RNA, 20 nt, Artificial Sequence
  source: /note="Description of Artificial Sequence: Synthetic oligonucleotide"
agccuuuggucuuaaaucuu

SEQ ID NO: 8244 - RNA, 20 nt, Artificial Sequence
  source: /note="Description of Artificial Sequence: Synthetic oligonucleotide"
guaaaucugacccugagaau

SEQ ID NO: 8245 - RNA, 20 nt, Artificial Sequence
  source: /note="Description of Artificial Sequence: Synthetic oligonucleotide"
uaaaucugacccugagaauu

SEQ ID NO: 8246 - RNA, 20 nt, Artificial Sequence
  source: /note="Description of Artificial Sequence: Synthetic oligonucleotide"
auguguuaucucuuaagaag

SEQ ID NO: 8247 - RNA, 20 nt, Artificial Sequence
  source: /note="Description of Artificial Sequence: Synthetic oligonucleotide"
auugaaauaauuuagugaug

SEQ ID NO: 8248 - RNA, 20 nt, Artificial Sequence
  source: /note="Description of Artificial Sequence: Synthetic oligonucleotide"
auaauuuagugaugaggaag

SEQ ID NO: 8249 - RNA, 20 nt, Artificial Sequence
  source: /note="Description of Artificial Sequence: Synthetic oligonucleotide"
auguaucuuucaucuagcuc

SEQ ID NO: 8250 - RNA, 20 nt, Artificial Sequence
  source: /note="Description of Artificial Sequence: Synthetic oligonucleotide"
ucuagcucugguuuuaaugc

SEQ ID NO: 8251 - RNA, 20 nt, Artificial Sequence
  source: /note="Description of Artificial Sequence: Synthetic oligonucleotide"
uuuaauuguccccacuguac

SEQ ID NO: 8252 - RNA, 20 nt, Artificial Sequence
  source: /note="Description of Artificial Sequence: Synthetic oligonucleotide"
uuaauuguccccacuguacu

SEQ ID NO: 8253 - RNA, 20 nt, Artificial Sequence
  source: /note="Description of Artificial Sequence: Synthetic oligonucleotide"
guauagucugcuaaacauua

SEQ ID NO: 8254 - RNA, 20 nt, Artificial Sequence
  source: /note="Description of Artificial Sequence: Synthetic oligonucleotide"
ucucuccuuguucugauacu

SEQ ID NO: 8255 - RNA, 20 nt, Artificial Sequence
  source: /note="Description of Artificial Sequence: Synthetic oligonucleotide"
cucuccuuguucugauacua

SEQ ID NO: 8256 - RNA, 20 nt, Artificial Sequence
  source: /note="Description of Artificial Sequence: Synthetic oligonucleotide"
caaagcccacuuuuuauaga

SEQ ID NO: 8257 - RNA, 20 nt, Artificial Sequence
  source: /note="Description of Artificial Sequence: Synthetic oligonucleotide"
aaagcccacuuuuuauagau

SEQ ID NO: 8258 - RNA, 20 nt, Artificial Sequence
  source: /note="Description of Artificial Sequence: Synthetic oligonucleotide"
uuuuauagaugggcagcaaa

SEQ ID NO: 8259 - RNA, 20 nt, Artificial Sequence
  source: /note="Description of Artificial Sequence: Synthetic oligonucleotide"
augggcagcaaaaggcacau

SEQ ID NO: 8260 - RNA, 20 nt, Artificial Sequence
  source: /note="Description of Artificial Sequence: Synthetic oligonucleotide"
aagugacccuuguuuuguuu

SEQ ID NO: 8261 - RNA, 20 nt, Artificial Sequence
  source: /note="Description of Artificial Sequence: Synthetic oligonucleotide"
gacccuuguuuuguuuuggu

SEQ ID NO: 8262 - RNA, 20 nt, Artificial Sequence
  source: /note="Description of Artificial Sequence: Synthetic oligonucleotide"
acccuuguuuuguuuugguu

SEQ ID NO: 8263 - RNA, 20 nt, Artificial Sequence
  source: /note="Description of Artificial Sequence: Synthetic oligonucleotide"
cccuuguuuuguuuugguug

SEQ ID NO: 8264 - RNA, 20 nt, Artificial Sequence
  source: /note="Description of Artificial Sequence: Synthetic oligonucleotide"
uuguuuuguuuugguugggg

SEQ ID NO: 8265 - RNA, 20 nt, Artificial Sequence
  source: /note="Description of Artificial Sequence: Synthetic oligonucleotide"
uguuuuguuuugguuggggu

SEQ ID NO: 8266 - RNA, 20 nt, Artificial Sequence
  source: /note="Description of Artificial Sequence: Synthetic oligonucleotide"
guuuuguuuugguuggggug

SEQ ID NO: 8267 - RNA, 20 nt, Artificial Sequence
  source: /note="Description of Artificial Sequence: Synthetic oligonucleotide"
uuuuguuuugguuggggugg

SEQ ID NO: 8268 - RNA, 20 nt, Artificial Sequence
  source: /note="Description of Artificial Sequence: Synthetic oligonucleotide"
uuuguuuugguugggguggg

SEQ ID NO: 8269 - RNA, 20 nt, Artificial Sequence
  source: /note="Description of Artificial Sequence: Synthetic oligonucleotide"
ugguuggggugggggguguu

SEQ ID NO: 8270 - RNA, 20 nt, Artificial Sequence
  source: /note="Description of Artificial Sequence: Synthetic oligonucleotide"
gguuggggugggggguguuu

SEQ ID NO: 8271 - RNA, 20 nt, Artificial Sequence
  source: /note="Description of Artificial Sequence: Synthetic oligonucleotide"
ggggugggggguguuuggga

SEQ ID NO: 8272 - RNA, 20 nt, Artificial Sequence
  source: /note="Description of Artificial Sequence: Synthetic oligonucleotide"
acacuuacccacuuagcaau

SEQ ID NO: 8273 - RNA, 20 nt, Artificial Sequence
  source: /note="Description of Artificial Sequence: Synthetic oligonucleotide"
ugcccaagauuuaagaccaa

SEQ ID NO: 8274 - RNA, 20 nt, Artificial Sequence
  source: /note="Description of Artificial Sequence: Synthetic oligonucleotide"
ucuggguaacccaauucuca

SEQ ID NO: 8275 - RNA, 20 nt, Artificial Sequence
  source: /note="Description of Artificial Sequence: Synthetic oligonucleotide"
aucuggguaacccaauucuc

SEQ ID NO: 8276 - RNA, 20 nt, Artificial Sequence
  source: /note="Description of Artificial Sequence: Synthetic oligonucleotide"
cuggcaugagucuuugaucu

SEQ ID NO: 8277 - RNA, 20 nt, Artificial Sequence
  source: /note="Description of Artificial Sequence: Synthetic oligonucleotide"
acuggcaugagucuuugauc

SEQ ID NO: 8278 - RNA, 20 nt, Artificial Sequence
  source: /note="Description of Artificial Sequence: Synthetic oligonucleotide"
cagguaauguucuuuuuaac

SEQ ID NO: 8279 - RNA, 20 nt, Artificial Sequence
  source: /note="Description of Artificial Sequence: Synthetic oligonucleotide"
uaacacaugauaaaaaauac

SEQ ID NO: 8280 - RNA, 20 nt, Artificial Sequence
  source: /note="Description of Artificial Sequence: Synthetic oligonucleotide"
acauuuagcaggcacuagaa

SEQ ID NO: 8281 - RNA, 20 nt, Artificial Sequence
  source: /note="Description of Artificial Sequence: Synthetic oligonucleotide"
agaaggauuauacauuuagc

SEQ ID NO: 8282 - RNA, 20 nt, Artificial Sequence
  source: /note="Description of Artificial Sequence: Synthetic oligonucleotide"
gacaacuucacauucuaaga

SEQ ID NO: 8283 - RNA, 20 nt, Artificial Sequence
  source: /note="Description of Artificial Sequence: Synthetic oligonucleotide"
ugaagguauuuaaaaguuua

SEQ ID NO: 8284 - RNA, 20 nt, Artificial Sequence
  source: /note="Description of Artificial Sequence: Synthetic oligonucleotide"
acaauauaaagauuaacuga

SEQ ID NO: 8285 - RNA, 20 nt, Artificial Sequence
  source: /note="Description of Artificial Sequence: Synthetic oligonucleotide"
gauacauaagucuuaguuca

SEQ ID NO: 8286 - RNA, 20 nt, Artificial Sequence
  source: /note="Description of Artificial Sequence: Synthetic oligonucleotide"
agacuauacccaguacagug

SEQ ID NO: 8287 - RNA, 20 nt, Artificial Sequence
  source: /note="Description of Artificial Sequence: Synthetic oligonucleotide"
cagacuauacccaguacagu

SEQ ID NO: 8288 - RNA, 20 nt, Artificial Sequence
  source: /note="Description of Artificial Sequence: Synthetic oligonucleotide"
gcagacuauacccaguacag

SEQ ID NO: 8289 - RNA, 20 nt, Artificial Sequence
  source: /note="Description of Artificial Sequence: Synthetic oligonucleotide"
uugacccuaguaucagaaca

SEQ ID NO: 8290 - RNA, 20 nt, Artificial Sequence
  source: /note="Description of Artificial Sequence: Synthetic oligonucleotide"
gcugcccaucuauaaaaagu

SEQ ID NO: 8291 - RNA, 20 nt, Artificial Sequence
  source: /note="Description of Artificial Sequence: Synthetic oligonucleotide"
ugcugcccaucuauaaaaag

SEQ ID NO: 8292 - RNA, 20 nt, Artificial Sequence
  source: /note="Description of Artificial Sequence: Synthetic oligonucleotide"
ucauguuuagaucacaauua

SEQ ID NO: 8293 - RNA, 20 nt, Artificial Sequence
  source: /note="Description of Artificial Sequence: Synthetic oligonucleotide"
aucauguuuagaucacaauu

SEQ ID NO: 8294 - RNA, 20 nt, Artificial Sequence
  source: /note="Description of Artificial Sequence: Synthetic oligonucleotide"
gggucacuugcagcagauaa

SEQ ID NO: 8295 - RNA, 20 nt, Artificial Sequence
  source: /note="Description of Artificial Sequence: Synthetic oligonucleotide"
agggucacuugcagcagaua

SEQ ID NO: 8296 - RNA, 20 nt, Artificial Sequence
  source: /note="Description of Artificial Sequence: Synthetic oligonucleotide"
ccccaaccaaaacaaaacaa

SEQ ID NO: 8297 - RNA, 20 nt, Artificial Sequence
  source: /note="Description of Artificial Sequence: Synthetic oligonucleotide"
accccaaccaaaacaaaaca

SEQ ID NO: 8298 - RNA, 20 nt, Artificial Sequence
  source: /note="Description of Artificial Sequence: Synthetic oligonucleotide"
augaagaguaagugaagccc

SEQ ID NO: 8299 - RNA, 20 nt, Artificial Sequence
  source: /note="Description of Artificial Sequence: Synthetic oligonucleotide"
ugaagaguaagugaagccca

SEQ ID NO: 8300 - RNA, 20 nt, Artificial Sequence
  source: /note="Description of Artificial Sequence: Synthetic oligonucleotide"
cagggccucuccccucuuug

SEQ ID NO: 8301 - RNA, 20 nt, Artificial Sequence
  source: /note="Description of Artificial Sequence: Synthetic oligonucleotide"
cccucuuugcggccacugau

SEQ ID NO: 8302 - RNA, 20 nt, Artificial Sequence
  source: /note="Description of Artificial Sequence: Synthetic oligonucleotide"
ugauaggaaagcccaaucuu

SEQ ID NO: 8303 - RNA, 20 nt, Artificial Sequence
  source: /note="Description of Artificial Sequence: Synthetic oligonucleotide"
aagcccaaucuuugguugaa

SEQ ID NO: 8304 - RNA, 20 nt, Artificial Sequence
  source: /note="Description of Artificial Sequence: Synthetic oligonucleotide"
gcacuuuuacauuuauaaaa

SEQ ID NO: 8305 - RNA, 20 nt, Artificial Sequence
  source: /note="Description of Artificial Sequence: Synthetic oligonucleotide"
cacuuuuacauuuauaaaau

SEQ ID NO: 8306 - RNA, 20 nt, Artificial Sequence
  source: /note="Description of Artificial Sequence: Synthetic oligonucleotide"
ugggcaucaaaaugccuguu

SEQ ID NO: 8307 - RNA, 20 nt, Artificial Sequence
  source: /note="Description of Artificial Sequence: Synthetic oligonucleotide"
guacaguuuagccauuaauu

SEQ ID NO: 8308 - RNA, 20 nt, Artificial Sequence
  source: /note="Description of Artificial Sequence: Synthetic oligonucleotide"
ucagagugucuguaaccaca

SEQ ID NO: 8309 - RNA, 20 nt, Artificial Sequence
  source: /note="Description of Artificial Sequence: Synthetic oligonucleotide"
ugcucacaugcuacaaguga

SEQ ID NO: 8310 - RNA, 20 nt, Artificial Sequence
  source: /note="Description of Artificial Sequence: Synthetic oligonucleotide"
agugacggcuccugugugcc

SEQ ID NO: 8311 - RNA, 20 nt, Artificial Sequence
  source: /note="Description of Artificial Sequence: Synthetic oligonucleotide"
guaagucuaaugagaaacuu

SEQ ID NO: 8312 - RNA, 20 nt, Artificial Sequence
  source: /note="Description of Artificial Sequence: Synthetic oligonucleotide"
uaagucuaaugagaaacuuu

SEQ ID NO: 8313 - RNA, 20 nt, Artificial Sequence
  source: /note="Description of Artificial Sequence: Synthetic oligonucleotide"
ugagaaacuuugggauuccc

SEQ ID NO: 8314 - RNA, 20 nt, Artificial Sequence
  source: /note="Description of Artificial Sequence: Synthetic oligonucleotide"
cuaaaugaucagcaaauuac

SEQ ID NO: 8315 - RNA, 20 nt, Artificial Sequence
  source: /note="Description of Artificial Sequence: Synthetic oligonucleotide"
gaucagcaaauuacuggaua

SEQ ID NO: 8316 - RNA, 20 nt, Artificial Sequence
  source: /note="Description of Artificial Sequence: Synthetic oligonucleotide"
auggauauauauuauuuucc

SEQ ID NO: 8317 - RNA, 20 nt, Artificial Sequence
  source: /note="Description of Artificial Sequence: Synthetic oligonucleotide"
augaagucuaaaccuucagu

SEQ ID NO: 8318 - RNA, 20 nt, Artificial Sequence
  source: /note="Description of Artificial Sequence: Synthetic oligonucleotide"
aaagaauagaugaauguuca

SEQ ID NO: 8319 - RNA, 20 nt, Artificial Sequence
  source: /note="Description of Artificial Sequence: Synthetic oligonucleotide"
uuuuuuuuuuuuuuuugaga

SEQ ID NO: 8320 - RNA, 20 nt, Artificial Sequence
  source: /note="Description of Artificial Sequence: Synthetic oligonucleotide"
gaguuucgcucuuguugccc

SEQ ID NO: 8321 - RNA, 20 nt, Artificial Sequence
  source: /note="Description of Artificial Sequence: Synthetic oligonucleotide"
uucgcucuuguugcccaggc

SEQ ID NO: 8322 - RNA, 20 nt, Artificial Sequence
  source: /note="Description of Artificial Sequence: Synthetic oligonucleotide"
uugcccaggcuggagugcaa

SEQ ID NO: 8323 - RNA, 20 nt, Artificial Sequence
  source: /note="Description of Artificial Sequence: Synthetic oligonucleotide"
ggagugcaauggcgcgaucu

SEQ ID NO: 8324 - RNA, 20 nt, Artificial Sequence
  source: /note="Description of Artificial Sequence: Synthetic oligonucleotide"
caccgcgaccuccaccuccc

SEQ ID NO: 8325 - RNA, 20 nt, Artificial Sequence
  source: /note="Description of Artificial Sequence: Synthetic oligonucleotide"
gccucagccucccuaguagc

SEQ ID NO: 8326 - RNA, 20 nt, Artificial Sequence
  source: /note="Description of Artificial Sequence: Synthetic oligonucleotide"
ccucagccucccuaguagcu

SEQ ID NO: 8327 - RNA, 20 nt, Artificial Sequence
  source: /note="Description of Artificial Sequence: Synthetic oligonucleotide"
ucccuaguagcugggauuac

SEQ ID NO: 8328 - RNA, 20 nt, Artificial Sequence
  source: /note="Description of Artificial Sequence: Synthetic oligonucleotide"
caggcaugugccaccacacc

SEQ ID NO: 8329 - RNA, 20 nt, Artificial Sequence
  source: /note="Description of Artificial Sequence: Synthetic oligonucleotide"
uuuguauuuuuaguagagac

SEQ ID NO: 8330 - RNA, 20 nt, Artificial Sequence
  source: /note="Description of Artificial Sequence: Synthetic oligonucleotide"
uuguauuuuuaguagagaca

SEQ ID NO: 8331 - RNA, 20 nt, Artificial Sequence
  source: /note="Description of Artificial Sequence: Synthetic oligonucleotide"
gagacaggguuucuccaugu

SEQ ID NO: 8332 - RNA, 20 nt, Artificial Sequence
  source: /note="Description of Artificial Sequence: Synthetic oligonucleotide"
aggguuucuccauguugguc

SEQ ID NO: 8333 - RNA, 20 nt, Artificial Sequence
  source: /note="Description of Artificial Sequence: Synthetic oligonucleotide"
uuucuccauguuggucaggc

SEQ ID NO: 8334 - RNA, 20 nt, Artificial Sequence
  source: /note="Description of Artificial Sequence: Synthetic oligonucleotide"
ggucucgaacucccgaccuc

SEQ ID NO: 8335 - RNA, 20 nt, Artificial Sequence
  source: /note="Description of Artificial Sequence: Synthetic oligonucleotide"
ccucaggugauugcccaccu

SEQ ID NO: 8336 - RNA, 20 nt, Artificial Sequence
  source: /note="Description of Artificial Sequence: Synthetic oligonucleotide"
ggccucccaaagugccuuac

SEQ ID NO: 8337 - RNA, 20 nt, Artificial Sequence
  source: /note="Description of Artificial Sequence: Synthetic oligonucleotide"
caggcaugagccgccgcgcc

SEQ ID NO: 8338 - RNA, 20 nt, Artificial Sequence
  source: /note="Description of Artificial Sequence: Synthetic oligonucleotide"
caaguuauuuugcccacgau

SEQ ID NO: 8339 - RNA, 20 nt, Artificial Sequence
  source: /note="Description of Artificial Sequence: Synthetic oligonucleotide"
guuuaaaacucuaacuagca

SEQ ID NO: 8340 - RNA, 20 nt, Artificial Sequence
  source: /note="Description of Artificial Sequence: Synthetic oligonucleotide"
guuaacacaguuucucucuc

SEQ ID NO: 8341 - RNA, 20 nt, Artificial Sequence
  source: /note="Description of Artificial Sequence: Synthetic oligonucleotide"
uuaacacaguuucucucucu

SEQ ID NO: 8342 - RNA, 20 nt, Artificial Sequence
  source: /note="Description of Artificial Sequence: Synthetic oligonucleotide"
caguuucucucucuggguug

SEQ ID NO: 8343 - RNA, 20 nt, Artificial Sequence
  source: /note="Description of Artificial Sequence: Synthetic oligonucleotide"
aguuucucucucuggguugu

SEQ ID NO: 8344 - RNA, 20 nt, Artificial Sequence
  source: /note="Description of Artificial Sequence: Synthetic oligonucleotide"
guuucucucucuggguugug

SEQ ID NO: 8345 - RNA, 20 nt, Artificial Sequence
  source: /note="Description of Artificial Sequence: Synthetic oligonucleotide"
auuaugauccaaaaauuuua

SEQ ID NO: 8346 - RNA, 20 nt, Artificial Sequence
  source: /note="Description of Artificial Sequence: Synthetic oligonucleotide"
cacuuuuacaaaugauuaau

SEQ ID NO: 8347 - RNA, 20 nt, Artificial Sequence
  source: /note="Description of Artificial Sequence: Synthetic oligonucleotide"
uuuacaaaugauuaauugga

SEQ ID NO: 8348 - RNA, 20 nt, Artificial Sequence
  source: /note="Description of Artificial Sequence: Synthetic oligonucleotide"
uguaacuuauaaacuuauga

SEQ ID NO: 8349 - RNA, 20 nt, Artificial Sequence
  source: /note="Description of Artificial Sequence: Synthetic oligonucleotide"
agaguuucacucugucaccc

SEQ ID NO: 8350 - RNA, 20 nt, Artificial Sequence
  source: /note="Description of Artificial Sequence: Synthetic oligonucleotide"
uuucacucugucacccaggc

SEQ ID NO: 8351 - RNA, 20 nt, Artificial Sequence
  source: /note="Description of Artificial Sequence: Synthetic oligonucleotide"
ucacccaggcuggagugcaa

SEQ ID NO: 8352 - RNA, 20 nt, Artificial Sequence
  source: /note="Description of Artificial Sequence: Synthetic oligonucleotide"
ggagugcaauggugcgaucu

SEQ ID NO: 8353 - RNA, 20 nt, Artificial Sequence
  source: /note="Description of Artificial Sequence: Synthetic oligonucleotide"
ucacugcaaccuccaucucc

SEQ ID NO: 8354 - RNA, 20 nt, Artificial Sequence
  source: /note="Description of Artificial Sequence: Synthetic oligonucleotide"
cacugcaaccuccaucuccu

SEQ ID NO: 8355 - RNA, 20 nt, Artificial Sequence
  source: /note="Description of Artificial Sequence: Synthetic oligonucleotide"
gccucagccucccgaauagc

SEQ ID NO: 8356 - RNA, 20 nt, Artificial Sequence
  source: /note="Description of Artificial Sequence: Synthetic oligonucleotide"
ccucagccucccgaauagcu

SEQ ID NO: 8357 - RNA, 20 nt, Artificial Sequence
  source: /note="Description of Artificial Sequence: Synthetic oligonucleotide"
ucccgaauagcugggauuac

SEQ ID NO: 8358 - RNA, 20 nt, Artificial Sequence
  source: /note="Description of Artificial Sequence: Synthetic oligonucleotide"
uuuguauuuuuaguagagac

SEQ ID NO: 8359 - RNA, 20 nt, Artificial Sequence
  source: /note="Description of Artificial Sequence: Synthetic oligonucleotide"
uuguauuuuuaguagagaca

SEQ ID NO: 8360 - RNA, 20 nt, Artificial Sequence
  source: /note="Description of Artificial Sequence: Synthetic oligonucleotide"
aggguuucuccauguugauc

SEQ ID NO: 8361 - RNA, 20 nt, Artificial Sequence
  source: /note="Description of Artificial Sequence: Synthetic oligonucleotide"
uuucuccauguugaucaggc

SEQ ID NO: 8362 - RNA, 20 nt, Artificial Sequence
  source: /note="Description of Artificial Sequence: Synthetic oligonucleotide"
ccauguugaucaggcugguc

SEQ ID NO: 8363 - RNA, 20 nt, Artificial Sequence
  source: /note="Description of Artificial Sequence: Synthetic oligonucleotide"
uggucuggaacuccugaccu

SEQ ID NO: 8364 - RNA, 20 nt, Artificial Sequence
  source: /note="Description of Artificial Sequence: Synthetic oligonucleotide"
ggucuggaacuccugaccuc

SEQ ID NO: 8365 - RNA, 20 nt, Artificial Sequence
  source: /note="Description of Artificial Sequence: Synthetic oligonucleotide"
cucgggugauccgcccgccu

SEQ ID NO: 8366 - RNA, 20 nt, Artificial Sequence
  source: /note="Description of Artificial Sequence: Synthetic oligonucleotide"
gccucggccucccagagugc

SEQ ID NO: 8367 - RNA, 20 nt, Artificial Sequence
  source: /note="Description of Artificial Sequence: Synthetic oligonucleotide"
ccucggccucccagagugcu

SEQ ID NO: 8368 - RNA, 20 nt, Artificial Sequence
  source: /note="Description of Artificial Sequence: Synthetic oligonucleotide"
ucccagagugcugggauuac

SEQ ID NO: 8369 - RNA, 20 nt, Artificial Sequence
  source: /note="Description of Artificial Sequence: Synthetic oligonucleotide"
aaauuuuuaaaaauguaugu

SEQ ID NO: 8370 - RNA, 20 nt, Artificial Sequence
  source: /note="Description of Artificial Sequence: Synthetic oligonucleotide"
agaaaaaaaauuaaaaauua

SEQ ID NO: 8371 - RNA, 20 nt, Artificial Sequence
  source: /note="Description of Artificial Sequence: Synthetic oligonucleotide"
aaggcaacuugugcucauau

SEQ ID NO: 8372 - RNA, 20 nt, Artificial Sequence
  source: /note="Description of Artificial Sequence: Synthetic oligonucleotide"
auaauaucucuuagacuuga

SEQ ID NO: 8373 - RNA, 20 nt, Artificial Sequence
  source: /note="Description of Artificial Sequence: Synthetic oligonucleotide"
uugauuuucuugaaguuucc

SEQ ID NO: 8374 - RNA, 20 nt, Artificial Sequence
  source: /note="Description of Artificial Sequence: Synthetic oligonucleotide"
ucaccacaaccuccaccucc

SEQ ID NO: 8375 - RNA, 20 nt, Artificial Sequence
  source: /note="Description of Artificial Sequence: Synthetic oligonucleotide"
caccacaaccuccaccuccc

SEQ ID NO: 8376 - RNA, 20 nt, Artificial Sequence
  source: /note="Description of Artificial Sequence: Synthetic oligonucleotide"
ucccgaguagcuagaauuac

SEQ ID NO: 8377 - RNA, 20 nt, Artificial Sequence
  source: /note="Description of Artificial Sequence: Synthetic oligonucleotide"
uagaauuacaggcacccacc

SEQ ID NO: 8378 - RNA, 20 nt, Artificial Sequence
  source: /note="Description of Artificial Sequence: Synthetic oligonucleotide"
uuuguauuuuuaguagagac

SEQ ID NO: 8379 - RNA, 20 nt, Artificial Sequence
  source: /note="Description of Artificial Sequence: Synthetic oligonucleotide"
uuguauuuuuaguagagaca

SEQ ID NO: 8380 - RNA, 20 nt, Artificial Sequence
  source: /note="Description of Artificial Sequence: Synthetic oligonucleotide"
gagacaggguuucaccaugu

SEQ ID NO: 8381 - RNA, 20 nt, Artificial Sequence
  source: /note="Description of Artificial Sequence: Synthetic oligonucleotide"
ccagauugaucucgaacucc

SEQ ID NO: 8382 - RNA, 20 nt, Artificial Sequence
  source: /note="Description of Artificial Sequence: Synthetic oligonucleotide"
gaucucgaacuccuggcuuc

SEQ ID NO: 8383 - RNA, 20 nt, Artificial Sequence
  source: /note="Description of Artificial Sequence: Synthetic oligonucleotide"
uucagguaacccacccaccc

SEQ ID NO: 8384 - RNA, 20 nt, Artificial Sequence
  source: /note="Description of Artificial Sequence: Synthetic oligonucleotide"
acccuggccucccaaagugc

SEQ ID NO: 8385 - RNA, 20 nt, Artificial Sequence
  source: /note="Description of Artificial Sequence: Synthetic oligonucleotide"
cccuggccucccaaagugcu

SEQ ID NO: 8386 - RNA, 20 nt, Artificial Sequence
  source: /note="Description of Artificial Sequence: Synthetic oligonucleotide"
ucccaaagugcugggauuac

SEQ ID NO: 8387 - RNA, 20 nt, Artificial Sequence
  source: /note="Description of Artificial Sequence: Synthetic oligonucleotide"
agugcugggauuacaggugu

SEQ ID NO: 8388 - RNA, 20 nt, Artificial Sequence
  source: /note="Description of Artificial Sequence: Synthetic oligonucleotide"
auaaaugccaaugccugaaa

SEQ ID NO: 8389 - RNA, 20 nt, Artificial Sequence
  source: /note="Description of Artificial Sequence: Synthetic oligonucleotide"
ugaaaaccaugaaaaauagu

SEQ ID NO: 8390 - RNA, 20 nt, Artificial Sequence
  source: /note="Description of Artificial Sequence: Synthetic oligonucleotide"
guuuaacugcucuaaauguc

SEQ ID NO: 8391 - RNA, 20 nt, Artificial Sequence
  source: /note="Description of Artificial Sequence: Synthetic oligonucleotide"
uugcuuuuugucuaguuuca

SEQ ID NO: 8392 - RNA, 20 nt, Artificial Sequence
  source: /note="Description of Artificial Sequence: Synthetic oligonucleotide"
cauaaauagauuuuauuuua

SEQ ID NO: 8393 - RNA, 20 nt, Artificial Sequence
  source: /note="Description of Artificial Sequence: Synthetic oligonucleotide"
aauagauuuuauuuuauggc

SEQ ID NO: 8394 - RNA, 20 nt, Artificial Sequence
  source: /note="Description of Artificial Sequence: Synthetic oligonucleotide"
agaauagaauaaucucaaau

SEQ ID NO: 8395 - RNA, 20 nt, Artificial Sequence
  source: /note="Description of Artificial Sequence: Synthetic oligonucleotide"
gaauagaauaaucucaaauu

SEQ ID NO: 8396 - RNA, 20 nt, Artificial Sequence
  source: /note="Description of Artificial Sequence: Synthetic oligonucleotide"
aauagaauaaucucaaauug

SEQ ID NO: 8397 - RNA, 20 nt, Artificial Sequence
  source: /note="Description of Artificial Sequence: Synthetic oligonucleotide"
auaaucucaaauuggggcug

SEQ ID NO: 8398 - RNA, 20 nt, Artificial Sequence
  source: /note="Description of Artificial Sequence: Synthetic oligonucleotide"
cucugagugcaucuuucagu

SEQ ID NO: 8399 - RNA, 20 nt, Artificial Sequence
  source: /note="Description of Artificial Sequence: Synthetic oligonucleotide"
aagucuaaccaguauuuuuu

SEQ ID NO: 8400 - RNA, 20 nt, Artificial Sequence
  source: /note="Description of Artificial Sequence: Synthetic oligonucleotide"
uuuuuggcaaguaagaguug

SEQ ID NO: 8401 - RNA, 20 nt, Artificial Sequence
  source: /note="Description of Artificial Sequence: Synthetic oligonucleotide"
uuuuggcaaguaagaguugu

SEQ ID NO: 8402 - RNA, 20 nt, Artificial Sequence
  source: /note="Description of Artificial Sequence: Synthetic oligonucleotide"
ggaguguaucugucaucaua

SEQ ID NO: 8403 - RNA, 20 nt, Artificial Sequence
  source: /note="Description of Artificial Sequence: Synthetic oligonucleotide"
gccagaaaugccuucugcca

SEQ ID NO: 8404 - RNA, 20 nt, Artificial Sequence
  source: /note="Description of Artificial Sequence: Synthetic oligonucleotide"
agaaaugccuucugccaugg

SEQ ID NO: 8405 - RNA, 20 nt, Artificial Sequence
  source: /note="Description of Artificial Sequence: Synthetic oligonucleotide"
gaaaugccuucugccauggu

SEQ ID NO: 8406 - RNA, 20 nt, Artificial Sequence
  source: /note="Description of Artificial Sequence: Synthetic oligonucleotide"
gggugauguuaaacauuuca

SEQ ID NO: 8407 - RNA, 20 nt, Artificial Sequence
  source: /note="Description of Artificial Sequence: Synthetic oligonucleotide"
uaaaaauugucaaacauaaa

SEQ ID NO: 8408 - RNA, 20 nt, Artificial Sequence
  source: /note="Description of Artificial Sequence: Synthetic oligonucleotide"
gugcaauauaaugaauucca

SEQ ID NO: 8409 - RNA, 20 nt, Artificial Sequence
  source: /note="Description of Artificial Sequence: Synthetic oligonucleotide"
aucuuaccuguuaacauuuc

SEQ ID NO: 8410 - RNA, 20 nt, Artificial Sequence
  source: /note="Description of Artificial Sequence: Synthetic oligonucleotide"
uuucaggauguauuucuaac

SEQ ID NO: 8411 - RNA, 20 nt, Artificial Sequence
  source: /note="Description of Artificial Sequence: Synthetic oligonucleotide"
cccaguucauguccauuguc

SEQ ID NO: 8412 - RNA, 20 nt, Artificial Sequence
  source: /note="Description of Artificial Sequence: Synthetic oligonucleotide"
ccaguucauguccauugucu

SEQ ID NO: 8413 - RNA, 20 nt, Artificial Sequence
  source: /note="Description of Artificial Sequence: Synthetic oligonucleotide"
cuguaaaauuccccacauuc

SEQ ID NO: 8414 - RNA, 20 nt, Artificial Sequence
  source: /note="Description of Artificial Sequence: Synthetic oligonucleotide"
aauuccccacauucuggauu

SEQ ID NO: 8415 - RNA, 20 nt, Artificial Sequence
  source: /note="Description of Artificial Sequence: Synthetic oligonucleotide"
ggauuuggccgauuucaucu

SEQ ID NO: 8416 - RNA, 20 nt, Artificial Sequence
  source: /note="Description of Artificial Sequence: Synthetic oligonucleotide"
ucuauccccaguaucuucug

SEQ ID NO: 8417 - RNA, 20 nt, Artificial Sequence
  source: /note="Description of Artificial Sequence: Synthetic oligonucleotide"
ccccaguaucuucuguggac

SEQ ID NO: 8418 - RNA, 20 nt, Artificial Sequence
  source: /note="Description of Artificial Sequence: Synthetic oligonucleotide"
cuguggacugguaguuugac

SEQ ID NO: 8419 - RNA, 20 nt, Artificial Sequence
  source: /note="Description of Artificial Sequence: Synthetic oligonucleotide"
uuuuuuuuuuuuuuugagac

SEQ ID NO: 8420 - RNA, 20 nt, Artificial Sequence
  source: /note="Description of Artificial Sequence: Synthetic oligonucleotide"
aggcucucgcucugucgcuu

SEQ ID NO: 8421 - RNA, 20 nt, Artificial Sequence
  source: /note="Description of Artificial Sequence: Synthetic oligonucleotide"
ucucgcucugucgcuuaggc

SEQ ID NO: 8422 - RNA, 20 nt, Artificial Sequence
  source: /note="Description of Artificial Sequence: Synthetic oligonucleotide"
ucgcuuaggcuggagugcag

SEQ ID NO: 8423 - RNA, 20 nt, Artificial Sequence
  source: /note="Description of Artificial Sequence: Synthetic oligonucleotide"
cacugcaaccuccaccuccc

SEQ ID NO: 8424 - RNA, 20 nt, Artificial Sequence
  source: /note="Description of Artificial Sequence: Synthetic oligonucleotide"
gccucagccuccugaguaac

SEQ ID NO: 8425 - RNA, 20 nt, Artificial Sequence
  source: /note="Description of Artificial Sequence: Synthetic oligonucleotide"
ccucagccuccugaguaacu

SEQ ID NO: 8426 - RNA, 20 nt, Artificial Sequence
  source: /note="Description of Artificial Sequence: Synthetic oligonucleotide"
uuuuguacuuuuaguagaga

SEQ ID NO: 8427 - RNA, 20 nt, Artificial Sequence
  source: /note="Description of Artificial Sequence: Synthetic oligonucleotide"
uuuguacuuuuaguagagac

SEQ ID NO: 8428 - RNA, 20 nt, Artificial Sequence
  source: /note="Description of Artificial Sequence: Synthetic oligonucleotide"
uuguacuuuuaguagagacg

SEQ ID NO: 8429 - RNA, 20 nt, Artificial Sequence
  source: /note="Description of Artificial Sequence: Synthetic oligonucleotide"
gagacgggguuucgccaugu

SEQ ID NO: 8430 - RNA, 20 nt, Artificial Sequence
  source: /note="Description of Artificial Sequence: Synthetic oligonucleotide"
gggguuucgccauguuggcc

SEQ ID NO: 8431 - RNA, 20 nt, Artificial Sequence
  source: /note="Description of Artificial Sequence: Synthetic oligonucleotide"
uuucgccauguuggccaggc

SEQ ID NO: 8432 - RNA, 20 nt, Artificial Sequence
  source: /note="Description of Artificial Sequence: Synthetic oligonucleotide"
ccauguuggccaggcugguc

SEQ ID NO: 8433 - RNA, 20 nt, Artificial Sequence
  source: /note="Description of Artificial Sequence: Synthetic oligonucleotide"
ccaggcuggucuggaacucc

SEQ ID NO: 8434 - RNA, 20 nt, Artificial Sequence
  source: /note="Description of Artificial Sequence: Synthetic oligonucleotide"
cucaagugauccgcccaccu

SEQ ID NO: 8435 - RNA, 20 nt, Artificial Sequence
  source: /note="Description of Artificial Sequence: Synthetic oligonucleotide"
accuuggccucccaaagugc

SEQ ID NO: 8436 - RNA, 20 nt, Artificial Sequence
  source: /note="Description of Artificial Sequence: Synthetic oligonucleotide"
ccuuggccucccaaagugcu

SEQ ID NO: 8437 - RNA, 20 nt, Artificial Sequence
  source: /note="Description of Artificial Sequence: Synthetic oligonucleotide"
ucccaaagugcugggauuac

SEQ ID NO: 8438 - RNA, 20 nt, Artificial Sequence
  source: /note="Description of Artificial Sequence: Synthetic oligonucleotide"
ugugcauguauaguauacau

SEQ ID NO: 8439 - RNA, 20 nt, Artificial Sequence
  source: /note="Description of Artificial Sequence: Synthetic oligonucleotide"
ucaucuuauuuauauacauc

SEQ ID NO: 8440 - RNA, 20 nt, Artificial Sequence
  source: /note="Description of Artificial Sequence: Synthetic oligonucleotide"
aaguccaaauaguaaaucaa

SEQ ID NO: 8441 - RNA, 20 nt, Artificial Sequence
  source: /note="Description of Artificial Sequence: Synthetic oligonucleotide"
acguuuucaucauucccaga

SEQ ID NO: 8442 - RNA, 20 nt, Artificial Sequence
  source: /note="Description of Artificial Sequence: Synthetic oligonucleotide"
aaggaaacccuguauuuauu

SEQ ID NO: 8443 - RNA, 20 nt, Artificial Sequence
  source: /note="Description of Artificial Sequence: Synthetic oligonucleotide"
cccuucuuccuuccucuaag

SEQ ID NO: 8444 - RNA, 20 nt, Artificial Sequence
  source: /note="Description of Artificial Sequence: Synthetic oligonucleotide"
aaauaaacauucaguuucuc

SEQ ID NO: 8445 - RNA, 20 nt, Artificial Sequence
  source: /note="Description of Artificial Sequence: Synthetic oligonucleotide"
uucucuggauuuaccuauuc

SEQ ID NO: 8446 - RNA, 20 nt, Artificial Sequence
  source: /note="Description of Artificial Sequence: Synthetic oligonucleotide"
ucucuggauuuaccuauucu

SEQ ID NO: 8447 - RNA, 20 nt, Artificial Sequence
  source: /note="Description of Artificial Sequence: Synthetic oligonucleotide"
uauuagugaaaucauguauu

SEQ ID NO: 8448 - RNA, 20 nt, Artificial Sequence
  source: /note="Description of Artificial Sequence: Synthetic oligonucleotide"
auguauuuggccuuucucuc

SEQ ID NO: 8449 - RNA, 20 nt, Artificial Sequence
  source: /note="Description of Artificial Sequence: Synthetic oligonucleotide"
agagucucgcucuguugccc

SEQ ID NO: 8450 - RNA, 20 nt, Artificial Sequence
  source: /note="Description of Artificial Sequence: Synthetic oligonucleotide"
cucgcucuguugcccaggcu

SEQ ID NO: 8451 - RNA, 20 nt, Artificial Sequence
  source: /note="Description of Artificial Sequence: Synthetic oligonucleotide"
ucgcucuguugcccaggcua

SEQ ID NO: 8452 - RNA, 20 nt, Artificial Sequence
  source: /note="Description of Artificial Sequence: Synthetic oligonucleotide"
uugcccaggcuagggugcaa

SEQ ID NO: 8453 - RNA, 20 nt, Artificial Sequence
  source: /note="Description of Artificial Sequence: Synthetic oligonucleotide"
ucacugcaaccucugucucc

SEQ ID NO: 8454 - RNA, 20 nt, Artificial Sequence
  source: /note="Description of Artificial Sequence: Synthetic oligonucleotide"
cacugcaaccucugucuccc

SEQ ID NO: 8455 - RNA, 20 nt, Artificial Sequence
  source: /note="Description of Artificial Sequence: Synthetic oligonucleotide"
ugccucagcccccaaguagu

SEQ ID NO: 8456 - RNA, 20 nt, Artificial Sequence
  source: /note="Description of Artificial Sequence: Synthetic oligonucleotide"
gccucagcccccaaguaguu

SEQ ID NO: 8457 - RNA, 20 nt, Artificial Sequence
  source: /note="Description of Artificial Sequence: Synthetic oligonucleotide"
uuuguauuuuuaguagagac

SEQ ID NO: 8458 - RNA, 20 nt, Artificial Sequence
  source: /note="Description of Artificial Sequence: Synthetic oligonucleotide"
uuguauuuuuaguagagaca

SEQ ID NO: 8459 - RNA, 20 nt, Artificial Sequence
  source: /note="Description of Artificial Sequence: Synthetic oligonucleotide"
gagacaggguuucaccaugu

SEQ ID NO: 8460 - RNA, 20 nt, Artificial Sequence
  source: /note="Description of Artificial Sequence: Synthetic oligonucleotide"
aggguuucaccauguuggcu

SEQ ID NO: 8461 - RNA, 20 nt, Artificial Sequence
  source: /note="Description of Artificial Sequence: Synthetic oligonucleotide"
uuucaccauguuggcuaggc

SEQ ID NO: 8462 - RNA, 20 nt, Artificial Sequence
  source: /note="Description of Artificial Sequence: Synthetic oligonucleotide"
accuuagccuccuaaagugc

SEQ ID NO: 8463 - RNA, 20 nt, Artificial Sequence
  source: /note="Description of Artificial Sequence: Synthetic oligonucleotide"
ccuuagccuccuaaagugcu

SEQ ID NO: 8464 - RNA, 20 nt, Artificial Sequence
  source: /note="Description of Artificial Sequence: Synthetic oligonucleotide"
uuuauuaguuaauugacauu

SEQ ID NO: 8465 - RNA, 20 nt, Artificial Sequence
  source: /note="Description of Artificial Sequence: Synthetic oligonucleotide"
uuuggaucguuucuacuuuu

SEQ ID NO: 8466 - RNA, 20 nt, Artificial Sequence
  source: /note="Description of Artificial Sequence: Synthetic oligonucleotide"
aauuaugcugcaaugaacau

SEQ ID NO: 8467 - RNA, 20 nt, Artificial Sequence
  source: /note="Description of Artificial Sequence: Synthetic oligonucleotide"
gaacauguuuucaguuaccu

SEQ ID NO: 8468 - RNA, 20 nt, Artificial Sequence
  source: /note="Description of Artificial Sequence: Synthetic oligonucleotide"
aacauguuuucaguuaccuu

SEQ ID NO: 8469 - RNA, 20 nt, Artificial Sequence
  source: /note="Description of Artificial Sequence: Synthetic oligonucleotide"
uuaccuugggauauacaccu

SEQ ID NO: 8470 - RNA, 20 nt, Artificial Sequence
  source: /note="Description of Artificial Sequence: Synthetic oligonucleotide"
gagugacauuguuaguaaua

SEQ ID NO: 8471 - RNA, 20 nt, Artificial Sequence
  source: /note="Description of Artificial Sequence: Synthetic oligonucleotide"
uuucugccaacaauguauga

SEQ ID NO: 8472 - RNA, 20 nt, Artificial Sequence
  source: /note="Description of Artificial Sequence: Synthetic oligonucleotide"
uuuaauuguaaccauccaag

SEQ ID NO: 8473 - RNA, 20 nt, Artificial Sequence
  source: /note="Description of Artificial Sequence: Synthetic oligonucleotide"
uuaauuguaaccauccaagu

SEQ ID NO: 8474 - RNA, 20 nt, Artificial Sequence
  source: /note="Description of Artificial Sequence: Synthetic oligonucleotide"
uuugauuugcauuuuccuaa

SEQ ID NO: 8475 - RNA, 20 nt, Artificial Sequence
  source: /note="Description of Artificial Sequence: Synthetic oligonucleotide"
auuuuccuaauggcugauau

SEQ ID NO: 8476 - RNA, 20 nt, Artificial Sequence
  source: /note="Description of Artificial Sequence: Synthetic oligonucleotide"
uuuuccuaauggcugauauu

SEQ ID NO: 8477 - RNA, 20 nt, Artificial Sequence
  source: /note="Description of Artificial Sequence: Synthetic oligonucleotide"
cuugaacuuugucaaaugcc

SEQ ID NO: 8478 - RNA, 20 nt, Artificial Sequence
  source: /note="Description of Artificial Sequence: Synthetic oligonucleotide"
gauauuuucuccuaucccac

SEQ ID NO: 8479 - RNA, 20 nt, Artificial Sequence
  source: /note="Description of Artificial Sequence: Synthetic oligonucleotide"
aaacucaauuucuuuuuaau

SEQ ID NO: 8480 - RNA, 20 nt, Artificial Sequence
  source: /note="Description of Artificial Sequence: Synthetic oligonucleotide"
uaauuggcagcuugugcauu

SEQ ID NO: 8481 - RNA, 20 nt, Artificial Sequence
  source: /note="Description of Artificial Sequence: Synthetic oligonucleotide"
aauuggcagcuugugcauuu

SEQ ID NO: 8482 - RNA, 20 nt, Artificial Sequence
  source: /note="Description of Artificial Sequence: Synthetic oligonucleotide"
auuggcagcuugugcauuug

SEQ ID NO: 8483 - RNA, 20 nt, Artificial Sequence
  source: /note="Description of Artificial Sequence: Synthetic oligonucleotide"
uuaauguugaguuaauuuga

SEQ ID NO: 8484 - RNA, 20 nt, Artificial Sequence
  source: /note="Description of Artificial Sequence: Synthetic oligonucleotide"
aauuaacugaccaagaugua

SEQ ID NO: 8485 - RNA, 20 nt, Artificial Sequence
  source: /note="Description of Artificial Sequence: Synthetic oligonucleotide"
auuaacugaccaagauguau

SEQ ID NO: 8486 - RNA, 20 nt, Artificial Sequence
  source: /note="Description of Artificial Sequence: Synthetic oligonucleotide"
aagauguauggguuuauuuc

SEQ ID NO: 8487 - RNA, 20 nt, Artificial Sequence
  source: /note="Description of Artificial Sequence: Synthetic oligonucleotide"
guaaauuuugaaaucaagac

SEQ ID NO: 8488 - RNA, 20 nt, Artificial Sequence
  source: /note="Description of Artificial Sequence: Synthetic oligonucleotide"
cuuuugccuaccauguuucu

SEQ ID NO: 8489 - RNA, 20 nt, Artificial Sequence
  source: /note="Description of Artificial Sequence: Synthetic oligonucleotide"
uuuugccuaccauguuucuu

SEQ ID NO: 8490 - RNA, 20 nt, Artificial Sequence
  source: /note="Description of Artificial Sequence: Synthetic oligonucleotide"
cagcuucuccguuuccuuuc

SEQ ID NO: 8491 - RNA, 20 nt, Artificial Sequence
  source: /note="Description of Artificial Sequence: Synthetic oligonucleotide"
uuuuuuuuuuuuuuuuuuuu

SEQ ID NO: 8492 - RNA, 20 nt, Artificial Sequence
  source: /note="Description of Artificial Sequence: Synthetic oligonucleotide"
uuuuuuuuuuuuuuuuuugg

SEQ ID NO: 8493 - RNA, 20 nt, Artificial Sequence
  source: /note="Description of Artificial Sequence: Synthetic oligonucleotide"
uuuuuuuuuuuugguggagc

SEQ ID NO: 8494 - RNA, 20 nt, Artificial Sequence
  source: /note="Description of Artificial Sequence: Synthetic oligonucleotide"
ucuuacuauauuacccaagc

SEQ ID NO: 8495 - RNA, 20 nt, Artificial Sequence
  source: /note="Description of Artificial Sequence: Synthetic oligonucleotide"
ccaagcugguuuugaacucc

SEQ ID NO: 8496 - RNA, 20 nt, Artificial Sequence
  source: /note="Description of Artificial Sequence: Synthetic oligonucleotide"
cuaaagagauccucccuccu

SEQ ID NO: 8497 - RNA, 20 nt, Artificial Sequence
  source: /note="Description of Artificial Sequence: Synthetic oligonucleotide"
uccuaggcuucccagagagc

SEQ ID NO: 8498 - RNA, 20 nt, Artificial Sequence
  source: /note="Description of Artificial Sequence: Synthetic oligonucleotide"
ccuaggcuucccagagagcu

SEQ ID NO: 8499 - RNA, 20 nt, Artificial Sequence
  source: /note="Description of Artificial Sequence: Synthetic oligonucleotide"
cuaggcuucccagagagcug

SEQ ID NO: 8500 - RNA, 20 nt, Artificial Sequence
  source: /note="Description of Artificial Sequence: Synthetic oligonucleotide"
ucccagagagcugggguuac

SEQ ID NO: 8501 - RNA, 20 nt, Artificial Sequence
  source: /note="Description of Artificial Sequence: Synthetic oligonucleotide"
caccacauccaacccccuuc

SEQ ID NO: 8502 - RNA, 20 nt, Artificial Sequence
  source: /note="Description of Artificial Sequence: Synthetic oligonucleotide"
accacauccaacccccuucu

SEQ ID NO: 8503 - RNA, 20 nt, Artificial Sequence
  source: /note="Description of Artificial Sequence: Synthetic oligonucleotide"
cccccuucugggacuuugac

SEQ ID NO: 8504 - RNA, 20 nt, Artificial Sequence
  source: /note="Description of Artificial Sequence: Synthetic oligonucleotide"
ccccuucugggacuuugacu

SEQ ID NO: 8505 - RNA, 20 nt, Artificial Sequence
  source: /note="Description of Artificial Sequence: Synthetic oligonucleotide"
cccuucugggacuuugacug

SEQ ID NO: 8506 - RNA, 20 nt, Artificial Sequence
  source: /note="Description of Artificial Sequence: Synthetic oligonucleotide"
ugggguucuguugaaucugu

SEQ ID NO: 8507 - RNA, 20 nt, Artificial Sequence
  source: /note="Description of Artificial Sequence: Synthetic oligonucleotide"
guugaaucuguuggucaauu

SEQ ID NO: 8508 - RNA, 20 nt, Artificial Sequence
  source: /note="Description of Artificial Sequence: Synthetic oligonucleotide"
agcuuccaauuuaugaacac

SEQ ID NO: 8509 - RNA, 20 nt, Artificial Sequence
  source: /note="Description of Artificial Sequence: Synthetic oligonucleotide"
aauuucuuucaguaauguuu

SEQ ID NO: 8510 - RNA, 20 nt, Artificial Sequence
  source: /note="Description of Artificial Sequence: Synthetic oligonucleotide"
cucacugcaaccuccaccuc

SEQ ID NO: 8511 - RNA, 20 nt, Artificial Sequence
  source: /note="Description of Artificial Sequence: Synthetic oligonucleotide"
ucacugcaaccuccaccucc

SEQ ID NO: 8512 - RNA, 20 nt, Artificial Sequence
  source: /note="Description of Artificial Sequence: Synthetic oligonucleotide"
agugauucuccugccucagc

SEQ ID NO: 8513 - RNA, 20 nt, Artificial Sequence
  source: /note="Description of Artificial Sequence: Synthetic oligonucleotide"
ccugccucagcuggaacuac

SEQ ID NO: 8514 - RNA, 20 nt, Artificial Sequence
  source: /note="Description of Artificial Sequence: Synthetic oligonucleotide"
caggugcgcgccaccaugcc

SEQ ID NO: 8515 - RNA, 20 nt, Artificial Sequence
  source: /note="Description of Artificial Sequence: Synthetic oligonucleotide"
ggcuaauuguuuuguguuuu

SEQ ID NO: 8516 - RNA, 20 nt, Artificial Sequence
  source: /note="Description of Artificial Sequence: Synthetic oligonucleotide"
uaauuguuuuguguuuuugg

SEQ ID NO: 8517 - RNA, 20 nt, Artificial Sequence
  source: /note="Description of Artificial Sequence: Synthetic oligonucleotide"
uuuguguuuuugguggagac

SEQ ID NO: 8518 - RNA, 20 nt, Artificial Sequence
  source: /note="Description of Artificial Sequence: Synthetic oligonucleotide"
uuguguuuuugguggagaca

SEQ ID NO: 8519 - RNA, 20 nt, Artificial Sequence
  source: /note="Description of Artificial Sequence: Synthetic oligonucleotide"
gagacaggguuucaccaugu

SEQ ID NO: 8520 - RNA, 20 nt, Artificial Sequence
  source: /note="Description of Artificial Sequence: Synthetic oligonucleotide"
aggguuucaccauguuggcc

SEQ ID NO: 8521 - RNA, 20 nt, Artificial Sequence
  source: /note="Description of Artificial Sequence: Synthetic oligonucleotide"
uuucaccauguuggccaggc

SEQ ID NO: 8522 - RNA, 20 nt, Artificial Sequence
  source: /note="Description of Artificial Sequence: Synthetic oligonucleotide"
ccaggcuggucucaaacacc

SEQ ID NO: 8523 - RNA, 20 nt, Artificial Sequence
  source: /note="Description of Artificial Sequence: Synthetic oligonucleotide"
cucaagugaccugacugccu

SEQ ID NO: 8524 - RNA, 20 nt, Artificial Sequence
  source: /note="Description of Artificial Sequence: Synthetic oligonucleotide"
gccuuggccucccaaaguac

SEQ ID NO: 8525 - RNA, 20 nt, Artificial Sequence
  source: /note="Description of Artificial Sequence: Synthetic oligonucleotide"
ccuuggccucccaaaguacu

SEQ ID NO: 8526 - RNA, 20 nt, Artificial Sequence
  source: /note="Description of Artificial Sequence: Synthetic oligonucleotide"
ucccaaaguacugggauuac

SEQ ID NO: 8527 - RNA, 20 nt, Artificial Sequence
  source: /note="Description of Artificial Sequence: Synthetic oligonucleotide"
caggcaugagccaccacgcc

SEQ ID NO: 8528 - RNA, 20 nt, Artificial Sequence
  source: /note="Description of Artificial Sequence: Synthetic oligonucleotide"
aauuuuuuguugauaauaua

SEQ ID NO: 8529 - RNA, 20 nt, Artificial Sequence
  source: /note="Description of Artificial Sequence: Synthetic oligonucleotide"
uaaauuucauuuuuauauau

SEQ ID NO: 8530 - RNA, 20 nt, Artificial Sequence
  source: /note="Description of Artificial Sequence: Synthetic oligonucleotide"
uuauuagcacuaacuuuuuu

SEQ ID NO: 8531 - RNA, 20 nt, Artificial Sequence
  source: /note="Description of Artificial Sequence: Synthetic oligonucleotide"
cuuuuuuugguagauuccuu

SEQ ID NO: 8532 - RNA, 20 nt, Artificial Sequence
  source: /note="Description of Artificial Sequence: Synthetic oligonucleotide"
uuguuucuucacuuccaauc

SEQ ID NO: 8533 - RNA, 20 nt, Artificial Sequence
  source: /note="Description of Artificial Sequence: Synthetic oligonucleotide"
uguuucuucacuuccaaucu

SEQ ID NO: 8534 - RNA, 20 nt, Artificial Sequence
  source: /note="Description of Artificial Sequence: Synthetic oligonucleotide"
uucuucacuuccaaucuggg

SEQ ID NO: 8535 - RNA, 20 nt, Artificial Sequence
  source: /note="Description of Artificial Sequence: Synthetic oligonucleotide"
uagaacuuccagaaaauguc

SEQ ID NO: 8536 - RNA, 20 nt, Artificial Sequence
  source: /note="Description of Artificial Sequence: Synthetic oligonucleotide"
uuaaguaugauacuaguugu

SEQ ID NO: 8537 - RNA, 20 nt, Artificial Sequence
  source: /note="Description of Artificial Sequence: Synthetic oligonucleotide"
uugaauaauuuuaucacgaa

SEQ ID NO: 8538 - RNA, 20 nt, Artificial Sequence
  source: /note="Description of Artificial Sequence: Synthetic oligonucleotide"
ugaauaauuuuaucacgaaa

SEQ ID NO: 8539 - RNA, 20 nt, Artificial Sequence
  source: /note="Description of Artificial Sequence: Synthetic oligonucleotide"
ugaacuuuucucaaaugcug

SEQ ID NO: 8540 - RNA, 20 nt, Artificial Sequence
  source: /note="Description of Artificial Sequence: Synthetic oligonucleotide"
ucuccuuuauucuauuaaua

SEQ ID NO: 8541 - RNA, 20 nt, Artificial Sequence
  source: /note="Description of Artificial Sequence: Synthetic oligonucleotide"
uuagauuaacauuauauuuc

SEQ ID NO: 8542 - RNA, 20 nt, Artificial Sequence
  source: /note="Description of Artificial Sequence: Synthetic oligonucleotide"
uuucuggaauaaaucccacu

SEQ ID NO: 8543 - RNA, 20 nt, Artificial Sequence
  source: /note="Description of Artificial Sequence: Synthetic oligonucleotide"
uauuacuuuuuauauauugc

SEQ ID NO: 8544 - RNA, 20 nt, Artificial Sequence
  source: /note="Description of Artificial Sequence: Synthetic oligonucleotide"
uauugcuggagucuguuugc

SEQ ID NO: 8545 - RNA, 20 nt, Artificial Sequence
  source: /note="Description of Artificial Sequence: Synthetic oligonucleotide"
uguuugcagguauuucauug

SEQ ID NO: 8546 - RNA, 20 nt, Artificial Sequence
  source: /note="Description of Artificial Sequence: Synthetic oligonucleotide"
cuuucgcaucucuguugaua

SEQ ID NO: 8547 - RNA, 20 nt, Artificial Sequence
  source: /note="Description of Artificial Sequence: Synthetic oligonucleotide"
uaguucucuugugauaucuu

SEQ ID NO: 8548 - RNA, 20 nt, Artificial Sequence
  source: /note="Description of Artificial Sequence: Synthetic oligonucleotide"
ucuugugauaucuuugguuu

SEQ ID NO: 8549 - RNA, 20 nt, Artificial Sequence
  source: /note="Description of Artificial Sequence: Synthetic oligonucleotide"
ucugaguucacaaaaugcau

SEQ ID NO: 8550 - RNA, 20 nt, Artificial Sequence
  source: /note="Description of Artificial Sequence: Synthetic oligonucleotide"
cugaguucacaaaaugcauu

SEQ ID NO: 8551 - RNA, 20 nt, Artificial Sequence
  source: /note="Description of Artificial Sequence: Synthetic oligonucleotide"
auguucccuucucuaucuuu

SEQ ID NO: 8552 - RNA, 20 nt, Artificial Sequence
  source: /note="Description of Artificial Sequence: Synthetic oligonucleotide"
ucuuuuggaagaguuuacaa

SEQ ID NO: 8553 - RNA, 20 nt, Artificial Sequence
  source: /note="Description of Artificial Sequence: Synthetic oligonucleotide"
uggaagaguuuacaaaggau

SEQ ID NO: 8554 - RNA, 20 nt, Artificial Sequence
  source: /note="Description of Artificial Sequence: Synthetic oligonucleotide"
aacucuuuuuuaaauguuug

SEQ ID NO: 8555 - RNA, 20 nt, Artificial Sequence
  source: /note="Description of Artificial Sequence: Synthetic oligonucleotide"
uugaggaaauucucuacccc

SEQ ID NO: 8556 - RNA, 20 nt, Artificial Sequence
  source: /note="Description of Artificial Sequence: Synthetic oligonucleotide"
ugaggaaauucucuaccccu

SEQ ID NO: 8557 - RNA, 20 nt, Artificial Sequence
  source: /note="Description of Artificial Sequence: Synthetic oligonucleotide"
uaccccugggcuuuccuuug

SEQ ID NO: 8558 - RNA, 20 nt, Artificial Sequence
  source: /note="Description of Artificial Sequence: Synthetic oligonucleotide"
accccugggcuuuccuuugu

SEQ ID NO: 8559 - RNA, 20 nt, Artificial Sequence
  source: /note="Description of Artificial Sequence: Synthetic oligonucleotide"
auuauuuuuaaagcaauuuu

SEQ ID NO: 8560 - RNA, 20 nt, Artificial Sequence
  source: /note="Description of Artificial Sequence: Synthetic oligonucleotide"
uuauuuuuaaagcaauuuua

SEQ ID NO: 8561 - RNA, 20 nt, Artificial Sequence
  source: /note="Description of Artificial Sequence: Synthetic oligonucleotide"
guaaaagcacauugaaugaa

SEQ ID NO: 8562 - RNA, 20 nt, Artificial Sequence
  source: /note="Description of Artificial Sequence: Synthetic oligonucleotide"
aucaacauccuuuaccagaa

SEQ ID NO: 8563 - RNA, 20 nt, Artificial Sequence
  source: /note="Description of Artificial Sequence: Synthetic oligonucleotide"
cauaguuuagaguucaccuu

SEQ ID NO: 8564 - RNA, 20 nt, Artificial Sequence
  source: /note="Description of Artificial Sequence: Synthetic oligonucleotide"
uguuauguauucugugaguc

SEQ ID NO: 8565 - RNA, 20 nt, Artificial Sequence
  source: /note="Description of Artificial Sequence: Synthetic oligonucleotide"
auuccagaaugucauauagu

SEQ ID NO: 8566 - RNA, 20 nt, Artificial Sequence
  source: /note="Description of Artificial Sequence: Synthetic oligonucleotide"
aguuggaaugauacaguaua

SEQ ID NO: 8567 - RNA, 20 nt, Artificial Sequence
  source: /note="Description of Artificial Sequence: Synthetic oligonucleotide"
uauauggagccuuuucagac

SEQ ID NO: 8568 - RNA, 20 nt, Artificial Sequence
  source: /note="Description of Artificial Sequence: Synthetic oligonucleotide"
uugaauaauauuccauuguc

SEQ ID NO: 8569 - RNA, 20 nt, Artificial Sequence
  source: /note="Description of Artificial Sequence: Synthetic oligonucleotide"
aagcuguuauaaaaguaugu

SEQ ID NO: 8570 - RNA, 20 nt, Artificial Sequence
  source: /note="Description of Artificial Sequence: Synthetic oligonucleotide"
aaaguauguagguuuuugug

SEQ ID NO: 8571 - RNA, 20 nt, Artificial Sequence
  source: /note="Description of Artificial Sequence: Synthetic oligonucleotide"
uuuuaauuuuaaugaagucu

SEQ ID NO: 8572 - RNA, 20 nt, Artificial Sequence
  source: /note="Description of Artificial Sequence: Synthetic oligonucleotide"
uaauucaugaauaauguuuu

SEQ ID NO: 8573 - RNA, 20 nt, Artificial Sequence
  source: /note="Description of Artificial Sequence: Synthetic oligonucleotide"
uaucuaaaaagucaacacca

SEQ ID NO: 8574 - RNA, 20 nt, Artificial Sequence
  source: /note="Description of Artificial Sequence: Synthetic oligonucleotide"
uaguucugcauuuuacauuu

SEQ ID NO: 8575 - RNA, 20 nt, Artificial Sequence
  source: /note="Description of Artificial Sequence: Synthetic oligonucleotide"
aguucugcauuuuacauuua

SEQ ID NO: 8576 - RNA, 20 nt, Artificial Sequence
  source: /note="Description of Artificial Sequence: Synthetic oligonucleotide"
uagauucacuuguuugcaug

SEQ ID NO: 8577 - RNA, 20 nt, Artificial Sequence
  source: /note="Description of Artificial Sequence: Synthetic oligonucleotide"
aucaguugauuauaauuaag

SEQ ID NO: 8578 - RNA, 20 nt, Artificial Sequence
  source: /note="Description of Artificial Sequence: Synthetic oligonucleotide"
auaauuaaguggucuguuuc

SEQ ID NO: 8579 - RNA, 20 nt, Artificial Sequence
  source: /note="Description of Artificial Sequence: Synthetic oligonucleotide"
ccacacuaucuuguuaacuu

SEQ ID NO: 8580 - RNA, 20 nt, Artificial Sequence
  source: /note="Description of Artificial Sequence: Synthetic oligonucleotide"
uuucuccuucaguauugagu

SEQ ID NO: 8581 - RNA, 20 nt, Artificial Sequence
  source: /note="Description of Artificial Sequence: Synthetic oligonucleotide"
guaaaaaaagcagucugaaa

SEQ ID NO: 8582 - RNA, 20 nt, Artificial Sequence
  source: /note="Description of Artificial Sequence: Synthetic oligonucleotide"
cuauauauacagucauuuau

SEQ ID NO: 8583 - RNA, 20 nt, Artificial Sequence
  source: /note="Description of Artificial Sequence: Synthetic oligonucleotide"
caguauccucaaaaucuugc

SEQ ID NO: 8584 - RNA, 20 nt, Artificial Sequence
  source: /note="Description of Artificial Sequence: Synthetic oligonucleotide"
caucuuccuauccaugaaca

SEQ ID NO: 8585 - RNA, 20 nt, Artificial Sequence
  source: /note="Description of Artificial Sequence: Synthetic oligonucleotide"
aacauggaacaucucuuucu

SEQ ID NO: 8586 - RNA, 20 nt, Artificial Sequence
  source: /note="Description of Artificial Sequence: Synthetic oligonucleotide"
uuauacauaaauauuucauu

SEQ ID NO: 8587 - RNA, 20 nt, Artificial Sequence
  source: /note="Description of Artificial Sequence: Synthetic oligonucleotide"
uauacauaaauauuucauuu

SEQ ID NO: 8588 - RNA, 20 nt, Artificial Sequence
  source: /note="Description of Artificial Sequence: Synthetic oligonucleotide"
auacauaaauauuucauuug

SEQ ID NO: 8589 - RNA, 20 nt, Artificial Sequence
  source: /note="Description of Artificial Sequence: Synthetic oligonucleotide"
uacauaaauauuucauuugg

SEQ ID NO: 8590 - RNA, 20 nt, Artificial Sequence
  source: /note="Description of Artificial Sequence: Synthetic oligonucleotide"
acauaaauauuucauuuggg

SEQ ID NO: 8591 - RNA, 20 nt, Artificial Sequence
  source: /note="Description of Artificial Sequence: Synthetic oligonucleotide"
cauaaauauuucauuugggg

SEQ ID NO: 8592 - RNA, 20 nt, Artificial Sequence
  source: /note="Description of Artificial Sequence: Synthetic oligonucleotide"
uucauuugggggggugcuaa

SEQ ID NO: 8593 - RNA, 20 nt, Artificial Sequence
  source: /note="Description of Artificial Sequence: Synthetic oligonucleotide"
agauucugcuuguacauugc

SEQ ID NO: 8594 - RNA, 20 nt, Artificial Sequence
  source: /note="Description of Artificial Sequence: Synthetic oligonucleotide"
agauccaguuuuuuuuuuuu

SEQ ID NO: 8595 - RNA, 20 nt, Artificial Sequence
  source: /note="Description of Artificial Sequence: Synthetic oligonucleotide"
gucauucuuucauauuuucu

SEQ ID NO: 8596 - RNA, 20 nt, Artificial Sequence
  source: /note="Description of Artificial Sequence: Synthetic oligonucleotide"
auuuccaguaugauguugaa

SEQ ID NO: 8597 - RNA, 20 nt, Artificial Sequence
  source: /note="Description of Artificial Sequence: Synthetic oligonucleotide"
aguaugauguugaaaggcau

SEQ ID NO: 8598 - RNA, 20 nt, Artificial Sequence
  source: /note="Description of Artificial Sequence: Synthetic oligonucleotide"
uguugaaaggcauuggugag

SEQ ID NO: 8599 - RNA, 20 nt, Artificial Sequence
  source: /note="Description of Artificial Sequence: Synthetic oligonucleotide"
gccuuguuccugaucucagc

SEQ ID NO: 8600 - RNA, 20 nt, Artificial Sequence
  source: /note="Description of Artificial Sequence: Synthetic oligonucleotide"
ucaauuuuauguuagcucua

SEQ ID NO: 8601 - RNA, 20 nt, Artificial Sequence
  source: /note="Description of Artificial Sequence: Synthetic oligonucleotide"
cauuaaauauguuagcugua

SEQ ID NO: 8602 - RNA, 20 nt, Artificial Sequence
  source: /note="Description of Artificial Sequence: Synthetic oligonucleotide"
uuuuguauauauucuuuauc

SEQ ID NO: 8603 - RNA, 20 nt, Artificial Sequence
  source: /note="Description of Artificial Sequence: Synthetic oligonucleotide"
auauauucuuuaucagguuc

SEQ ID NO: 8604 - RNA, 20 nt, Artificial Sequence
  source: /note="Description of Artificial Sequence: Synthetic oligonucleotide"
ucuuuuccuaguuuacugag

SEQ ID NO: 8605 - RNA, 20 nt, Artificial Sequence
  source: /note="Description of Artificial Sequence: Synthetic oligonucleotide"
ugaaaaucauuaaucagugu

SEQ ID NO: 8606 - RNA, 20 nt, Artificial Sequence
  source: /note="Description of Artificial Sequence: Synthetic oligonucleotide"
ucuuuagcuuauuaacgaaa

SEQ ID NO: 8607 - RNA, 20 nt, Artificial Sequence
  source: /note="Description of Artificial Sequence: Synthetic oligonucleotide"
uuucaaauuuugaacuagac

SEQ ID NO: 8608 - RNA, 20 nt, Artificial Sequence
  source: /note="Description of Artificial Sequence: Synthetic oligonucleotide"
uugaacuagacuggcauacc

SEQ ID NO: 8609 - RNA, 20 nt, Artificial Sequence
  source: /note="Description of Artificial Sequence: Synthetic oligonucleotide"
uaccuggagcaaaucccaca

SEQ ID NO: 8610 - RNA, 20 nt, Artificial Sequence
  source: /note="Description of Artificial Sequence: Synthetic oligonucleotide"
auuauuuaugaaugcauuca

SEQ ID NO: 8611 - RNA, 20 nt, Artificial Sequence
  source: /note="Description of Artificial Sequence: Synthetic oligonucleotide"
uaugaaugcauucaugguca

SEQ ID NO: 8612 - RNA, 20 nt, Artificial Sequence
  source: /note="Description of Artificial Sequence: Synthetic oligonucleotide"
aucuuuuauuguaaagacuu

SEQ ID NO: 8613 - RNA, 20 nt, Artificial Sequence
  source: /note="Description of Artificial Sequence: Synthetic oligonucleotide"
uauuguaaagacuuuggugu

SEQ ID NO: 8614 - RNA, 20 nt, Artificial Sequence
  source: /note="Description of Artificial Sequence: Synthetic oligonucleotide"
agacuuugguguugguauua

SEQ ID NO: 8615 - RNA, 20 nt, Artificial Sequence
  source: /note="Description of Artificial Sequence: Synthetic oligonucleotide"
uaauuucuuccuuaaaacuu

SEQ ID NO: 8616 - RNA, 20 nt, Artificial Sequence
  source: /note="Description of Artificial Sequence: Synthetic oligonucleotide"
cagaaugaaccaucuguguc

SEQ ID NO: 8617 - RNA, 20 nt, Artificial Sequence
  source: /note="Description of Artificial Sequence: Synthetic oligonucleotide"
ucaauuucuuucauagauau

SEQ ID NO: 8618 - RNA, 20 nt, Artificial Sequence
  source: /note="Description of Artificial Sequence: Synthetic oligonucleotide"
uuauuauuuugcauaaauau

SEQ ID NO: 8619 - RNA, 20 nt, Artificial Sequence
  source: /note="Description of Artificial Sequence: Synthetic oligonucleotide"
auugguaguuguguccuuca

SEQ ID NO: 8620 - RNA, 20 nt, Artificial Sequence
  source: /note="Description of Artificial Sequence: Synthetic oligonucleotide"
aguuguguccuucaaggaau

SEQ ID NO: 8621 - RNA, 20 nt, Artificial Sequence
  source: /note="Description of Artificial Sequence: Synthetic oligonucleotide"
caccuugauuauuaaaugug

SEQ ID NO: 8622 - RNA, 20 nt, Artificial Sequence
  source: /note="Description of Artificial Sequence: Synthetic oligonucleotide"
accuugauuauuaaaugugu

SEQ ID NO: 8623 - RNA, 20 nt, Artificial Sequence
  source: /note="Description of Artificial Sequence: Synthetic oligonucleotide"
uuauccuuuguuuuugagac

SEQ ID NO: 8624 - RNA, 20 nt, Artificial Sequence
  source: /note="Description of Artificial Sequence: Synthetic oligonucleotide"
uauccuuuguuuuugagaca

SEQ ID NO: 8625 - RNA, 20 nt, Artificial Sequence
  source: /note="Description of Artificial Sequence: Synthetic oligonucleotide"
uuugagacagggucucacuc

SEQ ID NO: 8626 - RNA, 20 nt, Artificial Sequence
  source: /note="Description of Artificial Sequence: Synthetic oligonucleotide"
gggucucacucugguugccc

SEQ ID NO: 8627 - RNA, 20 nt, Artificial Sequence
  source: /note="Description of Artificial Sequence: Synthetic oligonucleotide"
cucacucugguugcccaggc

SEQ ID NO: 8628 - RNA, 20 nt, Artificial Sequence
  source: /note="Description of Artificial Sequence: Synthetic oligonucleotide"
ucacugcagccuugacuucc

SEQ ID NO: 8629 - RNA, 20 nt, Artificial Sequence
  source: /note="Description of Artificial Sequence: Synthetic oligonucleotide"
cacugcagccuugacuuccu

SEQ ID NO: 8630 - RNA, 20 nt, Artificial Sequence
  source: /note="Description of Artificial Sequence: Synthetic oligonucleotide"
ccucagccucccaaguagcu

SEQ ID NO: 8631 - RNA, 20 nt, Artificial Sequence
  source: /note="Description of Artificial Sequence: Synthetic oligonucleotide"
ucccaaguagcucggacuac

SEQ ID NO: 8632 - RNA, 20 nt, Artificial Sequence
  source: /note="Description of Artificial Sequence: Synthetic oligonucleotide"
caggcacaugccaccaugcc

SEQ ID NO: 8633 - RNA, 20 nt, Artificial Sequence
  source: /note="Description of Artificial Sequence: Synthetic oligonucleotide"
uuuuuuauuauuauuagaga

SEQ ID NO: 8634 - RNA, 20 nt, Artificial Sequence
  source: /note="Description of Artificial Sequence: Synthetic oligonucleotide"
uuuuccuauguugcccagug

SEQ ID NO: 8635 - RNA, 20 nt, Artificial Sequence
  source: /note="Description of Artificial Sequence: Synthetic oligonucleotide"
ccaguguggucuugaacucc

SEQ ID NO: 8636 - RNA, 20 nt, Artificial Sequence
  source: /note="Description of Artificial Sequence: Synthetic oligonucleotide"
ccucagccuccaaagaguga

SEQ ID NO: 8637 - RNA, 20 nt, Artificial Sequence
  source: /note="Description of Artificial Sequence: Synthetic oligonucleotide"
cucagccuccaaagagugau

SEQ ID NO: 8638 - RNA, 20 nt, Artificial Sequence
  source: /note="Description of Artificial Sequence: Synthetic oligonucleotide"
ccaaagagugaugggauugc

SEQ ID NO: 8639 - RNA, 20 nt, Artificial Sequence
  source: /note="Description of Artificial Sequence: Synthetic oligonucleotide"
agccaucacaccuagccuga

SEQ ID NO: 8640 - RNA, 20 nt, Artificial Sequence
  source: /note="Description of Artificial Sequence: Synthetic oligonucleotide"
gccugauggcagaacuuuuu

SEQ ID NO: 8641 - RNA, 20 nt, Artificial Sequence
  source: /note="Description of Artificial Sequence: Synthetic oligonucleotide"
acuuuuuaggaacaauagaa

SEQ ID NO: 8642 - RNA, 20 nt, Artificial Sequence
  source: /note="Description of Artificial Sequence: Synthetic oligonucleotide"
aggaacaauagaaugguaua

SEQ ID NO: 8643 - RNA, 20 nt, Artificial Sequence
  source: /note="Description of Artificial Sequence: Synthetic oligonucleotide"
auuguuuuccccuccuccua

SEQ ID NO: 8644 - RNA, 20 nt, Artificial Sequence
  source: /note="Description of Artificial Sequence: Synthetic oligonucleotide"
cuccuccuauggaagcauga

SEQ ID NO: 8645 - RNA, 20 nt, Artificial Sequence
  source: /note="Description of Artificial Sequence: Synthetic oligonucleotide"
uccuccuauggaagcaugaa

SEQ ID NO: 8646 - RNA, 20 nt, Artificial Sequence
  source: /note="Description of Artificial Sequence: Synthetic oligonucleotide"
uucauugugagaaccucauc

SEQ ID NO: 8647 - RNA, 20 nt, Artificial Sequence
  source: /note="Description of Artificial Sequence: Synthetic oligonucleotide"
agaaaacucacaaaacugug

SEQ ID NO: 8648 - RNA, 20 nt, Artificial Sequence
  source: /note="Description of Artificial Sequence: Synthetic oligonucleotide"
ugugaggaaccuauuaugac

SEQ ID NO: 8649 - RNA, 20 nt, Artificial Sequence
  source: /note="Description of Artificial Sequence: Synthetic oligonucleotide"
cuauuaugacuggaugccuu

SEQ ID NO: 8650 - RNA, 20 nt, Artificial Sequence
  source: /note="Description of Artificial Sequence: Synthetic oligonucleotide"
agauuuuccuaucccaacac

SEQ ID NO: 8651 - RNA, 20 nt, Artificial Sequence
  source: /note="Description of Artificial Sequence: Synthetic oligonucleotide"
cccaacacugguuccuacag

SEQ ID NO: 8652 - RNA, 20 nt, Artificial Sequence
  source: /note="Description of Artificial Sequence: Synthetic oligonucleotide"
uuuuuauccaucugcuuccu

SEQ ID NO: 8653 - RNA, 20 nt, Artificial Sequence
  source: /note="Description of Artificial Sequence: Synthetic oligonucleotide"
caucugcuuccuugguugug

SEQ ID NO: 8654 - RNA, 20 nt, Artificial Sequence
  source: /note="Description of Artificial Sequence: Synthetic oligonucleotide"
aucugcuuccuugguuguga

SEQ ID NO: 8655 - RNA, 20 nt, Artificial Sequence
  source: /note="Description of Artificial Sequence: Synthetic oligonucleotide"
uacaucuuuuaaccuguugu

SEQ ID NO: 8656 - RNA, 20 nt, Artificial Sequence
  source: /note="Description of Artificial Sequence: Synthetic oligonucleotide"
ucgaguuuucauuuacaaca

SEQ ID NO: 8657 - RNA, 20 nt, Artificial Sequence
  source: /note="Description of Artificial Sequence: Synthetic oligonucleotide"
uuuuugauuccugacuguau

SEQ ID NO: 8658 - RNA, 20 nt, Artificial Sequence
  source: /note="Description of Artificial Sequence: Synthetic oligonucleotide"
acuugacauacaguccaucc

SEQ ID NO: 8659 - RNA, 20 nt, Artificial Sequence
  source: /note="Description of Artificial Sequence: Synthetic oligonucleotide"
gaauguguauauucagcugu

SEQ ID NO: 8660 - RNA, 20 nt, Artificial Sequence
  source: /note="Description of Artificial Sequence: Synthetic oligonucleotide"
uguguauauucagcuguugg

SEQ ID NO: 8661 - RNA, 20 nt, Artificial Sequence
  source: /note="Description of Artificial Sequence: Synthetic oligonucleotide"
guguauauucagcuguuggu

SEQ ID NO: 8662 - RNA, 20 nt, Artificial Sequence
  source: /note="Description of Artificial Sequence: Synthetic oligonucleotide"
uauauucagcuguugguggg

SEQ ID NO: 8663 - RNA, 20 nt, Artificial Sequence
  source: /note="Description of Artificial Sequence: Synthetic oligonucleotide"
agaugucuguuagaccuagu

SEQ ID NO: 8664 - RNA, 20 nt, Artificial Sequence
  source: /note="Description of Artificial Sequence: Synthetic oligonucleotide"
cuuuuagccauuauugaaag

SEQ ID NO: 8665 - RNA, 20 nt, Artificial Sequence
  source: /note="Description of Artificial Sequence: Synthetic oligonucleotide"
auuuuuugcuucauguauuu

SEQ ID NO: 8666 - RNA, 20 nt, Artificial Sequence
  source: /note="Description of Artificial Sequence: Synthetic oligonucleotide"
cauuuguuacaucauuuuaa

SEQ ID NO: 8667 - RNA, 20 nt, Artificial Sequence
  source: /note="Description of Artificial Sequence: Synthetic oligonucleotide"
auuuaacauaauuauugaua

SEQ ID NO: 8668 - RNA, 20 nt, Artificial Sequence
  source: /note="Description of Artificial Sequence: Synthetic oligonucleotide"
aacauaauuauugauaaggu

SEQ ID NO: 8669 - RNA, 20 nt, Artificial Sequence
  source: /note="Description of Artificial Sequence: Synthetic oligonucleotide"
aaauuuuuugauguucuuaa

SEQ ID NO: 8670 - RNA, 20 nt, Artificial Sequence
  source: /note="Description of Artificial Sequence: Synthetic oligonucleotide"
gauguucuuaaugguuuccc

SEQ ID NO: 8671 - RNA, 20 nt, Artificial Sequence
  source: /note="Description of Artificial Sequence: Synthetic oligonucleotide"
auguucuuaaugguuucccu

SEQ ID NO: 8672 - RNA, 20 nt, Artificial Sequence
  source: /note="Description of Artificial Sequence: Synthetic oligonucleotide"
uguucuuaaugguuucccug

SEQ ID NO: 8673 - RNA, 20 nt, Artificial Sequence
  source: /note="Description of Artificial Sequence: Synthetic oligonucleotide"
accaauuucauuacaauaua

SEQ ID NO: 8674 - RNA, 20 nt, Artificial Sequence
  source: /note="Description of Artificial Sequence: Synthetic oligonucleotide"
accuauguaauuaucuuuac

SEQ ID NO: 8675 - RNA, 20 nt, Artificial Sequence
  source: /note="Description of Artificial Sequence: Synthetic oligonucleotide"
cuggugcucuuuaaguucuu

SEQ ID NO: 8676 - RNA, 20 nt, Artificial Sequence
  source: /note="Description of Artificial Sequence: Synthetic oligonucleotide"
uaaguucuuagguguauuug

SEQ ID NO: 8677 - RNA, 20 nt, Artificial Sequence
  source: /note="Description of Artificial Sequence: Synthetic oligonucleotide"
auacauuuaguauuuuuugu

(The sequence listing continues in the following parts.)

The invention claimed is:

1. A composition comprising:
a) a gRNA molecule or a nucleic acid sequence encoding the gRNA molecule, wherein the gRNA molecule comprises a tracr and crRNA, wherein the crRNA comprises a targeting domain that is complementary to a target sequence selected from a TET2 intron and a TET2 intron-exon junction, wherein the targeting domain is complementary to a sequence within a genomic region of chr4:105269748-105272563, wherein the location of the sequence within the genomic region is according to an alignment with the human reference genome hg38; and
b) a Cas9 molecule or a nucleic acid sequence encoding the Cas9 molecule, wherein the Cas9 molecule comprises an amino acid sequence of SEQ ID NO: 123.

2. The composition of claim 1, wherein the targeting domain is complementary to a sequence within a genomic region selected from: chr4:105270624-105270643; chr4:105270630-105270649; chr4:105271863-105271883; chr4:105271340-105271360; chr4:105271204-105271223; chr4:105271526-105271546; chr4:105270350-105270370; chr4:105270268-105270288; chr4:105272182-105272202; chr4:105272465-105272485; chr4:105271387-105271407; chr4:105272436-105272456; chr4:105271924-105271944; chr4:105272323-105272343; chr4:105272057-105272077; chr4:105272309-105272329; chr4:105272324-105272344; chr4:105271184-105271204; chr4:105271190-105271210; chr4:105271295-105271315; chr4:105271292-105271312; chr4:105271458-105271478; chr4:105270635-105270655; chr4:105271173-105271192; chr4:105271232-105271252; chr4:105271845-105271865; chr4:105271849-105271869; and chr4:105271056-105271076.

3. The composition of claim 1, wherein the targeting domain comprises or consists of any one of SEQ ID NO: 1000 to SEQ ID NO: 10514 or SEQ ID NO: 10515, or a fragment thereof.

4. The composition of claim 3, wherein the fragment comprises 17, 18, 19, or 20 consecutive nucleic acids of any one of SEQ ID NO: 1000 to SEQ ID NO: 10514 or SEQ ID NO: 10515, wherein the 17, 18, 19, or 20 consecutive nucleic acids are disposed at the 3' end or at the 5' end of the targeting domain.

5. The composition of claim 1, wherein a portion of the crRNA and a portion of the tracr hybridize to form a flagpole comprising SEQ ID NO: 50 or SEQ ID NO: 51.

6. The composition of claim 5, wherein the flagpole further comprises a first flagpole extension, a second flagpole extension, or a combination thereof, located 3' to the crRNA portion of the flagpole, wherein the first flagpole extension comprises SEQ ID NO: 55 and wherein the second flagpole extension comprises SEQ ID NO: 57, and wherein, if the gRNA comprises both the first flagpole extension and the second flagpole extension, the second flagpole extension is located 3' to the first flagpole extension.

7. The composition of claim 1, wherein the crRNA comprises, from 5' to 3', [targeting domain]-:
(a) SEQ ID NO: 50;
(b) SEQ ID NO: 51;
(c) SEQ ID NO: 77;
(d) SEQ ID NO: 78;
(e) SEQ ID NO: 79;
(f) SEQ ID NO: 80; or
(g) SEQ ID NO: 81; and/or
wherein the tracr comprises:
(h) SEQ ID NO: 53;
(i) SEQ ID NO: 54;
(j) SEQ ID NO: 82;
(k) SEQ ID NO: 83;
(l) SEQ ID NO: 65;
(m) SEQ ID NO: 84;
(n) SEQ ID NO: 87;
(o) SEQ ID NO: 76;
(p) SEQ ID NO: 85;
(q) SEQ ID NO: 86;
(r) any one of h) to q), above, further comprising, at the 3' end, at least 1, 2, 3, 4, 5, 6 or 7 uracil (U) nucleotides;
(s) any one of h) to q), above, further comprising, at the 3' end, at least 1, 2, 3, 4, 5, 6 or 7 adenine (A) nucleotides; or
(t) any one of h) to s), above, further comprising, at the 5' end, at least 1, 2, 3, 4, 5, 6 or 7 adenine (A) nucleotides.

8. The composition of claim 7, wherein the tracr comprises SEQ ID NO: 53 or SEQ ID NO: 54, and if a first flagpole extension is present, the gRNA further comprises a first tracr extension, disposed 5' to SEQ ID NO: 53 or SEQ ID NO: 54, said first tracr extension comprising SEQ ID NO: 56.

9. The composition of claim 1, wherein
(a) the targeting domain and the tracr are disposed on separate nucleic acid molecules, and wherein the nucleic acid molecule comprising the targeting domain comprises SEQ ID NO: 79 and the nucleic acid molecule comprising the tracr comprises SEQ ID NO: 65, or
(b) the targeting domain and the tracr are disposed on a single nucleic acid molecule, wherein the gRNA molecule comprises a loop disposed 3' to the targeting domain and 5' to the tracr, wherein the loop comprises SEQ ID NO: 52.

10. The composition of claim 1, comprising, from 5' to 3', [targeting domain]-:
(a) SEQ ID NO: 71;
(b) SEQ ID NO: 72;
(c) SEQ ID NO: 73;
(d) SEQ ID NO: 74;
(e) SEQ ID NO: 75; or
(f) any of (a) to (e), above, further comprising, at the 3' end, 1, 2, 3, 4, 5, 6 or 7 uracil (U) nucleotides.

11. The composition of claim 1, wherein the gRNA molecule comprises one or more nucleic acid molecules, wherein the one or more nucleic acid molecules comprises:
(a) one to three phosphorothioate modification(s) at the 3' end of said nucleic acid molecule or molecules;
(b) one to three phosphorothioate modification(s) at the 5' end of said nucleic acid molecule or molecules;
(c) one to three 2'-O-methyl modification(s) at the 3' end of said nucleic acid molecule or molecules;
(d) one to three 2'-O-methyl modification(s) at the 5' end of said nucleic acid molecule or molecules; or
(e) a 2' O-methyl modification at each of the $4^{th}$-to-terminal, $3^{rd}$-to-terminal, and $2^{nd}$-to-terminal 3' residues of said nucleic acid molecule or molecules.

12. The composition of claim 11, wherein the gRNA molecule comprises a combination of any of a-e.

13. The composition of claim 1, formulated in a medium suitable for electroporation.

14. The composition of claim 1, wherein the gRNA molecule and the Cas9 molecule are present in a ribonuclear protein complex (RNP).

15. The composition of claim 1, further comprising one or more additional gRNA molecules or one or more additional nucleic acid molecules encoding the one or more additional gRNA molecules.

16. The composition of claim 15, wherein the one or more additional gRNA molecules comprises a targeting domain complementary to one or more of: a target sequence of an inhibitory molecule, PDCD1, a component of the T cell receptor, TRAC, TRBC, B2M, HLA-DM, HLA-DO, HLA-DR, HLA-DQ, HLA-DP, CIITA, RFXANK, RFXAP, RFX1, RFX5, NF-YA, NF-YB, NF-YC, X2BP, OCAB, HLA-A, HLA-B, HLA-C, NLRC5, CD247, CD3, CD3D, CD3E, CD3G, DCK, CD52, FKBP1A, and NR3C1.

17. The composition of claim 15, wherein each gRNA molecule is in an RNP complex with a Cas9 molecule, and wherein each RNP complex is at a concentration of 10 μM or less.

18. The composition of claim 1, wherein the composition further comprises a template nucleic acid, wherein the template nucleic acid is present in a vector and wherein the vector is a lentivirus vector, an AAV vector, an AAV6 vector, an adenovirus vector, a plasmid, a minicircle or a nanoplasmid.

19. The composition of claim 18, wherein the template nucleic acid comprises at least one 5' homology arm, at least one 3' homology arm, or a combination thereof, wherein said homology arm comprises sequence homologous to sequence of a TET2 intron.

20. The composition of claim 18, wherein:
(a) the template nucleic acid sequence is in an AAV6 vector;
(b) the template nucleic acid sequence comprises a nucleic acid sequence encoding a CAR selected from a CD19 CAR, a BCMA CAR, and a CD22 CAR; and/or
(c) the template nucleic acid sequence comprises a first homology arm comprising SEQ ID NO: 124 and a second homology arm comprising SEQ ID NO: 125.

21. The composition of claim 20, wherein the CAR is:
(a) a CD19 CAR comprising an antigen binding domain comprising an amino acid sequence of any one of SEQ ID NO: 160 to SEQ ID NO: 172 or SEQ ID NO: 175 or comprising any one of SEQ ID NO: 185 to SEQ ID NO: 197; or
(b) a BCMA CAR comprising an antigen binding domain comprising an amino acid sequence of or encoded by any one of SEQ ID NO: 239 to SEQ ID NO: 412 or any one of SEQ ID NO: 849 to SEQ ID NO: 863 or any one of SEQ ID NO: 879 to SEQ ID NO: 899; or
(c) a CD22 CAR.

22. A method of altering a target sequence of a cell, comprising contacting said cell with the composition of claim 1.

23. The method of claim 22, wherein the gRNA molecule and the Cas molecule are present in a ribonuclear protein complex (RNP).

24. The method of claim 22, wherein the composition further comprises a template nucleic acid, wherein the template nucleic acid is present in a vector and wherein the vector is a lentivirus vector, an AAV vector, an AAV6 vector, an adenovirus vector, a plasmid, a minicircle or a nanoplasmid.

25. The method of claim 24, wherein the template nucleic acid comprises at least one 5' homology arm, at least one 3' homology arm, or a combination thereof, wherein said homology arm comprises sequence homologous to sequence of a TET2 intron.

26. The method of claim 24, wherein:
(a) the template nucleic acid sequence is in an AAV6 vector;
(b) the template nucleic acid sequence comprises a nucleic acid sequence encoding a CAR selected from a CD19 CAR, a BCMA CAR, and a CD22 CAR; and/or
(c) the template nucleic acid sequence comprises a first homology arm comprising SEQ ID NO: 124 and a second homology arm comprising SEQ ID NO: 125.

27. The method of claim 26, wherein the CAR is:
(a) a CD19 CAR comprising an antigen binding domain comprising an amino acid sequence of any one of SEQ ID NO: 160 to SEQ ID NO: 172 or SEQ ID NO: 175 or comprising any one of SEQ ID NO: 185 to SEQ ID NO: 197; or
(b) a BCMA CAR comprising an antigen binding domain comprising an amino acid sequence of or encoded by any one of SEQ ID NO: 239 to SEQ ID NO: 412 or any one of SEQ ID NO: 849 to SEQ ID NO: 863 or any one of SEQ ID NO: 879 to SEQ ID NO: 899; or
(c) a CD22 CAR.

28. The method of claim 22, wherein the cell is an immune effector cell or a population of immune effector cells.

29. The method of claim 22, further comprising introducing into said cell one or more CRISPR systems comprising one or more gRNA molecules or one or more nucleic acids encoding one or more gRNA molecules complementary to a target sequence of an inhibitory molecule, a component of the T cell receptor, TRAC, TRBC, B2M, HLA-DM, HLA-DO, HLA-DR, HLA-DQ, HLA-DP, CIITA, RFXANK, RFXAP, RFX1, RFX5, NF-YA, NF-YB, NF-YC, X2BP, OCAB, HLA-A, HLA-B, HLA-C, NLRC5, CD247, CD3, CD3D, CD3E, CD3G, DCK, CD52, FKBP1A, and NR3C1.

30. The method of claim 29, wherein each gRNA molecule is in an RNP complex with a Cas9 molecule, and wherein each RNP complex is at a concentration of 10 μM or less.

31. A method of reducing or eliminating the expression of at least one isoform of TET2, or a function of TET2 in a cell, wherein the method comprises introducing into the cell the composition of claim 1.

32. The method of claim 31, wherein the gRNA molecule and the Cas molecule are present in a ribonuclear protein complex (RNP).

33. The method of claim 31, wherein the method further comprises contacting said cell with a template nucleic acid, wherein the template nucleic acid is present in a vector and wherein the vector is a lentivirus vector, an AAV vector, an AAV6 vector, an adenovirus vector, a plasmid, a minicircle or a nanoplasmid.

34. The method of claim 33, wherein the template nucleic acid comprises at least one 5' homology arm, at least one 3' homology arm, or a combination thereof, wherein said homology arm comprises sequence homologous to sequence of a TET2 intron.

35. The method of claim 31, wherein:
(a) the template nucleic acid sequence is in an AAV6 vector;
(b) the template nucleic acid sequence comprises a nucleic acid sequence encoding a CAR selected from a CD19 CAR, a BCMA CAR, and a CD22 CAR; and/or
(c) the template nucleic acid sequence comprises a first homology arm comprising SEQ ID NO: 124 and a second homology arm comprising SEQ ID NO: 125.

36. The method of claim 35, wherein the CAR is:
(a) a CD19 CAR comprising an antigen binding domain comprising an amino acid sequence of any one of SEQ ID NO: 160 to SEQ ID NO: 172 or SEQ ID NO: 175 or comprising any one of SEQ ID NO: 185 to SEQ ID NO: 197; or
(b) a BCMA CAR comprising an antigen binding domain comprising an amino acid sequence of or encoded by any one of SEQ ID NO: 239 to SEQ ID NO: 412 or any one of SEQ ID NO: 849 to SEQ ID NO: 863 or any one of SEQ ID NO: 879 to SEQ ID NO: 899; or
(c) a CD22 CAR.

37. The method of claim 31, wherein the cell is an immune effector cell or a population of immune effector cells.

38. The method of claim 31, further comprising introducing into said cell one or more CRISPR systems comprising one or more gRNA molecules or one or more nucleic acids encoding one or more gRNA molecules complementary to a target sequence of an inhibitory molecule, a component of the T cell receptor, TRAC, TRBC, B2M, HLA-DM, HLA-DO, HLA-DR, HLA-DQ, HLA-DP, CIITA, RFXANK, RFXAP, RFX1, RFX5, NF-YA, NF-YB, NF-YC, X2BP, OCAB, HLA-A, HLA-B, HLA-C, NLRC5, CD247, CD3, CD3D, CD3E, CD3G, DCK, CD52, FKBP1A, and NR3C1.

39. The method of claim 38, wherein each gRNA molecule is in an RNP complex with a Cas9 molecule, and wherein each RNP complex is at a concentration of 10 μM or less.

40. A method of engineering a cell to express a chimeric antigen receptor (CAR), comprising:
 (a) introducing into said cell a CRISPR system comprising the composition of claim 1; and
 (b) introducing into said cell a template nucleic acid comprising nucleic acid sequence encoding a CAR;
 wherein said nucleic acid sequence encoding a CAR is integrated into the genome.

41. The method of claim 40, wherein:
 (a) the template nucleic acid sequence is in an AAV6 vector;
 (b) the template nucleic acid sequence comprises a nucleic acid sequence encoding a CAR selected from a CD19 CAR, a BCMA CAR, and a CD22 CAR; and/or
 (c) the template nucleic acid sequence comprises a first homology arm comprising SEQ ID NO: 124 and a second homology arm comprising SEQ ID NO: 125.

42. The method of claim 40, wherein the CAR is:
 (a) a CD19 CAR comprising an antigen binding domain comprising an amino acid sequence of any one of SEQ ID NO: 160 to SEQ ID NO: 172 or SEQ ID NO: 175 or comprising any one of SEQ ID NO: 185 to SEQ ID NO: 197; or
 (b) a BCMA CAR comprising an antigen binding domain comprising an amino acid sequence of or encoded by any one of SEQ ID NO: 239 to SEQ ID NO: 412 or any one of SEQ ID NO: 849 to SEQ ID NO: 863 or any one of SEQ ID NO: 879 to SEQ ID NO: 899; or
 (c) a CD22 CAR.

43. The method of claim 40, further comprising introducing into said cell one or more CRISPR systems comprising one or more gRNA molecules or one or more nucleic acids encoding one or more gRNA molecules complementary to a target sequence of an inhibitory molecule, a component of the T cell receptor, TRAC, TRBC, B2M, HLA-DM, HLA-DO, HLA-DR, HLA-DQ, HLA-DP, CIITA, RFXANK, RFXAP, RFX1, RFX5, NF-YA, NF-YB, NF-YC, X2BP, OCAB, HLA-A, HLA-B, HLA-C, NLRC5, CD247, CD3, CD3D, CD3E, CD3G, DCK, CD52, FKBP1A, and NR3C1.

44. The method of claim 43, wherein each gRNA molecule is in an RNP complex with a Cas9 molecule, and wherein each RNP complex is at a concentration of 10 μM or less.

* * * * *